United States Patent 7,868,149 (PLANT GENOME SEQUENCE AND USES THEREOF) - sequence listing, part 56

SEQ ID NO: 30375 - DNA, 17469 bp, Oryza sativa
  unsure (1)..(17469): unsure at all n locations
tccacacccctgcatcgctcaatcaaatcacgcagatgattgagatttaaatgcacctgtcacgaaaacacgagaatgagaaaattaaataaactcgccgtacttgtcatggagcattttaggttcctctatgatttttttttttaaaaaaaacgggggttggggttggagtccccgtcaagggaggacgcggttaaccagcagagcacaagaaatgccagtttactgccgctttcgtccgcttctgcgagctcctccgctaccacgtctgcatcagattgacttcacggtttttaaaaatgcccaatcgtcctaacgatcattgggcgtgcgaaccggttttgttagttagttagctccgcctaatgaaatcactaaccaaaccgccctctcttttgtttagttagctcgcatcgatgtggtggtgccaagtagacatgggctaagcactatgccgttttgcaaattgctgctggtgctgctgagatggtggctagagaacggcactgtggttaagatcaaagcatttcactagatgtagtgggcgtctccctttactttccacccatctcctctccttttctttctctggggcttcgggtgctcgttgattgcacagtccccgggttattttagaggcgaacaaggtcacgttctagagttcgttttctgcacgcacactatgagctgtactttttggacggacatgcatggagtacatgctcctcttctctctctctacctcgcttccctgcctgctttattcttgcttcgttttggttcttttttcccttattagactccagcactttcgttttttcgaaaagaaaaagttgacggcagcagttgggtcaatatcgtttcgatggtggatattatggttatccgtcagttcgacgggcgggcaacggtcgtactcgtacactgtcaagcaatagctcaaagatcaatcgtaccctgctgcgcccttttggaaatgaacacggccgtctttgcacgtgctactgcgatgttttactcaggagatcacaaagacaactctaaactcagtttttttaaggtctaaaaattactgtataattaaagatttaagagatctttatattacctgtcatatggtgggggttcttttagccatacatgcacatcatatttatgcgcatcatgaaaccatgaatgtaccccttattctaagcaccagggtcgtaaacaatggtgcacatcaccatttcagagagaatgctacataatgtttttttctcatgattatgtgaagtataaagaaagaggagagaaatagatatcatacttattaatatatagaaatatactccctccgtttcatattataagacgttttgactttgataaaagtcaaattgtttcgagtttgattaagtttatagacaaatagtaatatttatactaacaaattagtttcatcaaatcactaattgaatatattttcataataaatttttcttggtttgaaaatattactatttttctataaacttggtcaaacttaaagcagtttgactttgactaaagtcaaaacgtattataacctgaaacgggagtagatagtagtcatttaaacaattttttgtgtcctgcaataaatagcttaaccaagcattaaaataaaacggtgcaaaagaagattccaatggtttttaaaggaattgtttgttaggtaagaactaggatgtggatctttagtttggcatataccgactatataaagaagcaattgctgtaaaagaagtgattgcacggtttggtagccaaatagggctgattgtgttgagtgagcatcaaagaggttttagcgtatgaaacaatacacatagagcagcagaggcatgtggcttttacaaagaaatcaaaacagagcagcactgtttatatatgccaagttcatctgtaagtcgcctccctgatgaatgttcacatgccaattactagaggtgggcgttcggtctacccgaaaatttcgatctcggtcttcggtttttcggtcaattcggtttttgaaaagtcaggaccgaatttcatccaaaaaaatcaagaccgataaatccggtctcggttttttcggtctcggtctcgatcagaccgaattcggaggagccgagccagagggcggagacgacgctggcgacgtcgaggcggagggcggagacgacaccggcgatgtggaggaggagggcgaaggtggcggtgcggcccgatggatccggcagtcggcggtccacgcgaccggcgaggcggcgtggaggcggagggcaaagacgtcgccggcgatgtggaggcggagggcggaggtggcagcgtggcgcgatggatctggcggccagcggcccgcgcgatcggcgaggcagcgtgaaggcgaacacggcgccgacgatgtggaaggcggagggcggaggtggtggcgcggcgtgatgaatccggtggcccggcgcgaccgacgaggcggcgtggaggcggagggcggagtcggcgccgacgatgtggaggcggcggcgcggcgcgacgcgatggaggcagaggaggtgtgctcacacgggatggaagggagggcggcgcgatggggatggggatggaagggagggcggcgcgatggctggatggatggggatgcagcctgtgggttgtctctagggtttagtggtgtactgggcctcctggacctattgggccacaatttgattttctcggttaattcgattaaccgagcccaataaccgaattacccgaacaaatttcggtctttgacatgttgagaccgaattactacccgaatttctcggtctcggtcttttcggttcggttctttggttcggtcttattttgcccacccctaccaattaccataatccattttttcaataggtaataatcgatggttcaattgatatcgcccaatataatttgttaccactgtcccttttttaaattgttccaggagtatgacatttggttattatttgttagattgttccagaagaaaacatcatcttctcttgaaggaattaataaccgtccaatacaaccaactaagacaaaaattaacacatttctgttttgctttatgaggcctagtggtaatgggacccactgcttactccaaaggggaaaattaaataagctaccgtgatcgcgatcgatggaaatgcattgtaatttttgcaaacccgaacgacgaagtaagcgcccatggatccatccgtctcctgattgggacataattaagaagaaaacttggttatgatacaaaacttacaaaaagggaccacttgaaaaaaaaaataacatactgatatctgatccaattctttaggctgtgctttgtacggggtttggaggagatcaaaatttgaatatcaagcacatagattttacttcatatatataaacactgctaatctcaggaacaaattagtaaacacagggaaacatgttgattcaatgataaagtcatgggtacatggctcgacttgatagagttcaatcttgatgactataaatattacatacatatgtgtgtgttttgaatagaaatttaatgagcctagagttttttggaattttcttggaatattatgcataaacgtgtacctttgggtttttaacgggcctaaagaaatttcaaaatatacgcattgtaaatattttcatccgtttctttaagaattagggagggctgatctccgtctatttaaactgtttgttccagaagctgtgagtgtggtatgtaaaagtataattaaagagcgaaaggtgatatttgtatcattgttctcctttgtttgttgtgttgtgttgcatttcttatctttggcttggcaaaatggcaaggtgcgtgccgtggtatccaccttgtttgacgtctcattgtttagtgtctcgttagatgttgaggtggtgatttgtcagcatagacgtgcagctaacagattttacttgttcgatagaataaacctagaagattacagttggtgcgattaaattagaggactcttatctcctttcacgcaaattaaatatagctactagccaacgctcacgccggccggacaagttgaccgtgtcattgaaggaaaacgtaccatatatacaaaagagaggcgaatttgatgtggatttgttttttatttgaccgtgtgatcttcaatgtatgattggaggagaattcgttaggtctacctcactttttaaagtgcgttttgccaattgtcaattttgacttttagatattgattcatagaaaaatacagcataagaaaggtaacagcgtggattaattgggctgagttttggggtcaaagggaaaaaaaattacctcagggtcaaagggtagagtttggcttgtagagactgataggtcaaaaggtatgattctactggcaaatttttgaagttttcttcagattgcaagttgggtgtacctgcttttgaaaagattatggatcttatagcagagcattgatggtttacatgttagtcctccatccatgtagtcgcaaaaaatatatatttgtgaatactccctccgtactttacgaaagtcgttaggacagcgacacggtctccaaagcacaactttgacttcttatttctataaaaatatttattgaaaagtgatatatgtatacttttatgaaagtatttttcaagacaaatctatttatataatttttatattttcaaactcgacaacttgagagttattcatgatttatatttctaagttttgacttaaacattgccctaaacgactttttttataagtacggagggagtactaaattacagaaacttaatggtaagaattaaatttcagaaactaccatgttttatgtccccacggtctcaccaatatcagaactgcttccctcattagaaagagtaatgacttgctgtcatttagtttttttctattgatatatacaaagtcataaacgttgtaccaattacaagatattcatatctttatgttgatactttattttagtcaaagagtaaacaattcgatcacgactcaaagtattcacgaccagatcgaactggacgcagtagctcattacagtagcggattaaaaaagaagtcgttaggctcactagtcaaatatatagtatgtcaaatttgttacaggacactaaaagtatgtggactttaatacgagaccacctaaagaacgtgtattttttcgtggacattgtaaaatatggtaattagctattagacacccctggattattttattatatccggtcaatatggagagaaagagcgttgaaagtaccattttgcccctaggttgttttggcttgtaaagacgactaccactggttccaactagacccagttcactccccacgcacttgatcctctttgctcgaaccctaggttttggggcaacgatgacggtgcgaaggcgacacggggtcttgacgctggcgtgggcttcatggtcggcgccgtcggcggcacgttcaccacttgtttaggggccttctgtgactccccgtgcggctgccactttgccggcgccatccatgacggcgttcccgtgtcgccacctgctgggcccgccttggcgtctatagcgccgccttttctacccactcgtgggcgaccgataggaaggacgacccactcgtctccatcgctgccacgggggccatcgtccgcttgtgccacgagccgctcgccgtgggacatatgccacactgtcgtcgacacacctaaacctagggtttggaggagaggggattgtgaaactgaacgggcaattggcctgcttcgaacgtgtctcggacgggttaaacaacattggcccaagggcaaacttgccttttatttaagtttctctctccatcttgactggatataataaaattatgcgaagggtgttcatcagctaattactacatgtttgcggtgtctcacaacaaatgccataaactcttagtgtcctatagcaaattttgtctatatagtaatcccttcatccaaaaaatagcttcagttttaacctcttagttatctctactattattataaaaattgaagatgttttcgtcaatactttggtacgtcgtctttatttgtgtttgtttttaagttcgttcgtttttggaaatacataaagagtcatataagaaatccttttaaaaacctcgcatgctaacttcggacgaaaggcggactcctaattgctatataattctcgctagaccataaaagcaacgtatagaatacgatcatcatcccaataaggatcatatcataataaggattccgaattagatatcaatactatcaaaataaaaatcccatatatactttttagaaaaaaaattaacaataatacaattaaaatagccttcacccgttgcaacgcacatgcattttttctagttctaaaataagtttttttatatgctcttatctgtcattatcgttagtccgtaaattaataaattttatttttcaataccccttagagcaagtttaatacaataatatatccaactattagcttaaaaattgaaacatcatctgtagccaacctaactcatacaatagttagttgtagatatgtactacattatttatacataatttacacatctcgcttgcatagtttattggaacccgtgctatagttagttataaatttgtaggccgagttttttctctctcctccacataaatataaacgtgatgtgacaacttgtacaacccgcttattgtactcgctcttacccacctcttatataccactcattaatattgttttttttattaatgaggatcacattggtatttctccgtcaccttatttaattttgcaccacgtagttaaagttattttgtgatggatggagtagtgtcagagtgtgttataagaacattttccaatttctaatgtgcattagtagttttttttttgcatgggtattagcactccctctgtttcatattacgagtcatctagagcaggtacaatagcaggctataagccagctataaacatattttaaagagataaaagaagagagagaagagcatcgggctacagatctgtagccagctgcatcacggactccaagacgtaatgtgtgtatgataggtgggaccaggtattaatagtatagtaagcaactattgtatgaattggctattatattggctatagatgatttggagctagtagtgggctatactattaaactttctcttataatgatgcacatctaatcaatatttttaaaaacatactatcaaaatatattttgaatttagtaaaattaatttggtgttatggatattgttaattttatttataaactaagttaaatttaaagttttactttaaaagaaattaaagtgcgttgtaatatgaaacggatgaagcggtggattagctatagcctataagtcattatgacccccgatacttacgtgcgagctaacacgcacaaaagtcaaaagtcaacacagggagtttgcacgtctcagccgttcgatcccttccgcgtgatagaataatcctatcgagcaggaagagattattagctgggcgcatctcaagtaggacaaacagtctcatcaccaccagcgacgtggcagttttggcaccaatgtcgtcgaccgatttttccccgtcctcctcccccgcgcgcgcgcgactccgacgcgtacccacgtccccgcacgtttctaatttgggcacgaacggcggccgtcgcccacatggtgatggatggatggatggcaacgtacgtcgtttccggtcgtcgacgacgtacgtacgcgtgctagctagctcgccccgatcgacaactggtgaatcgctgtactgtacatttgccagtttgccggccgctccggctgtataaatgacgaccggttcagccgcgacgacgacgacgacgggtgtcgccagcgcgacgatcgcggaagatgacaaggacgagccgtctgcgtacgcgcgcctaagtcggccaagcgcgaacggcgcggctcgctctcgcatgagacgtgccatgacggccgacgtaagtgctaacgtgtgtgggtgaccagtctccacaagccccggtaaacgtaccacgcgcgtactactacgtatcatcatatcgtgaaaccaaaccaacgcgcatggccacacaggcttggggggctctctatcccgatacggcaagttaaccgttccgttcaacaaccacgaacggaacagggtggacggagagatgggtacgtacgggtcgcgcgcgcgcaaagatacaaacgcgtccctttctctctcgcgcgcgcaccacggaaaattgagcggcgcgtttacgggagagaacggcgcgccgagactcggttcgcacttggcatgtacgtaccaccggccggtcagcgtcacccatctgctgctcggccgcgtggttgttagcccatgcgcgcgccgccacgcctacgcggttactcccgatcgccaattaaaccacaggtttctcttacgtgatggtcgagctaggtggaattagatggatatatatccggccggccgtacgcatgcgtgcatgcaccgttggatcactgtacgtacagtgtacacacactgtgccacgttcgattctgtattcctgcgcgtacgtacgtacgctcccacgttggtgtggccattattgattcttcacgatcgaacagtggcaggaaaggtacgtactactttcttcgcggtcgctgtagtatgattgtctgcgcgcgaccgtggaaactgaaaggcgtacgttccgcgatcgcgaaacatagaagatcagggaaaagcggcggcggcgcgcactcgatcggttggttggctgtttaagcaaagtgaatccctcgatcgatcgatcgcttcttcttctgctcgtacagcccccaaatcgttttcatgacagcgagcgacgcccgaacctgcccaataccggccatctccagcaatttttttttctctcttttggccctttcgatctctctctctctccccctcgcgtctcgccgtgattgggtttggacatggacaactactaactcctcttgtccttttgtttgctccaaaggttccctcgccgtctcgcgcacgtacatgcgagatcaccaatgagccatccatgcaacagggccactaacgacgcggctgtatgagagagtgaatcttgttggaatgaaaaaaaaaaagcgagaaaggcgttgggggcagttaacgctccacaaactccagagctgagggtgacagccataatagagacgatccaggtgatggctttacacgtgttagcttattttcccgaaggaaagagcattgaacagctatctaaccagggcccccttttatttgaaaactcagcacctgtaccttgtagatgaattcacgagttttctttatgttaaaaaagaggggcccgtgtttagttaaccaatggcatgtcacggtagatgtgttcattttgtacttgtgtactagtaattaatccccctgttgtttgatcccacgtgagtactttggctgttatatatgtcacttagcaggagtagtagtacagcaactagcagtattctctgtcttccagcgaattgcatgcatggctaaaatgattacagcagacgttttgccatcacgagttcacgacatatgattactcccactcccactcccacaaccatctctctgcgccagcgctatcacgtagccaacgccgctgcatggcaaaagttgattgctccctgtgcctgacaatgagatgggcaaagaggtacgagccggcccattggttggtgttacgttccctcgtcattgatcccttaggcccatagaattgtggaacctagagtgatttccatgggaacatcgcctctgggtttcaagtttccgcactaacaataatttcccctcgcccaagaaattagaacacgcaagtcacctgaaagtctgatagtaatatggccctgtctattttgcacttggtattgacagcattttggaatatattcattttcaaataagttcaattaagattcatatatttcagatggagatagttagtttacagggactgttttatcttaggtgatgcattgtgcaaactgcgaataattagatagaagagtgcgaggacgaacttaatgggctatatggcgtttggaactgaaaacctttttccgctgggctgtcacggaaggaataatggacttacaggctgtccctggatgatgacatctatgggctatagcttaagctttttgacgtcgtttgtgccgtgataagtctattttgcgtcctgcaactcttgctcctagctgaatcgcatccctcaactacaaaactggatataacgcatccttttatttaaaaatcggtgtaaattgcctccttaggtggtttggaaggtggttttatctgacgtggtagctttgacctagttgactggctaactcaactgtggaccccacctgtcaatgatctactccatcctatcctctcccctctgtctttacttcttcctcctctctcacctcacatcagaaatgcagggggaggctcgtcgggccattgctgtgcgggggaccgtggggtgggggggggnagggtgtttgccactttnttgccaggctaggttggttgctcggtgagggagggagtctctctcagcctgcgactatgcacagagggggaggggggtctcccagccagttcgagttgcgcgggggggagggggtcgacagaccatgggcgagttccagggggaggggttgccgggtgtgcagcgcggtgcaagaggaaggggttcaccgggccgcgccggcgcacgtgggaaggagctcactggcctcatgaaaggtggaaagtcatacatgttttttccatgtttcactgacatgtagggcccactgtaatatggtttttcatatctcacagacatgtgggccctacatgcaaaaaccacttttcaaaccatagaaggagtttatttgcaccggttttagaagataggggatgcgttacaccgggttttgtggtcgagggatgtgcttcaatcaagagcaagagattagggagtagtaataaacttattcctttgtgccgtgtgttgcacacaccgcacaacagctgacctaaataaaaggctttatgggccagccattttagcgtcgaataggcccaaatatcggtcatgggcccaacaaaagcagacccccaagaaacttacagaaaaaccttctcctgttgcctttcaatcattccccaatcaaaaaaagggtaagtttaccatcctttataaagtagaaaatatggtacctctagtactaatactatgtatcttaaggtataaggtataaaaaattttagtataaaatttaggtacctcaagatactttctcaaggattgtaaaattcctcgtcgaaaaaacattatacatgcagcaggagtcatctcctttgtgttcagattttccattgaaaaaaaaatcacgaatattagggatggacctaatatcaaataattaggagtgaggtttcgaacccaggttgtctagcccatcaccttgtggagctagccggaaagcggaaaacccttagacgtttctcgtttaaattttccattgacgagcgattaaatttacgtttttttgcgggtaattaaatttacgttttgccatatgcaggtttcaggtaataccattgtataagctattttgtcttaaaatacggcatggcaatcaatttcctcatggtgattatctataaaatgttatcttttttttgggggggggggggggggcaatcttgttgtgggaatttgtcaatagtaatttccaaacaatattaacacgcatttgtttaagagcaatttcgtcataatgttcacataattgtcaagcaaaattttcaagagtacattgatactcatttttcttccgattatcaatgtataaatgtggacaatcaatactatttctgctacatcacatgaggaattgggctagtggagtagaatcggtagaaccatgatgacgatagaataaggggataaaatgacatgtacattagcatttactggaactttcacagtttcactcgtcgatggcatgcaaaatgcaaattagacaattgccaaggggaattttttgatgtaaaagaggcccttttgctctccaaggagtcattataatgtttacccggggcttggaacgctcaaactatcttgatctcttctgaaaatcctgcgtgacgaacttaaaattcttactggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccgggaaaaaacctcgtgacaccaccgaaccaagcatggccgcgacgccaacgccaacccccggtcactgtcgagtcccccgcctagctactcctcccggcacacgctcgcagctcgctcatggaaacgtcgatgtcgacgccgctccatatccggtaaaactctcgagcagatgctcttccgattcagtagcaagccgagttggcgtgcctctgcgtgtgatgatttgatcggtgggtcgcctgctttgcacgctgcaagtcctcctcgtcgggttcacgcatttccctagttcagatggcacatcacagtctcaacagaaccttaattgtctgattgattcctcagggcatggtggaaacagaggacatgcctcatgtacgggtcaagatgcactatgtactatgtgcagtacatgtacgggtacatattgactctcgagcagtacaattcactacacttaatccaataatatctccgtcccaaaataagtgcagccgtggaaatccgtgtccaacgtttgaccatccgtcttatttaaaaaatttatgaatttttttttaaaatagtcacacataaagtactattcatattttatcatctaataacaataaaaatagtaatcataaaatttttttcataaaagacgaacggtcaaatgttgaagatgaatagtgtaaaactgcacttattttgggacggagagagtagcatagattcagagtactactgtaccagggttgctgccatccggactcatactcatggttcagttcggcgcagagcaagtaatggacgaagtcatgcaatacgctgcagaaaaatgcagaattgaaaacgttagaggctgagacgatgttgagaacaaagagtgataaccattcttgttcttcagaacgaagtcgtttcttcaattcttctacacacccagcaccgtagaagaaagcataaataagatcattacagcaaccaatattgttacttcatcagtcctagtatgaaacagtcgtgtaattcccctgtacacgttctacgctaacacaacaccctcaagcatctcacaaaatcacactacagatcccgcaaaaaagctcgagattttcagcaaagcgggcagcgcacgagcccattctcgttgcagtcggggcagcgccggaaggtgtccagctcctcgaggaacaccttgcagctgccggagcactcctcgcacggcacgaaccggacgccgccgcagccggagcacgcgtccagcgcaatgcccttgcccgcggcggccggcggcgccatctcgcagtcgcccagcgccttggacagctccccggactcgtgcatgcggcggacctcctcggcgccacccaggtgcctgccgtccgcgaacacctgcgggaggctgcccggcgcgcccagcgcggcgtggagctcctccttgaacccggcgtgcatcgacaggtcgcgctcgtcgacgagcacgccgtagccttgtaggatggacttcgtcgcccagcagtcctcgtacgtcttgcggatgccgcggaggctggtgaggtacagcaccactttccggtcgctatcaggcggcggcggtggaagctgcggctctggctccggaggcggtgacggtgacggtggcggaggcgccatcttggcgagcttcgcgtcgatcctcttctggaacgcgctgacccgctcgcgcacgatgcccggaaacctctgtatctcgcgcttcttgacgcacacctcgtcgccagggcattcgccggcagcgggaacctcgtcgagcgccttccggaaagcggcgatgatgtctggatcgaactccggtgacccgggcgtcgactgcccccgtcgctcctcgccgcggacgtcgccctcctcatccttgtcgtccaggccttccatgagctcccacacatttatcacctccggctcgcgggccggcgtcttggccggcgccgtggtggcccagcaccaattgcctctgccgcctcgccatctgctgtggcggcggcgtggtcttcgccgcgccgccgtcgtcgcgccatttcatcatctcctcgtcccggtcccgctcgagcctgagcgaccccagtgtgcaggacttgagcgagacggtgtggtgcacggcggccggaccggagcggctccgcgcgtacgccgtcttcccgccccggacgccaccccggaacgcgtgcctggaccccgtgcagcccatcgccgatccctccaccaactaacaaccaaaaatctcccgcactgccaccaatacaactcgaacgcaccactcaccggcagaggaacgactccttggatcactggaccatcacgccccgacgcggagaggagaggtcgatgtccctgcaaggccggagcaaatgcacgcgcgggaggtgggccaccgcgatgggagctcgacggcgaggtacaaaaacagttgggggaggcggcggtgggcgagatctgatggcgaggccggcgaggtagctaggtgcgtgcgtgcgagcagggaaagggaaacgctttaagccgcgggggggagaaagcgagcgaggagcgtttcgggtcacgggcacgcaccggttctcgcgcgtaaatgtgcgtattaactcgcgcgtttctggtcgggggcgtggcctccgtggagcgtggagttcccggacgaacgcctcaaggtggatggaatgattgcccgctcacaattccacgtcatttaggccatgttgatttcagtttaagattattgtaatctagattattaaattaaattactctaaactgaattataataagctgtaagttgtttgtttctctggattattagagatatctaatagtagtgggtctttagccactcaataatccataaaaagctcctctagagaagattactagattatactaatctggcttatagattataataatctagcataataatctatttgtttgtttcaacttactcctaataatccagattataataattctaagctgaatcaaacatggcgttagccaggctggtgacgggattatccatttatccacgtcggttatcgagcgatcaggcctttggattagcgggtgcgcacccctgcgtagaggtttgggtcgtttttatttggagcagagtgtttggagctattccagtgttcgttcattgtcactcgtcagcaggcagcagcgcgctgagctcgtcaattcagtgtgatcagtttggtgcactgtcatgtcagcgcggtgccggaatggtgccggaatggcgtgatttctcaagggccgtcgatgatttaatactcgtgggttgacgtgaatcggcgatgatgttgcacccgaattcaggaaattttcttgggtgttctgccgtactagtatcacgtatagtactactctgtgacgttgagaacttgagatcgcgtagcattaaaacctgctacaaacatgcggcggtcgcgtttcaaccttgaactgcagatcgccgcgttcctgaacttgaattcggcacagcgggagagtgcagcgacgagcgatgcgttgcggcgggggatcacccgtcgccgttgctcctcctgtaccgcagagtaatacacatgtgtctcacttttgtactcttcttcgataagaaaacaccgcgcttgcgccggaaaactgttttaaacactcgggtggatgtccacccgttttttgcatgtcatctaaatagttatgaaaaattttcaaaaaaattaacatgataggttaatatgtaatatatcacttcacaaacatgcaagttcaaattcaacttctataaattataacaaagataacaaatttgactgtgaatatacgtacaacttgtagaagacgaatttgaacttgcatgtttgtgaagtgatatattacatattaacatatcttgtaatttttttttaaattttttttataattatttagttggtatgcaagaaacgggtggacgtccacccgagagaatagaatccatcctccgcttgcgcctgcgcgtcgtttgacgtttggaacgagagcgagccggcgtcaaaaagtttgagccggacccggccaaagcttttacacagtctaacaccggcacgtcgttctcgtctactactcgtaacacgctcctcgcttcccacaacatttgaatctttgaacggctctgcacgatcggagccagtctgggttagaccagcgcaagagggatttgaatatttccaagccttttccgggcaaaggagtatttgagtagtatgtttttttagtagtatgatgcgtcggttggtggtgatcggtgactactctgccgacaggcgaggtcaggtggtggacgtgagcgagcaccggtttcctccgttcccttccagatgagaactgagaagaggagagtggtagtcttgcttggcgcgtggttggcatgtcgctcgagcactcacctgcccaggcgtccatccatccatctaccagctcggcttcttcctgctttcctagtagtcggtggtttgtccgattcctgctagccttttgtttttgcgtagtgcactgcacttcccagctacaaaaaggagtattgctgtgcgtgagcgtgactgcgtgttgccaagtcctcctgatgagaccgaggtcgaattttttactccctggtccgaaacagggtggatccggaacggacgcatgacagatatgcctaatctaccgaattggagctgatcgggacaggggatcgggattgttgctagcacagttggaccaccgaaacgggacgggggtaaacactgaagattggggtcctatcccggcaagaaaattgacatttagccactttcaaggatgggctgcgctgtaatgccattccgccaagttactttgctaaaatgccattcccacgctcgcgcaacacgctgcttcgccgttttttcaatttcattggattaacacacaaaatcannnnnnnnnnnnnnnnnnnnnnnnnnnnnnnnnnnnnnnnnnnnnnnnnnnnnnn

SEQ ID NO: 30376 - DNA, 23294 bp, Oryza sativa
cttgcccacattgccacctacgccgcgcttgctcttcccccaactgtcgacgcccggcaccatagctgccgaggccaagaagatctggaccatctggtcatctttggcgccatgaatccggccacttccgccaacggggctgctgccatcatcgacccgccgtctcacacggttcaatgggcatcatcacacgcctatgcttcatgtccttctttactagcaggttaaaaaatccttatggatttatttgctaatcatctttacctaatacatatctggtataattctttgttgccttggttttattactatatttttaggtcatcaggtggagaagccatccatatgctaaataggtctcaagataggagtgagcagcaagttcggttttcattgggccatactcctcatctgaacaaacaggtttacatagtttacatagttgttttacagcctataataggaaaaagaatattggatagcttgttattgtgaggtgatcttgtttgttgttggatgatattaattgattgattgttttattaggaattctcggcaggtgtgttgatttctattttgcttaattttgtttaattctgcagccatcatggcccagggagtataaagttgaatagagcggttgcgatgacggcagctcagctcaacaatggcactgggcgtgcactgggaggtatgcttaaaggagagtgttgtagcatttgcatttttggcagttaagtttgagcactggatacaaatcattgatcttctagaagtaacattttgattcctgcaaactaatgcggcacctctgtctcaacactgtcatcaggccagtctgctccccagtttggcactccttgtggtaagggaaacgaggagaaagaaatgaccgaccaacaggttgtgaaagacaccaacgacctgcatcacgcaaataaacaggtatttattattttggttagtttggtttgttgtgcagatattaattaaggccaggggtaggggttgaagacttatggatgaatccggtaccgtaaccttcacatttgaccgttcattagtagctaaatggacggctaccatgcatctgatacatcaatctgtaggctaatgacatatcttgagttatagcgatactttctttaaacaattgctatctttttatgtactgaaatttgcataatccttatgatgtgtttttctttaatcatatttatgtaattaatacatgtagaggataagaagagagatgattagcttctgcatttctgagatgtgaatatctaactaggtatccagatcctaagaaaaaatatcttcagagaatagtatcaagcaaatattcagagaaaacagtgggcccattttttttggggtatttcataccattaatcgtagcattcggcagttctgcagttatgtatactttgcacttctattgtgcaaatgttatgttacaatatatatgctgttctgaaggtccatgacgaaattcttgctgcaatcacagaaacagaggagggacctctccatttgaaatgctctaggctacataaaaaactgacctaatcatatgaaaccttaagatagtacatattattattagacaatatgttggtcttttcttgctaaacctgaattgttatattggtgcatagtggaattagtaagattggtgtgactaaggagatatatttgaagtgtatacatttttattaagtcaatagacaatgtttcagcctgcagtgatcgacatattcaggtgtcagtagagaggcacaacatttatttgcttactggattacttctagacaaggtttgcttcttgcttttctatgactgacatgttatagctccgctaaatgaagtattattacaattttagtggagcattatgatattagttatgctgatttaaaatgcggtaatctattgctttagacatgggaacatacatgatgaattgacctcttgttatagttttagtttcatcatgattttttagaaatatatataatatatgaatattcacaatgcaacatcctctgccttttcttctttggatatatcacactgagataaaagggaattattaatatgttagattgtgctatcagtgttgatgtgaaacaaagttatcatcggtattttttatcatggatttctattttctaatatccgtttcctatctaaccaaaggagggaacaacaatcggtgcatgatctctctacctgatttagacaggtaacactatcaaacacaacttgcatgggatttctatttttctgttggtcatgtgggttagtaatgaggcatgagaaaattttttcaaatttgattactataaattattgttactctaacatccctactcatgttagatgatgttctgaaaaagattctagcctgtatagctttatgtgcaatgcctcttgaggatgctgcaggttgtgtattttctgaattatttgttgtaaataaccatacacacatggattcttctttatgtttcttcatgcaccattgaaactttgatgtgctagcagccagggagttgccattttcctttctacattctgatggaggtaaactcaacatatatgtgtatgtgaaaccatgtcattaatatattttggcgtatttctgatataatacttaaaacaagtgcttatcagttttatttcgagggattaactgaatctggaaaagttttatttcgagggattaactgaatctggaaaatggaggacctagattttctaaagggtcatctgataatatatgttattgaacaagtgtgatctttctttatttttgctaatttattgataccttgccattttttaagttctatttcctgtaccaatttcctataatcaatgtagttttttttatttacataagtctctcaaaggtattgtcaagcttctgaccatgctaacattgaggctgccttgtaacagtgtacctctcctcaaatatcagaaacatggttggaagagtccattctaaatggcatgatggccacaaagtttgtttgctccaaggccacaaatagtgtctcaaaatatagtataaatttgtatgatcttctctttaaattctaaacacggtttttgacaactgacaagtatggataaaaaattcgatgcctaaaaatatgcaggagcctcaagtgatatctttagaagggatgagtttattgtaataaacatgaatatatgatgtaggcttagacaatatttctagattgacattttaatttctatataatacatgattcatgagtttgaaatgtatatgtagttatttatattttgtttttgtctcatgtgacattgatttcatgcataggcatattttatgattctccttgggctattacaaagtaccgtgcattcggattacatatttgtggagacgtgcgttgcacgtgcatgattactagttactttaaaattgacacttgtgaggatgacatatgagaccatctgaatgaatgaagatgggccagggtgtcaaaataattgaaacctatttttaaggggtgttaaaaattaccaaatctcattgtcgaggccaccgtcgttttcctctaaccccgttgtcgttgctgcaatgagaagaaaatgctgctcccttcgttacaaactaagttttctttaagctgttcccattttgcctcaaaataagttattcttagtaataactatattgaagtttgcgaaagtaataaataaatgtatttaaagtagataggggcataattgcactaggattcgataaagtgaaggtattttaaactttttttaatggcatgtgtggtatgggtgaaaatgaatttattcaggatgaagggagtagtagtaatccacttaaggggaaggagcaacgtacatcgcggcccgtgggaagctaagtggtagctgtgtcggctaccctagcttctcgaagaggagaatgggtggcggcaagacgagtgtcttatggtggccttgcgaagaagcggaagatacaacgagcaggagaaagcatgtcccgacgagaggggtgggaggttcttatttgtgctccagcttcatcattgtatcaagtggagctcacctggcttgaaagttatttgcgcgggttagtgcctgcaaatctcagagaaagatgagactatagtcacttacatgtgtctcacgttattttttatttttttatgacttggctgtcacgccagccaagctactcttaaattttaaactggttttaatacttcgagaggcgataaaccaggtttttgctgttgaaagatgtgaatcggattaggtcaatttttggagggaattaaaatagacttttatcaaatacagatgatacaggctgaactgctgatacttaccagaagcccatttcaaattcggcccaaaattgtagagacccaacaccagaagctcccaactccccaaggcaagagcggcccggcgtgagaagcggattagccgaggccgagagccgggggaagaaccgaagaagattgccgtggcgtctccgtctccctcctcgccgtcacagcgcagccttgcgccaccgtcttcgtcgcacgccggattccaatctccccatcgcgccatccgctcctcctcctcctcctcaccacatgcccggctccacggcctcctaaccctgcggattccatcccattccccctcccgaggccgcccgagatgtactacgcgatgcggttgcgctgcctcctcacgcggccgccggtctccctcgccatttcggccagcgcaggcggcggcgagggatgcttcgccaggagattcggcgccgccgtggcgccccggccgtggggcgcggggcggcggctgtgccggttctacggctcctcgaagggcggcgtgggcagcgccgaggcgaggagcgccgcggcggcggaggggagcagcgggcgatgcagcgagcaggagcacgcgaagctcggggagagggaccagcaggagtggctgagcggcgagaggttcctcactgattgcaagcggggggagtcgccgttcctcaccagacgggagaggttccgcaacgagttcatgcgccgcgtcgtgccgtgggagaaggggaacctcacgtggcagaatttcccttactacgtcaagtatgacgcgcgcaccacctgttcggtactttgtttgagtgagtcacatcagttttctaacgacgagaaattgcgtttttacttaattttggatcgcaagtgagaatgcgaggcggctgctgagggagtgtacggcgtcccacctgcggcacaatggtgtcacatctgagtatggttctcgtttgcaatcctctggggggaggatattgctccagagcttaccaggtattgagcggacatgctgcagatactaagtgttatcaaatgcttgtgttgagacctatttaatgcaggaactgagctttacagggagagattagtaagagctctcgcacacgagttgcaggtgccgctgctggtcctggacagcagcgttctagctccatatgtaagatactgcacctttatacctatcaaatatataagagtggttgcaaacttaatgtaactcctaacttgtaggattatggggatgactattcagaaagtgacgaagaggatgaacatgatgagtcagaggacgaggaatctgatattgaagatgaaggtgatgaagattggacaagcaatggtgaggctaaaaccgatgaaagtgacgatgaggatgctctgaaatctgtggaagaactgaagaagtctgtggatcgcctcagaaaattggttccatgtactcttgaggaatttgccaaggttatattctgttagcctatccaacattccaaccataacgagaaataagtttttgtatttctcttctcacaaaatatttcataattttgtctgtttttctagaaactatgatttttcttattcaatataaaccatgcggcatcaattggtgtccttttccctgcaatatctgcaaacaataggtcattctaagtttccaacgttaaacaatctcatggaagtaatacaataacataagtaaaataccccgtgataaaaacataactttttatactaaaaatgtgtgtttcttccaacaactaaaaaacatttgtgttgtcattctagcatggacctgaatcataaccttatgcgctggttcttttatcctttcttacttgaagaaaattaagctagaataatgcattagtgttttccagtatctgccccgaatgctgagttttctttcacttgtatgtcttgttgatgatgcttcttcatttggttatgattctagagagttgctggcgcagaagaaggcacaacatcagaatcatctgaaagtcctgagtcatcagaggaagataaaaggccttaccaaaggggtatggtatttcattgagtactctattttaaatcaagttaaaattctctcttccaaactaccttatggttcaatggaaaaattggaactagttacttatttcaatgcctattatcaggagatagggtcaagtatgttggatcctcagaagcctttgaagcagatcagaggtgatcattagatgttggctcttttgctctttctatagtttttcatcatgacaacctttgatcttgcatcgagtataagcaattccgcagtgatttggattacctttcttgtttcgtagtttggcaccaaaaccttagctatttatttagttttcctgatttagaaattttaacatctagcaacacagggctccttatttctgaagttttgcaatcatatttaggtgtctctaagtggaaacgctccatgttcctattagaagttacaaagtttatgatgtgcatgcctgcacataattatgtattgcatgctacagggtgtgggtgcccacatgcatctgcttgtaattttcatgtctttacatgtggtgcacacaagaacatggtgggttgatttgtggtttagtcttgtgggtttgggtggattagtataagaaagtgagcagtaagtttacttatgttgagcttgcgcacgcacacaatggtatattatattttgtccactcgtattagtgaaacttgaaaaacaaactttacttctggttgtttgttatttctactacatgttagaaattacgccactatctactctttaccgtagtttgaagttgatgttcttcatgcaaacactgatttgtaccatatgtatcatatacaggatcattttagggaaagtacctactaaagatggctcaagaaatgcctatacctttattagtggcaggtgggtggatatatctttcccatgtgaaacaggataaaaatggttttggtagatctaaaacctcagggaggcattgctctctgtaattttgaatattttggaacttttgcaaatccgatcagttgaaatatattagcaaaagaccctatgctgcagttgcttaggagaactggtttctccatttgtctttttgatcctcttcatttcaaggggggtttttcatagtttcttaaagcaaccaagctatacactctcttactgttctgtgtaaacttatcattaccatgaatttgtgaaacaagggtaatgtttctaccattgaaaattacaggactttatcaaagggacaacggggagaggtatatgagatcaatggggatcaagtcgcagtcatattcgaccctcttgcagagaagctgcatgatggtgataatgatgcaactagcaaggaggaaaatactgaggcatccatttactgggttgattgtatgcttctatcctttttcatgaacagttttgtgttcaagtatttgatttggaaatttcaggcgccttgacttcatctcgtttccttgtgcttagctcaggacattgttcatgaccatgatactgagtcagaagattggcatatcgcaattgaagcactttgcgaggtgatttatcaaacgatgtattgaattttggtgttacatacccccaacatttctattttgttgttggccaaccccatgtaataatttttacctgccttacatgattatgaatttaggttctgccatctctacagccagcaattgtctactttccagacagttcccagtggctatctagagcagttccaaaatcaaatcgcagagagtttatccaaaaggtagaggagatgtttgacaaacttactggaccagtagtaatgatatgtgggcagaacatattggaagcagaacccaaggacaaggataaggaacctgtaagctctgcaaacttctatgcatttgaatttaaccaataaaacagtttttgttagttcttatttctgttgtggacatgtacagccggcgctgatgttccacaatctctctcgcctgtcttcgctggtaattgcttgggatttagttcaaatcaattcatgtttattttctagaacaattttgctataatcactaatcacaaaacaacttcttcccttgtgctagcaagaccgtaagagtacatcaacaatacaggtctaaacattgtttgtttagttcctgcatccctttgaggatgcagtgcagtattctgataggttttgtcactttgttttcattgacgagcttggtttactatggctgtgcatagatttgtgaagttaacccttcattagtttctgaaaaggggtgcaaatgaaccagcttatttgcacaaaccaaccatcagcttatatgcattgttaaggaatatagactacctttacataaataggttattcctttacgtatttaggtctctagtactcctatgtattgcctccttggggctattatccaatacaagctatattcataatgcttggatctgttggatggagttgctgccagcactagcgaggatgttggattgatggctacaattcggatctttgctctgatgccatgttatggatatagcttgtattgaataataagcccaaggaggcaacatataggagtacaagagacctaaaaatgtaaaggaataacctctattagccacctttatattcttaggcatgacaggctgccaagtcagtaagatgcgcttataaccaccttatctgtagacgattaccgacgtttagtgctccctatagattgaatagagaatgtgggtcattgaatgattgcacatggtttactcctgcctgtggacatgctttttcttgtaacacaatcgcagttttggtacccaaactaaacgactttttagttccttataaatcataatttgttgtataaactatcaagagcatgccataaggtaaggatattgggatgctagttgtttagttgtaggaattatgattaaacctccttttcttttccatttgcactgttgaaaaaactaactcccttttctgacagtatctaactacttaagcaaaggtttccattttgtatttcacaactggcacttatttgaaatgtttatatgcagccatcatcactaaagcgattggtaggggggagaccaaaatactcaagatccagtggcatatcgaagctgttcacaaatagtcttatcgttcctcttcctgaggtttgtaccatttgctaatctagtttacaaagttatgttattcggaatgaacgattaagtaacatatgtgttgatgtcatgatggcgtttataattgaatcactgacttgcaatgcctagtgcatccgtactagtgagctttagcttggagggcctaccgcctgtgactttgtctctgtttacttacaggaagatgagcaacgacgaattttcaataaccagatcgaagaggatagaaaaattattatttcaaggcataaccttgttgaattgcacaaggtttggatgcaatgcttctgcttccagttatctgctgcctatgtcatgtagcattactgcttcctctcatgtaactaacagtaaatcatgattgatgaacacaggtacttcaagagcatgaactatcatgtgttgagcttctgcatgtgaaatctgatggtgttgttttaacaagacaaagtatgtctactcaatattttctgctcagacatgtgctgaattttcatatgatatcagttgttggcttttgttatgtgctggtgcattatagaaatagatagaaggaaagatcttttctttaaaaagttctttgggcttcctgccaactgttttgattagatgctgctttcatgttttgggtgattttttctatgcaattcccaattaagtcataggtttcattactgagtctatacatgtggtggtgctcctacatgtaaaaccagtggaatatggattttgaatcagtgaaagtttgaaaacttattctaggttactggttatagacttctagagttctagtcaggtggctgcatagggagatatcttaattatcctttgaaattaatgggtatgttgcaaataagttggaaggacaaaatacaacagcttacagccacttctaatctgctatggatgctaaattaaaatttattttgttcctcccttaccagctagtgtattgttgtctgcagaagcggaaaaggttgttggatgggctagaagtcattatctttcatcagcagttcttcctaacattaagggtgacagattaatcatcccccgtgagaggtacttcatttcaagatgatagttattgtactagggcactaggccaatttccttttgccaggtatttactctaattgttgcattttgtgaagtctggatgtggccattgaaaggctgaaggaacagggcattaaaactaagagaccctctcaaaatataaaggtatttagcttctatattccgcaagttgaccttttccacatctctattatctgccaccttcatagtttttatctgatagtcctactcctatccgaactcataagttccctaacttcagaatttggctaaagacgagtatgaacgcaatttcatttctgctgttgtccctcctgatgaaattggagtgaaatttgatgatattggggcacttgaggatgttaagaggacgctggatgagcttgttactcttccaatgaggagacctgaacttttctcccatgggaatttgttaagggtacgccttcgttttctgctaaacttattattatgactgttcactagctctgctgtatataccatgtgatcttgaacatccatttaggtcatcattgtcttctagaaagaaattactttattttggtatgagctcagaaagcgaggtgtgatggattgcagggaataatatattgttttcctccttgcatcagttttagactaatactttaaaatggtgttacatttgcataatctttccaaaagttcctttgtatttgagtcaacattgagtaccataatgtgtagtaatcacatggttttagaatggagatgttactcttactcaagtggtcctccgatggccagttgctatatcaggggaaaatgagattgtaaaaaaatgcctggtatttgaattgaccctaaaatatttgttaaagactctttacggaatcattatcagtatttcatggacttcaactagttgattctcttttgaatgttggacctatttctgatctcttaggttaaatatgttaaaatcatactataaatgacatacttatatcctgactgttcagcgctagtgcttatggtatttgccatgcaaggtggagttgatgatgcaagtatagcaatgtctataaacatcgtaagaaatacatgctgcctttcaaggcaaatagataaaactaaactgggatattctgcaattgaaagcatcatcctttcttcctatacatttgcaactcacttagtgcagttattgctacaaagaagtcactgcaagaagccacatcatcacttttctttgacatcctttaacggttcagattagcccatagtctttctaacctgatgagtccttttttggctgttaaattaatcattttctcagttccatatctaacaaatttgcaacagcactgtacgcactaatatcctgcagcaacgcacagggtgtcatctagtttcttactattttcctttggttcttgacaaattgttgcttagaattcagctatcttaatctgactattggatgccctagtaatttgttgtattcatcttattcgggatttaaacatacttgaattgagttagctgaatttttaatgtgacatggaccccttttcagccctgcaaaggtgttttgctctttgggcctcctggaacaggaaaaacactcctggcaaaggcacttgcaacagaagctggagcaaatttcatcagcataactggttctacactcacatcaaaggtaatttgatttgacttgttgctgttgcagtaaagctcttaaggatggcgtacttggtgtgacccagtaaattacaaacatcattcaactagttaaatttccatacttacctattagcttttagacaattttgaacacgacttttagtgtgggacaacttttttactagtcgccagctaagtcaacattttttttgacttttgccaaaagaacaggaagatggccaaaacaagaaactgacccctcagccatttttggcccatagaataaactttacatgtttgatttggatctgaaacttttctgtgcagatttatgtttcccatgaccaaaagggataaaaggtgaagcaaaacagtttctttttaaagttttacacacatgtagaatagacatatcaaaaatcaaaggataagtgaaacagtctgcatatacaattctagataaaagggcagtctatctacgggaccaacttgtcaacctatttaagatggcgaatttaagctttcaaaagatttgcttcgttttgtaacatcacacgccaaattgagacttctgagttcacatgtgaactgagtgggtcctgctttttcttaaaacattgattatacgaatgtagttgacaggttgaggccttttctcttatgttaaatgtctcctgctgctttgcatgaacaaatgaagctactgatgtgaatcctatcatatgcatgaggtctctgtatgtccctagattataccaaaggatcctcactctttagtcatttttgttagtgggtggttggggcatgggatgatagtggacaagcttgttttgattgaatgtatggtatgcataaatgcaggcagagtaggtggatgcaattttttagaatgctctcctaaaatgctatttgtgatgtttgcgtttcactctgcatcttatattcacggaaccaaataagtaaattttgagattctttagaagattcatcctcctgcactgtcccacatagataaaggtttatttcccaactgagcaccacttcaccgctctgttttctttgaacagtggtttggagatgctgagaagttgacaaaggcccttttctcctttgctagccgattagctcccgttatcatatttgtggatgaggtatgtttacttaaatgaaacaaacaagtgcttatattcccctcctatgtgctttctcctggtatgatataatttagttttgacataacaggttgacagcttattaggtgcaagaggtggtgcatttgagcatgaagcaacaagaaggatgcggaacgaatttatggcagcttgggatggtctaaggtccaaagagagccagcgaatccttattcttggtgcgacaaatcgtccatttgatctagatgatgctgtaatacggcgtttacctagacggtaaatttacattcacactattgcttccaggatagtaatatggtgatctagcaagattttcattggttattgactttcatgatctacaggatatacgtggaccttccagatgcacagaaccgaatgaaaattctcaagattttacttgctaaagaaaacttggaatctgatttcagatttgatgaacttgccaattccactgaaggttattcaggaagtgatttgaaggtatcacatacaccaacgatcataatatcttttttcctgtggaaattggaattgttctggtccttcttttctgccatgtgagcaggcaatctgaatttccttttctgcagaacctatgtatagcttcagcatataggccagttcatgaacttttagaagaagaaaagaaggtaaacaattctataattatggaaattatgtggtctctcattttcactaactttaacatcttctgtagggaggtccgtgtagccaaaatacgggtctaagaccccttagacttgatgatttcattcaagcaaaagccaaggtattgcaaactgcaaacttaagattttttttcttttagcgcagttctctgcaagtagtattttgttcacattgattattatttcccccatttaggtaagcccgtctgtttcgtatgatgcgacgagcatgaacgaattaagaaaatggaacgaacagtatggtgaaggtggcagcaggacgagatcaccttttgggttcggcaactgacatactgtatacacatctgtactagtgattcttcaaccctgttgtatttgtaacaccaataggctgcctagtcacaggaggaggtctcccttttttatttagagctatttataacgttgcaatcattttgtaccatagaaaaatatctaatgaaatggcttcttttttaccttccataccggctggtgttatcattgtacaattatgagaagatcagaaatcaggttagatggactgaaaaggtcaaaaggagccataagtagctccgtctttgcttcagcctgatcaagatgtaaatgctccaggaattatagtttgattgatgtacactatggtggaactcaatcaaatatattttccaatgtatgcttctctgatattagaagcagatggatgtaaatactcgtgtaattgatgtaaattgaatctcggggaccgtagttctggagatgaaaggcagctccctaaaaagacgatgggaactggctagttactagagtggagccagagaccgcttaggttgttaccggttgcaaggctacgaactaaaatttaaaatttaatttgttttttttttcctgttactcagtgactggccaatattaaaaacttcgaagttgaatgttcgtctgctgaaacccgggaaccggttcccacacatgagaggctgctttggtgaacgtgatagctcgtggggtaagtgataaattatcgtttgattctgcttattgcagagatcgtgatcactattgattggagtcccactcccatttttaaggcaaaagatgaaattaagtccgggaaagcgagtgcggaactgtggaagtagttcgaacaagtgaacgttgacaccgcaggctcgcatctctactgatccactcagggcatctacaaccaaagatctactcagggcatttaaaaccaaagatccactcagagcatctataaccaaaatcacacctaaaatcacacctagagtatccccactaactgagagtactctttgagacacttctctcttaatggaggatatcctaaatgagctccttaaaatttcaagcaacttggtggagatactccagcccacaacgagtgtcccagcccacaaagctccatgtatatttttacttcactacccctagtctctttcttctcttttttcgccgccgccgccccctcctcttctcttttcctcacctctcctctccctctccctctcgccgccgctgcttgcctcttcctctccctatcgctgccaccgctcgcccggagggccgcctccctccctctctctatcgccagccgctcgcctctccctctcgccagcaccaccgccgcccgtctccgcgcggtggccaacggagagccgcacgcgggatacgctagttgacagcgagcggcgcgaggggtggggtggccgacggcgggcgagcttcgccgctctgtctccgtcgtcgccgtcctcctccacctcacgccgtcgccagccgggggcggcagatctggtgccatcgtgggcggttctgcccaccccccctccccgcggccagatcgggatggatacggcggtggcgggcgcggcatcgacagaggaggtcgtgacgacggctgtagctgcgcgtgggctcgtcttgctctgctccggcggatggaggcctcgtcagcgggccgaggcgagaggggcaagaaggggaatctgaaagggaggaggcagggagacgggaccacgagccatgcttagaaaaagggagtggaggcgcccgttcctttaatgggggtcgcgcctcccttcaggggtccggcgacggaaaatggacggcgtttgcgaagacacgggttgaggataccattgctcatgctctcatgagtaaggtctcaggagtcaggactcgggaccactctagcaaagcattcatccttgcgtcgcatcgcatggtaggcatcgcaattcgcaagattgagcacgacgtgatcaatgtgatgcagctggagaattaatcaattaatcaggcagccaatcaaattaatgctctttatgcagatccacagtcatgttccagtcatcttcaggaccagttttctctttcttttcttcgcgtccatggccaatcacttcaaaaaggaaaaatagctgttgcacacgtgtacatacattgtagcacaagttatattgggctccatctgccgaatagagagtacagagtaggatggatctcaaccagccagtactactgctaccccccccccccccccccccaaaaaaaaaggaaaactagaaccaggagaaactcaccaaaagaccgcccatttcctgatcttttattgattgccttgattagcactaacggcactgatgttgccgtatatagtggcgctcaaagcctgattcaattcatactaaccacactttgaaggattccccgacttaaaaaaagtagaatggagatttgataaattaacacttttaaaatgggctttgattatttgatatcatggtctatttttattcacttagatggtcccacatattatcctcacaagtgtaattaaagtaagtagacaacgaaaaaagtattatgataatttatcagtcttatagtagaacgattagaacataaaactatcaaatataggacaccccacgctcctgagaggcaatattgacacccccacaaagcttcctagagtcacgagggggagaaaaaaatgacaactcaaccaaaatcaatgcaccacaagccgatatcagccacatccaatcacacttcattaggggagatccagaagctagtcgccgaccacttcattaggactttacgccaacatactgctaaccaccttaattatcagggtattacgtcgacatagttatagactactacatatattaaggttaccatcctcatactttatacttgtaatattaatctactattataaaagttgaagatatttttactggtattttggtacatcatccgtgtatgaatcagtttttaagttcgttggcttttggaaatacatatccgtatttgattcggtttttacgatcgttcatttttggtaatacagaaggaatcatataagaattctgttttaaaaaaactcatatactaacttgaaatgatcagacttctaactgcaactcatgattatacacacacacgaaaaatatccgtgtattaaaagctattttaatcttattattgttatatattttagttaacgtgaaatctattgtgggaactcgtttggatatatatattttttaaaatcatgagctgcaattaggagtccaatcgtctcaagttagcaggcaagtttttttaaaaagatttcttatgcgattccttctatatttctaaaagcgaacaaacttaaaaactgactcaaacatggatctgtatttcaaaaaatgaacaaacttaaaaaccgactcatgatgacgtaccaaaataccgattaaaatatctttaatttttataatagtagagataagcgaactcccacagtgaatttcatcttaactgaaccatataacaataataagattaaaatagacttcacccgttgcaacgcacgggtattttttctagtaaaggaaaaaatatcagtctttggccaaacatgacatgatcggtagggtcattattcatcacagggtctaaacctaaaaaaggccctatcaactatctctcattacaactttgtttatataagtcatactcctcgtatttacattgtatatacacgcatagtatagtcggaatgaattttatctatcaacaaatagttcgaagaaagactggtgtgaaatgtgactagtcacatcactgcttgctaatataaccaattgattctatcaaatgatggaagggcagcgaataacaaagaaatacaagagggcggtttcaccaaaagttactccccagatccttttgaaagacttgcgctgccgtgtacttacaaatctaactgaaaacacttttgtcgatagtcgatacagtaacactaagatgttacaatttgtccagattgatgttgtgtctttggggcaacttctctgaacaccctctacctgaatgcattgaccggttcgaacgcacgctttagtcaggaatgttcatatcgttcaacatccatccgctgaaagttatatattcagatttcacttcagttgaagagagacaagggggtaggtagagggcgtaaaatatttactactacaattttcttcttcaattctcaattcttatatatataaaagaattgagaattgaagaagaaaattgtagtagtaaatattatatatatatatatatatatatatattcaaaaaaaagttctgctttaattgagctaacattctaacgtatttgacccgttaaaatatgtcaatttctccatgcatctccctctttttttttcttttgagaccgaattagctgttatgtctctctctcatcgttatatgttaatttttggactggaccgggccacgattcgtagtattagcacttgaagtttgtggttggtggcattgcaactttgaaaagagtttttttttttgagaacaactttgaaaagagttggtccatcatctgactcatctaccacaccacctctcaatgagcatgcgtcttgtggttggtggcttaatttcgtgcctgaatactttggactagtctcatattacagtatcacatagaagagagaattccaaggtttctttttcctttcgattacatggaaggtgcacacacttacaccattatatacgtacacatgtacataaacaaacccacaactttattaaatatatattgaaagcatagtcgtttcaggttgtacaacttcaccgctataaacttttaaagcttccctaaattttcccattttctagcaaggaaacaacaatccatctgttctgcaatataattctaactacttagtacacatgttgtacaacgtatggaaataagccatataaaacttaacggagtagcacaataaaatatatcggcaaacattggccttagttctgatttccttacgagcctcatacagtgattgcaattttagtttaaaatttcggaaatttcagaccctccggcaagtcattatctcgcctgaaatttttggattttctcaaaaaaaaattgttgaatttgagcaaagtttattcaaatttagttaaaatttcaaataatttcaataaaaaagtaccaaaattcatgaaattttggtgccaccgaattttcatcgaaatcgaaggttgcaaattctgttcccataagattgaggtacattttttttctagcaccgccttttccattacaattagatgcgctctctcatgctggtcactttttaagataccaactaaacagtcatgaaaaactatagaaaaaataggactgataataatacaatagggatcaatcgatctcacaaaagagtagttcaaacttgatctagagaggggaaaacaaattttagttgtaaatagcgcatgcaccctattcatagcgtggatcgaatttaactttgtgtgctcactgagtattatatttgtgttaattcctaattatgtctataacttttcagattttcttataactagttcacacatagtatgaagtaactgtgttaatctataattctttaaaagatttcaatgctaattggtgaatctaacatcacctatcactgatggcatgtgagacctaaatgcttaggtggactcctcttataaacagatgtacaaatattgttcatttctcatatcattatagctccacagctccactccaaattccgcttctaaagttaaatttagaagttggagttctaccaaatggacccttgaaagcaactatgtagcttgacatacatgtacaaaaacgatgccaattattgtttacaatggaaatgttttattataaattttggggccttagagtgtacgatggggtttcctattttaaattccgttgcaacccatggacattttacctagtatggtaaaagatttctcctgacttggtataagtttggtttatgaacacactcttagggcacgttgtaaactatgttttggcttggctacctttttcattttccactagcatattttttaaactgttcaatggtgtgtttcgtgtgtaaactttctatatagaagttgctttacaaaatcaaataactttattttcaaggttttaataattaatattcaattaatcatatgctaatcacctttattgttttacgtgtggctaattactcgttttaaactacacttttgaacgagcgtttagttttttttggaaaaagtttaggaggtagcaacataaatgtcaactatagtactcaccagcagggttcaccttttttgattgagcactggatccagacccctagtattatacgaattttcgtcaaatttcaatcaaattgtgataaaatttaccttttcaaatttgatttctggagaataattcaaaaattcactcgtaagtctgcttttatccagcgtcaaaacctcaatattttgtgttttttttattggttttgcgtccaaaatggtaacaaatggctagtgttgttaggacagtcccaacccataacactagacatgattttcataaactccacatcatcaagaaattagtaccagacactactcttccaatgcaaacaccactattccatacttcaatttaatattacttatctcacatgatgtcttggatgttgtgtagaaaccatgtctcatgcaagacatggttttcttctctttcctcatttattcatttgccacgtcattttttgttctaggtggcaacttatttaatgctatggacaccattttagtcattggtttgggaatgcccttatagttttggggctgatgtccgctaattatgaaagtacacatgaacgtgcgtttgcattttgcaatggtgtgtgaagtgaatgctctgagctcatgctatgtgtgagccgttcgtgagctcccgaagatagcgttgtactacttgagaggcacacacgatctgatgcacacacacgttgatgcctctgtggtgtaagcatatttgcgtccaaaaatacacttcaccagaacacattgagttctagcaaaatctacaaacacattgctacattgcagggcagccttgcaggacaggtgcaaaagctggaccgtctcccgtcgactcgtcggcgacacgattccgcatccgccgaccgcacgatccctcaaaagatgctcccccggaccaccaaaccccgtcgtcactccgacgtggcagtcctcggtaggtgagtcatctccgtactgaatccacaactgctgctactagatcccaaatgcccccgtgaccaaaatgcccccgatcaactggataaaccatagaaaatatttgatcctcacaaatccgcaaatattgataatcacacgaagtaccaagcatagaaagaatctcgatattttcttcagacatgaacttgacatcatcgcaacttgcaagtagtttgatcgcagcagccagcaggtattatgaaggctgcgttcgttcaaggagatcaaatgatttttttaagcatcatggtcgtggaaaacaaaacgagaaattagcgcacgattaatttattactataaaacttgaaaatgaatttatttgtatttataaagaagtttttttataaaatgtctttttttagaaaatgcaccgtattgttaacgaaaaacacgctgttaactcgtataaatgggaagtgtgctaacaaaaaaacaaaaaagttatagtttgaagttggagattagaatggtgcctaagtcttaggccgaaagattttattatagactctttttttagtttaggcttttatgagttttttttggttttgtggtttataacaaagaggtttttaactatcagctgtaagggtggagttctaactctaattcacacaaaccaatcccaaaatataagaacttagttctggatgaggcacattccagtactacaaatatgaatagtggacatgtatatagtagtaggatgtatcacatccagacttttatatttgtgatggaggtagtagctatttaaacttaacctttggacaataatgtaagagtggattatggttttaaaaacataacaaaaagctattggatctatttttgggggatttgtgtttttttatgtaagtctacttctacacccaatgaagacgccatatcatgagaacgactaggtgtaaaacacctgatatgatgaaaaaaaggtgataaaatgttgcagttgatcatcataaagtaaaaaaatcatttaaaacatttaaaagatatgtgaaatactacaaaatgttcgctaaaacaattagctcttgtatactaattatcgaatattaactgttgaaacatatatatatttaccattggaatataataatatttaatttaaataaatataacaacataatagaatcgtagatcgtttaaaccttactgatagagctgtaataagcgagcacccatacaccatggtgagaaaatggaggacaaatatgcaatagaccaagaaagaagaggcacaacaaaaatatgagaagagtatatgatcgttatgtcttgttcagacaaacaacttaagtatttccactatattatgcacgaggataaatgataatatactcatacttattttcgcgtagaataggataggagtacgttgttttcccttacatatgacaacaacaatt

SEQ ID NO: 30377 - DNA, 1562 bp, Oryza sativa
attggtgatatttggaggaacacatggaacgggtgcgttgattcggtcaaaaaaaaaaaaaaagcttgcaagtaagaaattaggtggtaaggctggcttcgaatggatcgaatactgcaaaagttgtgcctctttctgttgtttgcttttgctatggcgtccattttggttcagattttgagtcctattgttcggattagattgatcaaaatggataggttgattgggattattattggaaaggtaggaagagatgaagtttcgcctatgattggtccttctagatcaagccaatcctgaaaattccacgaggtgtgatttatgtcttcacaaatttcagacaaattgacgctcctcgttatattgttcctgtgcaggtcatgaaacattgcataactcggttgatgaagccctcttgctaaaggtactgcataatcaaatcaaaggcgacactggagtttgcttgttttcttccatcactctatgttctaaccatctgttttattttcagagaaaatcagaagaagttctcttctatttgaatggacggtgtatttacctagttggttagttctgaaacttctcattcctccaaattatcagcactgaaaaagatcaatatatagatggcatctgaatttctggttgataaattaaaacatgtctgcaggaatgatgggttctggaaaaagtactgtgggaaagatcatgtctgaagttttgggttattcgttctttgataggtttgtatttttgctatttgccaaggagatcttgcccttggtgctcatggtaatctaagcttttatatttctggaattgtttgcagtgataaattggtcgaacaagctgtgggcatgccttcagtcgctcaaattttcaaggttcatagtgaagccttctttagggataatgaggtaatctttttttctgaatccatcttctgctaacatgatctactatcttagcatttgtttacttgtagttatcagaaggaaaatctgagactgattattttctctgtggctctcttttatgcattacagagtagtgtcttgagggatttgtcctcaatgaagcgattagttgttgctactggaggtggtgctgttatccgaccagttaactggtatctggagttcacttctatttttcctgttggaatagtttattttgtggcttctcttattttgattaacaatattgtgatctctttgttgtattatcaggaaatacatgaagaagggcctatctgtttggttggatgtgcccttggacgctcttgctaggcgtattgctaaagtggggactgcctcccgtcctcttctagatcaaccatctggtgatccatacacaatggtgactacttggcccatgaatttatgccatgcatgaatatgatattatttcagatgtatttttttaaatttttaatcagtcaatataggctcattcattcaatgtagaaatgaaaaactgcaagtatgatcctgcacatctgcacaactggtagtgtaattctttcatttcagtgctagtatgagttgctcactggattcttc

SEQ ID NO: 30378 - DNA, 1392 bp, Oryza sativa
ttgctattgaggtatgcatgataagctattctgaacccacaatcaggagcaatatgaatcttatttttttctaacgtactgaaacaatttccctaacaacattcttggcattttacagtcgtttcataagatcgagaactttgtcattgaacataccgttgacaatccggttggtgactcccaggctgactcacgtgctcagaggatacagaccttgtagaattttgatcttttttgtaccttagtgttaccttgtagcgctgttgagttatttgttcgttgtaccgacaagatgatgaaaagaaccggaagtgtattttccttgtaaactgtaaagaaaaggaataatggagctaatcagaaaatcagcgtttggttgcaataccttggggattttggccttcgttcttcactgaacagctgaacatcttagttccaaaagatgaagatctccatctgaggtctcagaaaaatacaaaatgccacaggagattctaccggaatcctgaggctgagacgaactgggcactggccttctcaatcgtccactcaccgtcgtcctccatggttttgttttggataacgatgggccaatccgtagttggcgcctaatcattgtcacagatacttcgacgtcgccgtagtaggggcgctggtagggcaggatactccgatgagatcggcacaggagcaacgcgagcatgtgctccaaattggcttgacccaccgggccaccgagcgcgtggagctgagtcagctgactaagcacgccgatctccacacaacgacggagactgttgcgcttcaatccagatcctccgcagtcctgctcactgacatatggcccgaggatctttgaagctcacatgtcagtgagcagtactgaggaccctcactcgttgtgcttggccgcagcggagaggaatacgccaacgccctgctgcttgctcttgcttgggcatcgtgaagccccttgaggcccttcctgctcctgtattgtactcgacgcaatttacacggagactgctacagatcggtgttgcagtgtgttatcaagaaatgtttcacatgtttcatccctcgctaaaaaatgtttcaacaaaaatgttccagatgtttcactaccaacgaaaaatgtttcagtgcttgagaaaaaatgtttcaaacaaatgcaacattcaaatatactgattgcaacactatgctccagatgtttcactaccaacaaaaaatgatacagcgcttgagcaaaaatgtttcaacaatgcaacattcaaacatgctgattgtaacaccaagaaatcaatgtatgcaacattgagtcaaaatgaaaatataacaccttaatacaataaaatgcaataaaaaaatacaaatatgattcaacatcac

SEQ ID NO: 30379 - DNA, 4925 bp, Oryza sativa
attccggccatactagcagtggcgggcatatgcgacggcgacggcaggagagggcaccggcaggtgtgggcgacggcgcgcggtggcctactccttgctcccccgcgcacggcggccccctccggcggtcgagacgcgggatctagcaggcgacggccaacccccacaccgatccggcggccgaccaccctccctcgcgcgggatctggcgcgcggcggcctccctcccgacggcggggtacgcagcccctctccttcctctccctccggcgtggtcctcgtcccaccagcacggtcttcaccttcatcgacaacaacgaccgagcacctagccgctcgccatgggaagttgttgatggggagagaggagagaatatgcggctaagaatgaggataagactgcatcgatacgttgactagagaggagaaaaggacgagggagaaaaggctcggtgggacccacctaagatgaagagtccaatatttccttccgcatcgcatggtcgattggaagcattttcgaatttacacggtccaaatttttaattggtaaaattgatgtttcagttctaggttattttttattctatgtctaaaaatctaataagcatgaaggggatgcattattatagatgatcagttagccatgatttttattcatgaaccttctctctcttttttttcttcagattctacctttcatcggattttttgcggtaacaatattcttcttcaactcaacaataccgattatattgaaggtactaaccatgatcctcttgtgcacaaattcataaaattcctgaatgttgtatgtaacttcagatatgtgggctgaatgcttcagatatgtggggcaacaatgctgaagctcaacctctcgcttttgacctcggacatgtgggctgttctaatccttatcttcgcttaccatgaggtctctgaacatcaattcctccctccataacctcatgccaatacttcaatcttaaaattgaaattgatattaatcaaattttgagcatttgcaggttgattggatttgcttcgttgcttttgctggcatggcagctggccttgtcatctactcatacaagccttccttcttcatctgccattgcttctgaacatgcacataagatacatacttcattcataccaaaataaatcaatttctgaccacaaacctacacataaggaattgatttattttgtgacggagggagtagcaaccagctgtgacgatgtcactactcaccactgagaactcttgcaagcaggggctccaaggaggcggagagtcggagacgatgatgaaccagcctccaataaggaggtctcgtcgttggttgctactacctcaaggtagtagtaggtaggattctgtctgctgcatctgcacacaattgtgctgtaactgaaaatgttttactatgtacagtgtgatagctggttcataggggcaaggtttggtgtgaactgtgatgatgtgtgatatttttactgtcagataagcaagatagggttaagaactagcataggtttactgcataatttaaaagtatacgtgtatcatgtctgattttactattgttttgtaatattggtcaaggcttcgtgcctgcctgacaagttgtaatgcaaaagattcagagaaatttctatggacgatctgatgtacagagtatttcaggcagtcggtttcagcactgtgccagggacaaggtaatattacactgcacaattgatacataaccactagagggaaatccagaaatgaggagacaaacaccctgaacagtaatgcacttgtcaacagaccattcctacttcacaatcatatttcattttccataaaaaatatttcctaaaagaaaaaggtcttaaattcagtatgtaacaaggactcaccatgaaaaattgtgttagcaaaatgatcattacgaagtgacatatacctagctataaagcccccaaaacaactcatataagggagcacaaagttgtccccaaactagcctcaagtcatctatcatcgatcttgacattattcagagccaacatcaacacctttctttgataggaattcctttgcctccaagatatcctgcaaattaagtaaatacaactgagaatagactaataatttctttgaagcagaatggaagtgtgaattatctcaatatcagttgggttgtttcctttgaatcatgcaacggcaattgcgaagattttcatgttaccatagtgcaaactgcatactttaaaaatattcatttacatcacataataataccttgaacacccatttctcatatcaacagagaataaaggggggagatagagtaggaagtcgaaaattttcactggtatatactaactaacatcttcaagtcatagaagtcctagtttcaaactaattaagatcatcataggcccatgcacagaaattttaggctcatggatctagaacaactaacctgctgtagtagtacagcttcttgcgggcaagttgggaagaacataagcccaaatccaaccataaaaaggccatagcatccaagtgccactaccaagtagatgggaagctacaataacaaaaagtcataaataaagcccttatccttaatcatcttgcactacaatcatcaaggaaattgagatgaaaattgatagcactgaccaaccaagtataacttcgaggaacagtcgcggtttcaagaagggcaatccaaatagctgagactgccaccagcatagcaattatcttgaatatgtgcttcatttgggaaaccaagtgttttctgccaagataaaccaaatgagaacggcaaataaaatgtgcccgaatgttacagtctcaaaagatgaattgcaagcataattgcactagcaattcagtatgctagcactaaggcagacccatggcgagtaggaagtccagcagacttagcacaagcatgaaggggcggatccaacttgggacacggggattcagttgaacccctaaactttttggggaacaaacaaactgttacttgtattaaggttaaggctctgaaattaagagaagatattcttccagatctagaagagaagctagggttaacggacgcaagcaaattccagacaaaagtactcccggtgggagagagagataaatcggaaagaggatgtggatgctcaccaggatcccctcccctcccgcgccctgctctgctcgccaatggagatcggcgcccctcccctgttcagccgcgagatggcgcaaggagcggaggcggcgacgacgagacgggagattttgttttacgccaagggaagggggagataacggagtgctccaccttttatctcaaaattttcactttaaaattctttacgataactggtaaaccacttgccagcagtactcacgacgataaacttcttggatccctggcaactaactgtcgctctatacaccagcaccacaccatcgttactccactctgccttcgtatgcgcagccatacactttaaatctcgacatgtattttctcttccctcattgttatacatgttattgtcatggtcgtcgttaaggatgggattgttgggcttacagggctcggggaggcaggagccaacccaacagaaagcgaagatgctagatttggactcctccttactatatccgacgattccccaattgtcgaaggaaaaaagaaaaatgagagagagagttagtgtgcagagtgattgcagagtcactgatttggaggtggagcgatggtggagtcaccggacttggagtttgatggatagaatgaggtggtccaaattgtaacaaaaatgtaaagttcgtttttgtgtagataaaaagaatgtttaaaggatgatatcacatcaaaacttttaaggatacatgtacaaattgtaatttatttatttttctctagcacaattaaatatgagttatctattagcaatagtctcgtgctatggcaagcccactataatttgtctccacggtatgattggagatatattgaaatattatgtgaattatgtgggatgatgattaaacatgcttgtattaaaattaataaattataaaattatagataatatagcatgcttacatgatgtttaagatgtaataattgttagtggatgatgatgttatgcttttgttagtaaccctctgttaagtgctataaatagactattttaccgatatgaattgttgaaagatgaataaaaatttttactcttttaatcaacgtaaataatttagcgtaaagagcaaactacaaattagtgtaaactaatggaaagagtaaaagttttagtgaacttttaataatttgtaggggtaaaatgattttattacaacactttacataggaatgctaacgaaaactcaataatgatggcatttctaaggcaaaaacgcttgtacttagaaagttaagtttatcgatgacatttattagattttctctaaaataattagattgtgcttctcaagcgcatgaaatgcttagcagacgcaatggatttggaggtggttccggttggaaaccggatcctctgagggacgtccgaccatgctgattcgttcgatcggcatcggacgggagcgatggaacacaggaacgaacaagctaagctgtcgcggcccacgtaagaaaaatgggcccacgaagaggcttgactgccgtccggccgtctccactctcgacacagccggagcgccgcttgaaggggaagagaaggcaagcgctgccagtcgagctccggtgtgaggaggtcgcaggagtcccgggttgaagtggccttggctttgtccggatcttccctgcgctcccccgcagagctcgcgcgcacggccgcatgtggtgaccaaggcgaaggttccgaaagcttgtgttctcgacgct

SEQ ID NO: 30380 - DNA, 13038 bp, Oryza sativa
  unsure (1)..(13038): unsure at all n locations
nnnnnnnnnnnnnnnnnnnnnnnnnnnnnnnnnnnnnnnnnnnnnnnnnnnnnnnttacaacactttacataggaatgctaacgaaaactcaataatgatggcatttctaaggcaaaaacgcttgtacttagaaagttaagtttatcgatgacatttattagattttctctaaaataattagattgtgcttctcaagcgcatgaaatgcttagcagacgcaatggatttggaggtggttccggttggaaaccggatcctctgagggacgtccgaccatgctgattcgttcgatcggcatcggacgggagcgatggaacacaggaacgaacaagctaagctgtcgcggcccacgtaagaaaaatcggcccacgaagaggcttgactgccgtccgcccgtctccactctcgacacagccggagcgccgctggaaggggaagagaaggcaagcgctgccagtcgagctccggtgtgaggaggtcgcaggagtcccgggttgaagtggccttggctttgtccggatcttccctgcgctccccggcagagctcgcgcgcacggccgcatgtggtgaccaaggcgaaggttccgaaagcttgtgttctcgacgctgctggccctcggattatattggggcgctggagatgcaggtgtgctccatggcaaagctcacgaaggcgctccctccgtggcactcccgccgccggcgccgtcggcggcggcaatgttgtcatctccagttccaagcaaggaaaggactcgtatatgtatctgtgcatctcttttttagggtattactgtgttaatgagcaaatcgatggtgaaaagcatccataaccagttaacaatgctagtgttcctttttaattagtttagtcatgaatgatttttgtttaacggcaagctcgtggcttctgcagcaaaagcaagaacgagagtattcacacgcttcttttagacgtatgttcccgaatgaaatcgaccgggctgatttttgccggcggtaggcgccgctctagcatgtccgttaaccgatcctttcgcgcaatctggtctggcatgtggcgtaccaactaccaagtcagtagccagtagacaggtcacgaagtactgaagtactccctccatcccacgaaaaaccaacctacgtcccacgaaaaaccaacctagtactataatgtaacacattctaatactacgaattagacatatatctgtttagatttattgtactagatatgtcacttttttttcggactgagggagtagaaagaaaggcacacataaatagcccgccagcttgcgcttagttatagtgctcgctccaaccactttatggaatagataaaaatagaatttcaaaaagattagatctatacacttaaatcatctgttactaccaacgagaatatacaccctaagctcttcccgtgcaaaaaatcacacaagggcatggtgacaataccataagcttaacaaatgaacaaaagaattatcacatgaacatgaaacaattctcttagggcgtgaattcactctactcgaaagtcgcagcatcatttactgtccaagcttgctccatatgcctttccgtgctgttaggcacttcaatttgccaaacacaaaaccagacttttgagggttcccgtctacaagagagttctcgtatatttccttgcactcttgtacaacctaagaacgaggaatgaacagtgaacacgtaattatcaattaaaaaattctgactaacagtttttctaatcactttcaaaaggcataatttgaccactggaataggtctaatttgcactgtttcgcacaaaattgaaccgcacatgcatatgatgtgaaaaatgttatgttcttacctctttggcttccttccttggaatgccttccctcattcccacaagcttctcaacaacctcaggctacataacgtagatatcaagttcagcacatcaacagaaatgaatgcactactaaaccactaatttctggcaaaatcgagtagcttgttgaaaaaattaccgggcaatctggttgatgttccagaatatttgtataaatgagagtaaaactatccagactctcagctgaagcaagctcccttagatcagccagaatccgcactctggtttcaactttctggagcacaaaatcatagagtggttaaagttacagaaccaacaaataagcatttgtgaagaaaagtctaggattacagatgttcgatgctaaaattgtaaaatccagtttaattatacaatagcacaaaatacatggtatcgtgggtagcttggactttgaatgaaagccacatgaatggaagttgcaagtatacttactgtcacattaatgtgttctctgaaaaaatccataagcacttcttcatcaagcctcatcctttcgattgtttcttcttttatatggcctttctggaggtgcaaagggaatacatattatcaatttgaaataaattaccagccagcagctgcataagataagtagacatgtagtgtgaaatgatgggtgtaattggtaaaaagattgtctgacccagcaacagctcagtacagaatgatttatgaaacattttccaattcatatttttgttaacagtcatttttgtacagagaaccacaactggccaagtatacaactattcagtactaagggcagttctgcaaacctgagtaaggagatgatcaacgtataccacaattgtttgctccaggcaagcctccacaaatcttcgaaatgatctttcttcaatatatctagaaaaaatagacccggaagtcttcaaatcaagtatagaaagaaacatgactaactattatcaggaataagtgaccgtttacatgccacaaggaacacaaatgatctacaaaaggttaagaatagaacttatataacaaagaaaaaaaagtaaaaagtgtacgtaaaaattgcattggagctacctatgtttatatactttttgagaattctcacttgcatttggaaaattatcaatttacacattttcactatttggcaaacaatgtatgaaaatggttcatgcttgagatttggggttgagatttttcacgtcgtggcacacaatttgataggatgagattttctcaaaatgtgtagagtatcatatattcataatgaagacataggcaaataaaataaacataagtcagcatttcttagggaatgtatccttccgttccataccacttatattcaattatatgagaacttactgtttgacatccccaaaataatcagcaaatgttgcgacaagatattctgtaaccattccttccatccaatctgaataaataaaaagaatcaatgttagaaaagagagagagagagagactcacgaaaaaaaacacttgtgcacactacccattaaggttaaacactcaggaacacactgtaaacaagaaaagactagtacataaaatatataaacagtgttgtatatgatccttggtacatcaaaatctaatatatcagtttcaccaaatcacacatcggtgatggctatacttggtcctaagcacaaatttaattgtgtaagcatacatgttagaaaattctgggtgcctttctgggcttgtcgataagactctcacaagggaacaggagtcgctggtgctttcaattccaaatctaatcaagaacatgacacaaacaacagaagaaatgacagtttggaactaatattgcaaaagaattacctttttggtaaactttcactagtagatcctgtacacctgggtcttcaaaaataacgctgacagtttgaaggactgcctcctgttgaaataaccaaaattctagttaacaattaccttttatagtctaaagatgtagctaaatcaaataaaattgctcgaaagaaagccaaacttggctagttctcaggacattcctggaaagttgagttcattggtgcccaataccagttgtcagataatactggataaaattggctagaaattagcatcaactaccttgaactaaccagctccgtgctcacttaactattcaagtattgagctggcttttctacagtcttggaaaatattatgctggattcactaggtggtgctgaaagagtgtttctgacaagtgtcaacctccctgcttttgtcagtgtttcagtttctgtataatccaagcatctctaaccaggaattttggcctcaagatcatgaagtgcacagtcagatgtgtaacatgcacagagttagccaatactttctagaagcaaagtaaatcacaacttgcccataagagaaactacaaactttattgaacactagctatgcccgagctttgctaccgataaaaatatattataatattacctaaaataaaatgtcttacctatcattttgctatagggaatattcaccttattttgactttatatgtgactatccatttagattaaattgatttttaatactaagaaattcaaggggtaatttgcaaaactacaatgggagtaggtggggtggcagattcactgccagtctaaccatcaccactaccttcttttaaagtactatagagtatagatataaattacttaaaagatgccttatctataggtaatgacaatatatgcaattaaggcatccttgtatagtaaaccctgggcacctcaagaaacacttacgcagtggtcagcacatgaggtttcatttcttaaacctaagcaaatgaatcatacacatgtactacatccgtcccaaaataattgtaattctaggttgtttagcataaattaaggtttgagaaaaaaggctattataccctcactaaatggtgtataggtaagaattggagggtagttgagagtagaatagggagaaatttaaatgagaagcaattgatgagataattagtactctattgtgacaattattttgggacaaatttgtatcctagaaatataattattatgggacggaggtagtaacagttatgtcttatgcttgtaagatgtagaacaaaccttggcaacctcaagaaatcctttgcaggtatcttcaaaattaacctgtaaaacagaaattttgctttgccgtgaagagctttaaaatgcttaagtgtgtaactgcaaaggacaaactgcagaaaaacacatctttaacctatgtcaatgccaaagtctctatgtattctacatttctacaacctgtaatatgcttggctctcagcagatatttatccacccagtttgctcaatcaattcaaactatggactcatcaaccagcaaaactgattccaggcgaagtcacaataggcaaaaagggaatgtgtgtatttcggacgcatctgcatttatgtaggttgtaggataccacaatagaggcatgattttacaagttttggtcaacgaagtaggaaatattttacctccagttttagttcattttatatccatgcacaaagaccaaggaactttagtttttttttacgtagattgcctctattcattacccatctctctaaaagtactgacaaaaggctatcaataggactgtttggtcaaaatgtagcctagaaaacacagaacttcaattgcaaaccaatgcttcctaaaatgtcctttagactggagatccatccctccctttctctctgctgagaagttagaagtagctgacagaatggaatctaaggagcaatattagtgactcattcgcacctgctcagcatagttttgtggaagcgcttccaatgtactgctacttagctctgatgaaagttcgtagcaacgcaggttgttgttaatctgctcaacaaattttatgtcaaatgatatgaaattaaagtagcagggaactcacatgcagtccttaatcgagaaaaatttacataccaatgcacatagagattccaagccaacatcagaagctggttcctcaagtctttgcctctcagctgcttgaaaatcaagcatgacctatattataaaggaaacaaagaagatgaatttggcatctttcagtaattcatgtcaacagcaaagcgtaacaaaaccatgtaaagaacatcatcatgaagggttaactgtgtaaatacctgtataactgcaagagcaatacgatacagcatgacatctgtgctattttctgtaacaatctgcacttgctcagtcaatattctgaacaaatccacagctgcaggtgtatatagtttcccatcctctgtactttttggtggttgtgttttgtcagcctccaaaatgttactgtaccatttctacaggagcaaacgagtgaagttacacaaataataatgattaagttcaaaatgaattcaacagatcaaaaggagtaccttagttgttgcttgcatacgttcgacatacatattcatgaggggatccaatgcaccactttctgaacaaacttgggcaagagactcgtccacaccaagaccgataagattttcttggtatttcacaacccaacctgttacctacagtgaccattcatttaatgattttgcaatatacgagaaagcaaaccaaacaagtgatattcatgaatcaaggaaaacaaaatgctgacaatgcttgcggttttcacatttcatcttgtggaaagtaaatttagcagaataaaacgatggcatttgaattcatataccttaagaatatttatatttggaatatcatttgctctatcactgagaagtcttagcatctggatgaacctttcagtatacaggtttaccatgagctggaaaatttcatatctgtatagaaacaaaaaaaaacatgagactgaaagaagttagtgggatatgaagaaacagctaggtatctttctgcaaatcaccatttctaaggagtaagtatagcccccatgtcccaaaagaaatagcaattgatgatatatcaaaatgaaatgagaaaaagcaaagtatcatattcttcatccgataagtttcattaagcaatacataatttgtgtatgagctgatgtatttaaagttagaacatgacaaattatgtcacgttcccatctattggattaggatggcatatagtgtggcccatcataggagataatctgtatctttgtattgctacagtaaacagatcctcagttcttgtgtacacagaataaatggttgtgaagatcttctaaggataagtatttcatataataattatcaacatacctaggaggaaaacatggtgcaacatagtcatagatatcaccaagctcatctccaatctgaattgcattaggaatagaagaatgacccatatcagttagataattcagttaatcaagataagtgtgtcctacagaaatagcagctattctttgccaggttgcaaattgaagaacaagaagggttaagatgtactaatggaatactaattgctactaataactaaaagaaagaaaagaaacaatgtcaatcgatacttcaccgagtcataaacaacagtactgtgggttccatcgcgtatcaaccacatcagccattttcttttcaatttgttagacaatatcaagttgagaacaatggatagaacaagcattggccacgaagctagagcaccaagacaatctaaggagtctagaattcttcatatgcgtttgtattatagcaagtgcaaaaacaacagagtacttactgccttagcttcctccaaagcttccatcaaatcttctgagaaaacaagctgtgcaataaaaaaaatcagctacttgctgctaactgcatggactgtgatgaccacacaataaaatcttaagtccaggatatatttaagcactacctcggtgagcagtttgtcgaagcgagcctcaacagccttcctgatatactcatagcatttgtccttgtagccctttccctggacctttgatttatcttgagtgcttcttggggtagatgttgctcctccacctttcctgctacagttgggcaaggatgagtcagaactatgagcagtcagtataataaataaaatggtttaataattactatttgagtggttctcacattggttgttggttgataatagatatctagagataatttgaataaaacaacagttatacaagtcatcatgacaatagtaaagcaattcatgcagaccatagcagacaaccaagttagttacacccatagtcccgtacaatagcttgaatttgttgatctggtagccagtctctggtattaaagatattatatatgaaaagcatgatgtaaaaactttaatgccacctttacaggtgcgcagatgcacagatgctgatatggacaagaagtgcgttagtactcatatcttcagtacagttatatcagcatgaaagtaaagggacatgacaaattttgtatcctaggatacattatttctttgatcctctgaaacatgaaagatataatatcaatatatcatactacctagcacctactggaagtacagaaacatgtgtgaagcaaagaaaggaagaagcatactttgcagttctacgctggtttgctattgtcgccatagcacctgcaccctcagcctcagctgcttcttctgcaacttgttgatctaggatctcttgcatttcaacaaccctaacataagaatgaatttaaggattatgtgcaagatatataagtgcccattacctagaaactaaataagaaaaaagaatcaagccaattttctaaatctcaaatgatcagcttgtatttatgtattatttccctaataaatcaataaatagtctttcattcaacaagtgaactgaaagggaggaagccagggggaataattgctccacagaagaaattgatgggcaacaagtatcaaactatgagctggtccaaacattcagctttcacaattgactgtacaaaatgatcaaagggtagatattaaatagtgtcatgcataccttattgctcgaactaacgtctgagggctgcacaaagaaaaaagatagtgagtttaatacaggagcatttgtagcagatatgcgttaaatagaaaggcagtgcaattcatataaaaacaataagacaattcattcatttaccatgttaaatagcaaagacaaagtgaatcgtaataaaaggcagtacctatcttttgaaagtctgaaaaagttagtgacatggccccacaatgctttctcaaatgtttcccatgaacgatcaacatcttcaaagtactctctgtggagaagacaataatcaagcaaattatagatatatacttcattgcactacaaactagaagaaagattaaaatcccttgttaaccctaacagtatttgctatcatactgtaatatgtagagaagatcatttctgcatttcttccttaagagtcattgagccattatataccttgttctattttggatcttctacagtcgtttcataatatagtagaatcaacataggatcataagtctgattttcttcagataattttctgattgcagtagtattacttctgctcagaatgctttacattattctaacgagaaagacaatggggacgttaaagggtgggggcgtgggggggggggagaaggcaggtatgcattgaataatcattaatattagctagtttcaggggagaaacaccacctcaatcgaccaacttcttccttgtgagatgcagcagcagctaaagcaaaacgtctctttccatcaagagctgttaatctctaatttcaacaaataagatcaaacagcaaagtcaggcaagtaggatataactatgatcaattcctgatttaaaaaaagagctataatatcaatcatggtattgatcagtgatccaaagagggaaaaatagaacctcataagtgcgaattaactctttatcatcacttagcgagtcgcgtgctgcagctgcttcaacagaaatagacatcatacctcccacatcctaataggcattgacaatcaacatgtcagatgaaattttcgtgctcgataacttggttagcttaatgtattgataagaacgttagtaaaaaacaagcaagtacaaccttaatacagttgttattgctaaagtaaggtcagcacacctttaaagttgtgttcaggttatttcttgcgttgctaagaagcttaatcttgtcgtggttctcaattaatgtttgacactcctggcacaacctgccagacatttatgataaacaggactgagaaatgaggagaaacatataacctcaaggaagtgatctagcatatcaatcatgcaagagcataagaaaatgtagagataaaaatattttagcttacttgtctatatctatgaagttctcgcgtagtttgtttattgtttcctgagatagtgcaagagcattgatgccagcatgggcttgctcaacctataagtgataaaatatgcacatacagaaaaactataatccaacagacaaacattgaggggggaatgcaaatgatagtagcagaaaccgtaactcgagcaaagcattaacaatagcattaaaactaataagtttggcagttcatagtagatgtcaaggaatacctgctctgctaccattgtactgagctgtgcatcatttgtctgagaatttatagaagacagttagaaatccagaggtatataatatgcatatgccaatatatgctttacaaaatggtaaacatgctcataatatctcactgaagataatatgcatatgccaatatatgcattacaaaatgggtgtgagcacatacgcacatacacttagccatgttttataatttacttgcatgtctacatttaagcttgccgaacatcccagccatatctgagaactgagacaactctgcccaaacctttttaagaaatgcccaatcaagtctaacacaaacctttgcttaattagtatgttttgaaaccctttggtaagagataacaaccatcaagaatgtgaggaacaatagcattgagataaaccgtcgacataggaccaaaaaggctaaaaacaaatcctggagtacactgtacaaagctacacgcaagtgtggagtaatcaataaggagaaactaagccttgttgtgatcagcaggatgtttgaggatagatgcacgcattagatggtcaaatgtcatttagctttggaagaagtccagcaatcaattttattgtaaacgcaaggattgaaatctcttcccttgaatattcattctgatttgctataattatggtgacaaattttttcacaaaacacagttgaattttcagctttaggatggtatagagatttgtgtttgctgagcattcacgcatgcgttttacttcttttcttggcttcctttctcgaaacttgctcgtgcctcctgagccttctaacatttctgccagtctaccaaacatgcatgttgatatgaccgattgatcagtattcattattcatcattatcatgatgagaaacgaagaggatcaccagtagccactatatctattacaccgtaattacatactacttacatatcaattacatcttagttacactataattaattcctacttacatttgtatttttttgttgtatgtgactgtaaaaacaatttgactgttttttgatgaaaaatatggcaccacaattataggtatgccttaggataaaagtagcaagtgggcccactgaaaaacgtaagtaaaaggaaataatagaaaaggtctaaaccatgccatctccttgtttttttttccctggttcttctctctactatccttatctgtatactaaagtttaattttcaaaccatatgaatagtaacgaatttgcttgcacagtaactgctgatatgaacattagaccaggaatagctaatctgcatagatgctgcatataatccatcagggttcaccgagcaacacaattttttagcactttgcatctgcaacttagccaccacaaaattctgagggtagcaaagtattttcagaaaccatggaaaattttattagaattcgacggaagtctcagggacaactatatcacgggtaccggatcaggatttccgcacacctcaccacttcacaggcacagtactacaatttgtgattgcactgatcagcaacgaatttgaaccagcctaattttcaagcatttcaccgtaacaaacaaataactacctgatgctggttaatctaagtgctagaagctgagagataggatcctgccgcgacccacaccactaaattgcagccacatcacaagcgacgcatcagagctcagagcgaaaaacaaatcagttcaatgcgacaggtcactcagaaggagaatggagatgactatcagagttcgccgaatctatcaaccaaacacttcagaaattccgctacgtttggcgcgaatcgggtttcgagggagggatcacatcacctgctgccgcgcgaggtagtcggatttgatggaggcaatggaggagaggagctccgggagcgggagcagcttcgccacctcgcgcacgggcgcctccttcgcctcgatgcccagatcctccatgacagcacggccgcggccgacgccaaccgctgccccgcgcccccggcctgccgctgcagaggcgcacgaaaccgaggcggcgggtgagtgctcggcggggtgggaggaggaggaggaggagggcgcggcgcggcgaggcggggatgggagacggagatcgtgaagatggcgtggtgttttgtttcgtcggaccccggtggttgatgactagcggagcggggagaagagaagcgaacgggtgcgagtcgtgtgcgtgaccgtgtgagatctgacgggttctttcgagagaaacgttacgcgctgcagaataatattcactcatccgaaagaaatactatctactattagaagtcctttttaagagaaaatcactcaactttttttgagtaaaagtaattccttcattctaaaatataataattcaccctaaaatattagtgtggatataaattaggaatagggagggctgtgtaatatagttcaaataaaataacaggagcatggtgtt

SEQ ID NO: 30381 - DNA, 9611 bp, Oryza sativa
  unsure (1)..(9611): unsure at all n locations
ctttttttgagtaaaagtaattccttcattctaaaatataatagttcaccctaaaatattagtgcggatatattttaggatatagggagggctgtataatatagtccaaataaaataaacaggagcatggtgtttctttccctctcatattcaacccattttaaagcactggtacagcaatccacgtgacataatatttgatgaatacaaattttaataattgatgtcatcaaattttcatgtcgaaggaggtggacaacaagaattcttcctatgaaatcacgtcatgtacccatcaacagtatttgtctttatacataaacacaataatttcaattagactcaatgaaaccatcccattacagtaatgagccgttttaacttatcttaaaaataattacaaagtcctttactacgtaagaaataaattggctacaattttcaaggtgtcataaagattttatgttaggtttttcagtttttcgaaaatttcgccaagagactttggacagataatatttgcttatggcattctagcttttgtagcaacctcataagtgggcatagtggaaagaaatattcaatccaaatgtccaaaataagcatgaatgttccaaaataccaaaatcaaattgcaaatacaattggttgatgtttttatctgttatacattatatttattttttttgaattaaataattacattgtgtttaactttttttcgaacaaaatagcaatgcaaaagataaagtatcgtatgatgtattttaaaaggaagatttgagactggattggccaagagattcatcatgtgtatcggtattttaaggttgtttagtaaatattaaagataagggaaatagttatctcagtagtcaaattttgaattttcaattgtttggattaccctcctatatacaaaatttgaatcctaaaaatgtttatgttttggaacggagtgggtagatatttaaggtttaagggaaaaggctgttcagttttttaaaaaatttcgacaatcaatttcacattagaataaaagtgtaaaatctaatagatgtgtgatatgttatgataatactttttaggaaaatccacatgtataatttattttgttttctaaactaagcatttgagaaataactcacattgatatgcaaaatttttaatttttgaccgaatctttaacataactaagcgttcgctagttctaggatatgctttcggagctatgtagctcacaataaagtggtagaagcataggcttttttttatttcaagacaaacaaaatattaagaagttgtcttaaaaatagaaatgtacttataatgtaccatctatgttttttaatacatgatgccattgacttttgacaaacgtttggtcgttcgtcgtattttttttcttcgaatatataattttgtacataatacttacaggacctgtgataaatcaagcacaaacaaaataaatgataattatacattttttctaataaaataaatggtcaaacgtgtcttaaaaagtcaacggtgtgatatattaaaaatgatggagtagctatttgatagtaagattgttcaattgtgtcattattttcttctcacttggtttagcaattatagtacaagaggtagtgactagttaaaaacaaaaaaccttgtgagactaagcgaaggtaggggtggatatcgagctggctcggctcggctcgctctagctcgttaagataacgagctggctcggctcggctcgctatcctaacgagctaaaagtctgtctcggctcgggtcaattgtaagcttgagccagctcgtttagctcgcgagctagatttggacgacgcatgcccagagctgagctggatctggaagggcgagcgaacgacggactccatggccgacgagtcaagaaggagcaccacatagcagcgccggccagacctcgtcggagcagtggactccacgacgaccaacaaatcgagcaggaggagggccacatggctatggcgcggcggtgctggctggacctcgtcggagcgacgtactcctcgggcgacgaatgaacacacgcggatgggaggtgatgccggcaatgcaacgaaaggagatggggagttatctatttgccttgccaaggtggcggcatatggcacaccggcaaggtcacaaatcacaacaaagttggagcaggagaaatgtggttaggtgtgtgctgtggatagtgttgagtgctcgacgagctcctgcttctacgggcggccagctggcctatgaagacgatggccaccggtgaaggtgaggcacaggcatggtggagcaacgggtggagtgtgtgaccggctagagacaactagaggagagagagcagcaatagatcgaggggattggggaacgtactggagacaactccaactacgatagaaaaagttctaaaaaaagggtacagaagatgggcctttttcttgtccttttttcttataactaacgagctaaaacgttggctcgactcattacaaaaatacaacgatccgagccgagcgagctaatgagctacgagcttttcatcctaccctaagcgaagggaaggacaccaccttgcgaaaaactaaaacagtactgtaacacaatgtcatagataagatagcaaggatgtgtgtgtttataaagaaagacgtcataataacgatccactacataaacattatttagttatattcataaaatcccaaacttacatgacagaacgaaatgactaacaattacaagtcaagacagaatgcgttcttccttttcatcgaaacaaggaaaaaatataaaccactaaatcaatcaacaaaataaacaaatttccgcttgcttgtgatgcatgctcttgttattttccttgaaccacggtcattagcactgaggcatgtttggaggacgaggcagcatctgagcctgcggtgtcttgccgtccttcacgatgaacacagtgtccatcccccacaccacgtggcgatcaaaatggcaatgcatgaaccacacacctgaacaatcaaaataaacacgaaaaaaatattaaaaactgtacataaagaccaatatcaaagaccataatccgaaatctgaataactctcacctggattgtctgctcggaagcggattgcggcccagccggacctgggcacagagaccgtgttctggaacggcgggtcaacgaggttgtaggtcgccgggtccctgctctcgtcgaaggtgccgttccctcgtcccacgacgtagaaggcgaagccatgcagatgcatagggtggttctcgctggacaagtcatgaaacaccacctctaccacagtgccgtactccagcaccttcaccttggtgccacgcttcgtcatcaagggcccactgccgttgttgacgggcgggtcgacgaaggctgtcggcttgttggggaagtcctcctcgtacacgccgtggccagagctatagtagtaggcgtcgaggacgtcgatagccgggctctggaagctaacattgttgaggctcgccgcgaaccggttgccttggggtccttctttgcacttctctgccatgttggtggggtcgcagggaagaacgttgatgtcaatgtcgatgagcatgtgctcatcgacatgtgtcggtacgtgcaccgggtgttcctggttgcctaatgatctgagctgcgtgacgaacgccatcgccgcgttctcatccttgatggccggcagctggacggggaattccggtggcccgaccggcctcgcggtgacgctgtccgtgtactccacgatagccgtggcagtgctattgttgaaagggatagtgtcgagcggtaacgtgataaacgttctcgcggccatgtaataccggctgttggatcccaaggtgcgtttggcctcgaggagcacgtccatggtctggccaggcgcgatcatgatgtagtcgactgtgagcggcttggtgtagcgggcgtcgatcccgaccacggtgaggcggtgccccgcgatggcgaagaacatgtcgttggtgagtccagcgttgatgatcctaagcaggtacgtgttgccctgctgcacggccactttgaacgtgtcgtccctggagcaggggaacatgtccccaggctgggcgttgatggtgttggcgttggacggatccacgtctccgccgaggagctgcgccttgtcgagcacgtgctctatgtcgtcattccaccactcacctgcagaacatcatagagatggttaagatcaaaacacgtacgaagcattgcattgcgcaatggaacattatcaaattaacaagattagtttgttgtggcttgtgtataccaaggatgacgggtatctccttgtctggcttcttgaaggggaaggtggtgccgcgcttggggtggatgacgatggcgccgtggacggtggcgcggtcgaagtcactgtgcgcgtgccaccacagtgtgccctcctcctcggacaggatcacctggtaggtgaagttgccgcccggccggatcgggcactgcgtgatgaactccggcccgtccgaccacgggttccgtggctggtccacgccgtgcctgcgccacagtaaaatcatcgagaacaccgtaagtttcgagccaaggataatgctcttcttctctgcagcaggtggcaaaacggatgtggtttaccagtggatggtgatgtttttgttcccgttgttgtggacgttgacgatgacgaggtcgcccttgcgcgcgtagatggtcgggccggggaactgcccgttcacggtgaggatgctcttctcgtggcagagcctcgtgtagttggtctccgtaatctgcagggggggcatcacgcatggttaaaactcaaaactcatttcgtgcattcatgcctgtacatcggcatccatcagtgaacacgctagaattcaagtagatcacttacgaagaaatcgtagtggcgagtcttggcgccatgagcggggttaactgcaagtgctaacaccacgcctgctagtaaccaaagcaatgcaggtaacttggctgttcccatcgccgaacgcacacaattcaatcgccaatccaagggtaagaaacacagagctaattgagattctgtatgcgattaactgtttggttcttgcacagtagctaactagtgccgtaagctgctgatttgcagatggccatctggccaaatgtatttataggaaacgcaacgcacccatgcatgaatctgacgactgatgactattctatataccgccctgcagcccacctattgtcccacggaactagcgaatcgttctccagcagccgcggcgtgaaaaatgttaaaaatggcgtgagttgattgtcgggcctctcgctgcgtgttttgtttgtgctgtagttgtatgtatgtatgcatgctgctgtggcgacgttgtccagcctttggaccagccactaaaaaaatgtatagccaggaagattttgaaattgactgactgacgacgacatcttgaactagtccttcccagacatgcgcatccgtttcctgcgtctttacccaatcattaacttaattatagagtagtcgatgttgttaacgaactgactaatcaacgcggaaattgaccttgagcagacacacatccgtatttcgttgtaccctggtggggcacgtaagcacttgatcaaaagtctcattgggcacgtttgcatgtgttcggtggccatgaagattgttaattcgattatcatacattgagtaggtgggttttcgtgatttcgtcgtagcctagcgaagtaaataagcacgcactcgattaagtctcaggttgtgtttgcatctccaggatgggaactcgttctctccgcacaaaaaacggagcagtctattagcgcgtgattaattaagtattagctatttttttaaaaaaaatagattaatttaatttttttaaacaattttcatataaactttttgcaaaaaaacataccgtttagcagtttgaaaaacataagcgcagagaactagcgagagggttgggagaaggggttccgaacacgccagcctcaaagggcacgtctgcatgcgttcggcggccaggaagcttgttttctttttttctaaaaaaaataaataaggaaagaagggccgccaggaagattttgaaattgatatcaaacattgaggctctcttttgacgcatctcccgatccaagattttttaaattgagtattcttaacatcacaaatacttgataaatcatcgataaagctataatcacgtcgatatataatatttggataagttatttcgtttttattttaggtgttttttaaaattttaaaccactataatttaacatacaaactttagatttaccgtggatataactagccattaacagttgtaatgttacggatttcctccttttttgatttttttcggctcctcggagagttttacgcctgttgggattttctttttaaaaaaagctcctcgtatctgcacggaatatcgcatatgttcttggaccgtctgacaccccgttgtgtttcttatgtataataaaatctgaagctatgtcaagcatgacttaaatatctttctcatatctatttataagttattggaaggaagttttcaaattgatctagtgcaaaagtgaagatacacaacaatataaacgccagattttttttggaccgactatatttatgttgatataatcttttcttaaaaataattataattttcaatatgcatttacactatatattccatagtttgcactgaagaatcgtatcttgcacggtaaacaaatcaaacgccatgaaaatcaactgtaatccactaaaaatatgtcaacgcaattatagtatttttcctacaaataaacactgaaattgttatacatctatcgcaagattttttgttagagatattgcaattttttgacaattgtatttttattgagattcgtgctagggacctaaaaaaaatgcaaatgtgtgtgagaaaaaaaaaagcgaagtcgaggaaatatgcatttgtggtcatagaacttataattcaaagctcaacgctgccattgctactgtgcgactgtgactgtcacttaacgctggcaatggcaacactaatcttccagaatgtgaaaagttaatccagagagtgcacaatgatgacgtttgtttcagattaatgttattataatctagaatattaaatcatattactgtaagctagattataataagttgatataaaataagttgtgagttgtttgtttgttttattattagagatatataggggtagtgattttttgttgggtggctaaaaaatgtcctatatgtctccaataatctataatataataagtttatactaatctgacttatggattataataatctatcatattccctccgtcttaaaatatagcaatttttggttggatgagacgtattctagtactatgaatctggatataagatataaggtacatcttatccaagtaaaagttgatatattttgagacggagggagtaataatttacttgtttatttcagtttacttctaataatttaaattacaataattctatgctgaatcaaacatgcggaaaccaacataattatcactgctgctacgtttctaacatccaaatgcaaaccaaattctacagctgaattttgcaaaaatgatcgtgaccgcacgggccgcaagccagcgtaacagccggacaaattggctggactccaattaggccgttgatgggcgaccgctacaagcaaagggcggagcctacggcccaaagaacaggacaggtttgggcgtacagcgtactccctccataccgacaaaacaagtcgtttaaaacaaaattgtggttaccaaggagtgattaatcagggctattctttcatgttttcccttattaaatgagggtgcgggtgcattcatttgagaaacaaacagaactcaaatagctagtgcagtgaggtttgaaggcttagtgcctaggttcgattcctggtgggcttgttttttttgctgattttgcatggtgctcgtttgggccctcgtcaacagtgtccagcgcgtcgacggagtccggcgccttgacgtactctagcgactcgacgtactccatcatggcgctcggcagccgggcggcaaggaagagagacgcgcgtgtgcgagcggcgagcgtgtgcgagcgacgtgcgtgtgccattaatcacgtccattcagcttaaggcggcattaatcacgtcgcctcgtttcttgcctcgccgctcgtcactcggctctcgcatcaggggcatacgcgtccaaactataccccactgaggaacgacgacttgttttgtgaaaacggactaagagcccagaacgacttgttttgtgggcgtggagggagtactaggctcatcgtctcatcccctccgcgaccgcgagcgcctgcggagctgcgcctcccaagctgcggattacacaacctcggtcaaaaaaatcacccactctctccccgccacgtcttccctccccggccatgggagcggccatgctcctcgctcccatgcctttcctcctgctcgccttcactcccctcgccgccgtccacctccccacccgctgacgcctccgactgcagctcctctcccgcgccgcgcccgaagccgtcttcgncaccaccaccaccaccaccgcgcccgacaaccacttttttgtcgaggaatacctcatctccaactgcaatctcacccagccacaggcccacaaggcgtccaagagcantcgccaccttaagtgccgctccaaccccgacgccgtnctcgcctttctcgccgacttcggcctcttccccaaggaggtcgcggccatttgtgcctncaaccggcgcatcctgtgcgcccgcatcgacggctcccttgcacccatctgctcggagcttcgcgcngtcggcttctccccctccagaatcgccgcctcgcccagatcaccggccgctacttcctctgccgcagcttcgtctccaaggtgcggttctggctccccctcttcggctcatcggagaggcttctccaggccagcgactggaactactggctcctcacctccgacctcgagaaggtggtcgagcccaacgtctccttcctcaaggaatgcgggctaagtgctcgtgatatttccaagctgctcgtggccgcgccgcggcttgtcaccatgcacccggattacgtcaaggacgccgtgcggcgtgccatccagctcggcgtggccccgggctcccagatgttccggcacgcgctctccaccgccggctgcatcggccaggacaagatcgacgccaaggtcgccgtcctgaaggagagcctcgggtggtcgcaggaggaggtgaacctggccgtgagcaaggcgccgcggatcctggtcgcgtccgaggagaggctgcgccgcaacgcggagttcttgatcgacgaggtcgggctgcagccgcagtacgtcgcgcggcggtcggtgctgctcatgtacagcctcgagaggaggctggtgccccgccatctcgtggtgaaacttctcaaggagaggggtctgatcgagcaagaccgg

SEQ ID NO: 30382 - DNA, 3492 bp, Oryza sativa
gggtgcgtcccgggtctcgccgacgcctacgagtctgcctgtgccgggaagacgccggtgcaagctgagtagtgaccggacttgggggagaacaatggaggtgtgtatgtgtgtgtgtctcacttccattggataacttcattctactgatcaactatagcagggatggcagattcaattcatggtcattttagtgtaggtttcttgcagttgacaaggaggtggatgtgtataacaaccttgagaactgttcagttgtggttgaacaatgttcagtgggttttcatataaaatctgtgagcattacgtctcctatggtactcattttctttgttacaggcttacactctagctggcttctggcatgatcagcgatcacgatgtcctgatgtgcatcttccaattccaagttgaacgagagaaagtgaagaaccatctgagcaaagatataactagataaattgcgggactagggaagaacactctacataaggagatggaaaaggttgatctggttctcagcaaatcatcagaatgaggagtgttcctctacggcatagaacaagttgcggctgaagctttagaagaggttatttttcaagctgttcaactggataggcagaggctttcctatcgtatactagcatgtttcttggattgcatgcctactgttgcaaagcaaaaacttaggcaacccaagattagaaaaagcactactccatatacttcattcacccgtttctaaatatttgacaccgttgatttttttttaaacatgtttaaccatttatcttgttaaaaaaattaaataattattaattcttttcctatcatttgattcattgttaaatatacttttatgtagacatataatttcacatatttcacacaaattttcaaataagacaaacggttaaacatgtgctaaaaagtcaacggtgccaaatatttagaaacggagggagtaataaagagagtgaaaaaggatgccgtggagttgagtaggcccaacaaatccgggatttcatgggttacagtactttgggctaaaattgtgttccgtaggcccaagatggaactcgatcacgggccttatttcttcttcccgtgaagactgaagcccaaatctccctcaccacagggcacgataccgccgtccgttcgcggcgcgaccctttgccgccgcgccgccgcgccggcgctatgcagcgcctccaaaagcagctccttcccgccctgcgcgccgcttccctctccctgcctcccacttcagcagccgccttctctccgcctccaccgccaccttatcccccacccgcttcgtcgacgaggacgccctcgtcgccgcctgcggcctcaccggagccgaagccctcaaggcctcgaagcgtctacagaaggtaccctcaaatctagacgccgccctcaccttcctcgcctttctcgccgacttccgcctctccaaagacgacatcgccgccgcaagctcacggtacccgcggttcctccatctcaaggtggacgaaaccctaacctcccaagtagcccggctccgggatatcggcctatccactcccgagattggccgcctcattaccatcgccccctgcatcctctccaatcctcgcacgatctcccgccttgaattctacctctcctttttgggctcctaccccagggtgcactccgcccttcggaacaattcctcccttctacggcgaaacaacatcgagagtgaggtcaagcccaacattgcattcctggagcagtgcggcctaactacttgtgatattgccaagatcctcatgtctggctctaggatactcattatgcagccagagcatgtcaaggaaattgtggcgtgtgcagacaagttcggtatgccccgtgagtcagctggtttcaggtatgccctgatggctgttaccggcatcagcccagtgagggtcagcgcaaaacttgatttcttgaggatggttattggatgctcagatgcccagctacacattgcggtgtctaggtttccactaatcctgacatactcagaagttaagctgagccgctcactggaattcctgaaagcggaggttgggttggagcctcagtacattgtgctccggccagcattgctcggctatagcattcagaaacggctgatgccgcgttatcatgtcatgaaggttctgaatgaaaagggcctgctgaagaaagacactgatttttactctatggttaaaatagttgaagagagcttttttaagaagttccttctcccataccacaggtctgttccaggacttgaaaaagcttatctggctgcccgtgaagggaaaatgtttcctgaaatctaaaacagagatgctggaggtttattctgcctaggaacttgataatgttctgcattttacatcttgctcagttcttagatgatttctagcgatctgtatttgtgatttcatctgtgctttttgagacaaacatctaattttagtgcactcttgttctcattttaatgcctcgcacaccacaaggatttttgcatgcttacttaaggaatgttttagcctggagttgcgctgcaatgctgcaatttgtttgtcagccgatgcttctgtatgatttgaacagatctatagccagctcatgaatattactgtttagtgcattgacgacttcagtaattgcgccggtttgttaatctggttgtaccagagtttattggttatacccatccgtagaattatctatataggaaaccaaataagaagttgctttttcaaggtaagcagttttacagcacagaaaattttctcctgttttgggggagaaaaaagagagaaatgctggtgatatttagttgatggtcctgctttgaagaattgaagttgtggtgtcatgtactccctccgtttcataatgtaagtcattgtagcatttcacatatatatctatctagattcattatcatcaatataaatatgagaaatactagaatgacttatattgtgaaacggaggaagtacaaaatttggtagagaaatggagagttccagtatggtgttaacacaagtctacaggctacagctaaaacccagcaaggaggaggaaattgatagaatgcaatgcatagagttggctttgatagggtgtatccatgttttgaaatgctacgggatttcatagagcacgacattcaatgtttacagtttttctgatgggtcgttccgtcctactgtatatgggtgctagaatctaccacggggctgttcagattgttgctaaaataaaccctgtattgccaaaaattttaataagttggtaatattatcaatttttttttgagaataatattatcaaaattttggtagaatttctcatgtgtttatcaaagtttagcaagaaaataaatgtatgcacacctttgtcaactttaccaaaaattggcatcaatctgaatagcccattcaattttgggttaattggatccatgcc

SEQ ID NO: 30383 - DNA, 3018 bp, Oryza sativa
gtggtggacaaacggccgcgcgggcctcatgacgcagatcgtgggggagttcgagaacgccttcaactcgctcaccggcaccgaggtggccaccgtcacctccgtcgtgcagctcgagtcgcaggacctcgcgcagatcgcgcagcaggtgcagaatctcaccggcgcgaagaacgtccgggtcaagacccgcatcgacccggagctcatcgcgggcttcaccatccagtacggccgcgacgggtccagcctcatcgacatgagcgtccggaagcagatcgaggagatcacctccgagttcgagatgcccgcagtaaccctcgacgtctgatcggcatccaccaccctcccggcggcgctgccttggcccttaggtcctctcctcctgttgtctcttactcttgtgcaagtgcaacatacattgctctcatgtgattgttgaatgtttggtaagcattactgctgaaataatacatagctggattccaaaatttgcactgtttgattatcttggcctgcatattttttttagcagaatttgtagagtagcgtgtgttgcgttcactagctccatgtctcggcctcatgggggaagttttcaatagatttgctctgccaagttcagagtagaactgtagaagattgtcttgtgcgatggagcagagaaaacaatcattgaaagtagttcataagtgtgagggcattagggcaaagtggcgaaggaatttggcttttgtgatcacatgaggctgctcttataatctgcaaacctgtcaatctaatatgcaaatgcagtttaattagtgacagactgttcatccttttgcagctccattgtcacagggaatctcgaaggcttgtcaagaatgctggtcctcatccccttcagaactgaagatataatggaggaggctcaaatacatatgacgatcacgacaacattcttttctgcatttcttttcattttttggccggagccaatgtaattctcttttctttcgttgcccttgtaatttgcttcaaatactaaactatagcgaggctgctcctccattatgtacctgccgatagagtttgcagatatgtatagaaagtgccattgttttcatctgataaacgagatcaatatatcatgtggtgttccgttttatgcgtgccctgaacttttgcttcaatgtaagtcaggtaatatgccataaaacgttatactacctccgtactagtaaaggaagttgttttggacagcgacacggtctccaaaacacaactttgacttcttgtttctataaaaatatttatttaaaaattgatacatgtatacttttatgaaagtatttttcaagacaaatctattcatataatttttacattttcaaactcaataacttgagagttatttatgatttatattcctaaggtttgacataaacattgttctaaacgactttacgagtacggagggagcacaagcaaacaaaaaattaatttataagtaaaactttttttatctgtgttatttgtggtttaaaagcattgttgaaaactaaaatatgatgaaaaaaaccctctcaaaatcaactctaaaattaagctttaaattcaagttttgcagcgtcttataagtgtaccaggtttgctgctgagatttcttcgttttgctgcaaccttagccatgaccatggcatgtggcaagtgttactagggattagggttcatctttctgattgagcgctgaatcccgaccttcgacggtatgacagtttttgccaaatttcgatagattatgatcaaatttctaccaaatttactgttttaaattttaattttcgaaaaccattcaaaatttcacttggaatgtgcttccgtcccacgtcaaaagttcaggggcaggatctgctgaggtgcttgctcattaagttagtattttaattaatacctgtagttagcatttgtaatcaccaaggatccgtggcgcaatggtagcgcgtctgactccagatcagaaggttgcgtgttcgattcacgtcgggttcaaatccccgatccaaacggatctccttttttcttttcatttttgcctcatttttctggtaactgttcaatcctcaccgtccaactcacactaatcgtacgaagccgataatctgagccgtccaaaatcgcactaatccatccatctcctccccccctatcccctcggcctcctctccccccacccgcgccgcgcccctccctcccgacggcagttgccgccactcgccggcggccaaccctatccaatgcaaacctaaggggcctctccttttgacctaacccgatgctcgcctaccctaccacatcgagcccgtggccgccgcgccaccacggcgccgccgctgcccccgccgcgcggcggcacatggcggctgcggcagccaggggaaagaggcggggcgcgggtgccgcggcggcggaaggggcggacgaggccgccgaggcggcggacctggtgcggttcttcctccggaggacgagcggcggcaaggagcggctcgtggccgtgcttgaccgccacgtgaaggtggtccgcaccgagcactgcttcctcctcttcgaggagctcggccgccgcgacggctggctccagtgtctcgaggtgagcatggcgaagtgccccaatgcccgagtagtgaaaaaccctgtttctccttacgccctttaggtttctacagtaacaacgcctttctactgaaagtgagagacttttaccatggtttacatttcgtgtcacatataatctttgcctatgagcccaactcaaatcacaattgactagcagtatgcctgcttttgtgtactaatcccctgattgctatcataagtgccattttagggtgttgatgtggatcaacaagagatgaattttgaagttcctgtaagttggacatatctactggttccttactgctcttctattttgctaggttttcagatggatgcagaaacaaaggtggtatgttgctgataacggcatatatt

SEQ ID NO: 30384 - DNA, 20007 bp, Oryza sativa
  unsure (1)..(20007): unsure at all n locations
nnnnnnnnnnnnnnnnnnnnnnnnnnnnnnnnnnnnnnnnnnnnnnnnnnnnnnnacttttaccatggtttacatttcgtgtcacatataatctttgcctatgagcccaactcaaatcacaattgactagcagtatgcctgcttttgtgtactaatcccctgattgctatcataagtgccattttagggtgttgatgtggatcaacaagagatgaattttgaagttcctgtaagttggacatatctactggttccttactgctcttctattttgctaggttttcagatggatgcagaaacaaaggtggtatgttgctgataacggcatatattcgaagctgatatctgtgatgggaaggaaaggccagatacggatggcaatgtggctgttctctcagatgcggaacagtgggtgtaggccggacacttcagtgtataattctcttatcggcacacatttgcattcgcgagacaagagcaaggctttggcgaaagctctcggctattttgaaaagatgaagactattgataggtgccaaccaaatattgtgacatataacattctcctaagagcttttgctcaggctggtgacacaaaacagctagacatcttgtttaaggatctggatgaaagccctgtctctcctgatatctatacctacaatggagtcatggacgcttacgggaagaatggcatgatcacagagatggaatctgtgctagtacggatgaaaagcaatcaatgtcgtccagatgtaatcacattcaacatactcatagattcttacgggcgaaagcaggcattcgataagatggagcaggtgttcaagagcttactacgatcaaaggagaagcctacacacccaactttcaattccatgataaccaactacgggaaagcgagactcagggagaaagcagagtgtgtgcttgataagatgactgaaatgggattcaaaccgaactatgtgacacaagaatgtctaatcatgatgtatgcatattgtgattgtgtctcaagggccagacagatattcgatgagcttgtgagctcacaaaataatgtacacctgtcatcagtgaacgcaatgcttgatgcgtactgcatgaacggcttgcccatggaagcagatcagctgttagattctgtaattaagaaaggtgctgtgcccagtgcttccacatacaaattgctttacaaggcctacaccaaagcaaacgacaagaagcttattcagaagttgctcaaacggatgaactcacagggtattgttccaaataaaaagttcttcttggatgctttggaggcatttggcaacactgacaagaaaccccggacggtacccagcaaaaactctgcaagcaagccagatgtggagtccgcaaacaattctggaactgacacttcaagcaagccaaatttaagcgtttggcaagttgctgcgtgatggggcggtcagttagttcttacaagctcatactctgcgttgcctgacagcacggagaatgcaattaatttatctctaaaactgtctatagcagtatctttggagatacgagcgattgattggctcataacgcagttttctttatgtgaatgctgagatcttttgtgcgtcggctaatgctgcttgtagtcttgtagatttcatagttgtgttgtaaaatcagcataggggtttcttttttttccttcttttttgttcagctcctctttcgtatagctgcaagcctgcaattctgtctgtcagtaaccttgaggtttctgaagtatcgcttctcattgttgttcgcatctcgtgcgcatgttctgatagcttacctttctttgtacatggatcagtttatcaacttggtaagacgttcatggatcagtttatcaacctggtaagacgttattgcgcaggtgatgcatcctgacgatgcaattttgccactcggaaataacatgtctgtaacacgcttacgggcgtattgcgtacacaggaaaagcgtgaaagctggcggaaatgtccaattagcgtatacatcagacaacagtacatcatactctcataagagagagacaagcaaacctgcaaaattcaccagttcgatgagaacataagtacaaacttctgcaaatccggatgaccctaattgggcaatcctgaaaagatcaacctgaagattcccgcgatgacaacgggcaaaagtgatcttcaccaacaagtgaatagagaattatgacatgctaaattcaataatgcagtttttttgtgtcaggcctcgtacatttggagcgcaaaaccgtgctcgcctacaactggcagtccttacaaagatacaagggcacaggctccagatgagtttctccccggcacttttagctgcatgttcaaagcttctcaagaacgatgcaccagtttgatttgtcatagaattggtcaacaacaactgcattgtttataccagcaactaacctgaaatgaaattaatgagacaatgtgccagagataggagatatttccaaccaaaagaccagagatcaaacatactccctcaatttcatattataagttatttgatttttttcttagtcaaacttttttaagttcgaccaagtttatagaaaaatatagcaacatttttaacgcaaaacaaacatattatcaaaatatattcaatgttatatctaatgaaactaatttggtgttgtagatgatgctaaatttttgtataaacttggtcaaacctaaaaaaagtttgattaagaaaaaagtcaaaacgacttatagtatgaatcggagggagtaaaagcaaaactttagaatcgcaagtattgtgtatcataccattgttgcatagctaaacacaaaaactgatactagtaaactactaaactgtatgaaaatatctcaaagccaaacaatagaaatttcaaatcatcagtcaacaacatgaaatggagatattctggtgaacttatatataatgtgatatatcttaactcacgcattttcatagaaaaaattggggaaaatgaaaaaaagaaagaatagaggagcattttatactaaagctcagagtaagaatgcttcacctttgaagttctccttcaacaaaaacatggtaatagcggttgtagaccacagtacccttcttgtcatctctttttgcaaatccattttcaagagcagcagcagatgcaccaccaatttcagctcggtgaaatggaagatgccaaggaacaaagtactcctgctgggttttgtgatactcatcaatgttggaattgctgcaagttacatcggcgttatcatccaaaccatcattacttattttcagatcatcattcctttgcttcactgcacctgtgtcttcatcagtctctgatatgctttcaagcacagtattggattgattacgcactggagggctgctcggatcaacccactcttcattatacttctcacagaggggagtccacttgttgagaagtgacttgtcctcctgctccacagcccagacagtgatgagcaccagaccacctttccgaacaacacggatcaactcttcaatggccttcctccgcctggcatcagtacttaaatgatgcagtactgctattgaaattgccgcatcaccaaaattatccctgtatggaaggttgacagcatcagcaaccaacacttcatgccctctcccagcacatatatcaatcagtggtgggcttatatcacatcctatgaataaacagtcaggattgaagcccagatatttgccattaccacagccagcatccagtataactgaccctggcctcaacgaattcaagaatcctgcaaccttaggccattttgcaaagcgtgttgagctgaaatgtggggctatggcatcatatacacgatgcacatacttcttctctatgtcaggagtggactgaacactagaacagctgttgttcccctcagtagataccgtttcctgagctcccagcatttcatttgaattcatgggactgcttgtgctagtacttcgataatttgaactatatgaattcgatgcacagatgactctagaggatcccctgttgctatcctcgaaaatatttgtagcatacaaatcctacgtgtgaaaaactgaagattagccacactggcatgctggtaagcctaactcgttcaataaaatgaaatcgcaagtactattcgactgcagaaccttttacaacaaagaaaagggcaacggttaattagcagcatgcaacaattaacaataaattcgctgcacaacagatagtgagccctaaagctctggataagactagactcaattattcaaccgttcacaagcaaacctatcagaaattacgagtccagagtggggaaagcggaagctaaccttggaagagatcaaatctggcgtaagccgtctttaaggctgaactccaccaaaccaaaaatcgatgcagcgagtcagcgaccggccggtctgcctcctccctcggcggagacagcggaggagggccgaggatcccgtaccggacgggcacccgcacggacagccggagaaacccctgacacgcacacgagccagcgacgggtccggacgctccaagcgatcacgcttatacagcgccgtcggatcaccgacgggaggccgcgcccccgcgactggtggcctcttccacggcgcgcgcgacgccgagccggagagagagagagcagagggtggaagggttttgcggcggcggggtcgccggggttgggttcgcgcaagcggagaagcggcgcggaggcggagcccgggagccgcgcgagccttgcggcggaaaccaacggtagagatgggcgagcggccagaatcggacggcctgtaacaagcgggagagatgctattgtatttggtaaatgggccgctagatatattgggccgggccgtaaagctgttgctgtcacatcgacacatcgcagccaggccccacatgtcagtgacactataaagttaagttaaattcctatcttgcaactcagatttttggtatctccaggcttgttcactttattaccatttttaatcttaccaagttttagtatggttgctaaattttagcaagattttatatgtacttactaactaaatttaatagcaaactaaatgtagctactttttttttaactttgccaaaaaataattgggttgaaaatagtagcaaagtgattctttggcataatgagaaatttggcccaaaagtgtttccagatgggataactataggacagattctattttttttctttcctttttccgtccacgtaacagaataaaacaccccttttttcagcttacatatatgagtacaatattctggttttacatgacaaacaccagtgctaaaaagaatcgataaaatgtcaatgtggcaagagaaaaaagaaaaaggagagaatttttttcgttttcacattacaatttatacaacagaaagcatccaatccctgtcttctgcacactcgttacaacattaagatcaccatgacgcatcctccagaaaccttcagttccagctcccaagcatatttgacgggtgttaaagtatgtatatttctaggatttgaatggctctaaaattggatgtcaaaatgaattcacaagagctgcgaacacaggaaagcagatacaaaatcctagagcgagacattgtacatcatcatcaggcaggcggcgtatcacagtatggtacacccacatctgttctgcttgggggaattcgcaagctgcttctctggaaaggagaaaccaacaacacattatagatgtgtatatagaggtgtcaaattggtctagatgaaagctttaagcatttaattagccaaatactaccatataaacaacagaattatagttccatgagagtcaaaaccaaaaatagttgcagaatcgtagttttaaaatactttagttcattagaataagtagttattttctagccagatgtctataaacaaaaaggttttgtgaatctgtaggctgtagttttatgtgcaaagtgtaaacatggttgagaaccaacccaacacccatttcaatctatagaagtaacggcgccaaactgtcctatttaaatcttctaacatgtaacaaatctaaactgaagctatcaaaaaagttaatacagtttcttatgccacaagactaccatagacctatccatcataaaagcgtgttaatttgcgaaaagaactcgaaatattcatttcatgcctctatcaacttaggaaacaccagctcagctgctctacaatttccatgcaagtaattgaccaaacaatataccttgatcaattaaaccctacacaaaataaaacaaggaacaaaccgctattggaaaaagggctgggctcttcttgtgggacactgtattcagattacagatactatccctatacatgttcatctttggaggacaggacactacagtcttagaatgatacccagctgtagcataatttcattcgttgaatttaatagagttttgtgtcaacggagaagcgaaataggccatcagtgcagccagaaaaacaatgtgaaaaaaaagaaacaaaattggcggcaataccactgtttttgtcgggttgtggagggcgtactaccacatgcattgtaattacacctcctggaacctctcctactggaacacgggactcagcaagtgtccggttattctccaatatccgtccggcattaatgagcttcaggtcattgacagtttttggagttatttccttatctgccataaaaagataaagaacaatccctttaataaaataaatttggaatataaggataacaagtatggattatgaagaaattgaatctttacaaaattacaaagagaacttcagaatgcaggtcaatctgaggacatccagaaaacgttaattctcatttgtaatcaatagtatctcaaaaaagaaattgcaccatttccagccttcgagtttgtaatgcagtgtgtgttcaatgaaggtaaaagtactgcaggaggaatatcttgcttgcagacactgattcaactgggaaaggatcaaaggattcaattttacatgctctagtttactcaggaaggagcacctcacccaagcattgcacatcaagaaaagaactcctgtctgagtgtgatagtcagatggttttttttttttacaattgttggcctatccatttcctcagttattagattttccattctacacaccaaatctttctccggtggtcccaattaatgtaaacggacatccatttatacagcagcatcttttttggcaaaacatcagccagacaaaaggttgcactatgcaaaagattctggtggttgtcagtaacttcaatgtgccacatgacaaatgtggcccttgctgatcattatgcttaagtgtacaaacaaccaaatcatttatgtgttccatagtgttaatagaaatacagctgtggttgaaatcgtcacatccgtcctgatggtttcaccacccaaaaaaatgatacattagcaccacagtcggtgtccagagttcatccttaccgtttacttgtgaatggcccagcaatcatattgacgcaaaggaccaaagatgtgctaagttctatagtgctagcagaactaccttcagataatgtaggaaagcaaataggtatacaaaaggcataatactgttattaacatggcattgtgccgtcttctttgtgtctttactctttataggacataggaagactaccctctttcttgtttggcccttcatcgcacttatttgtgatccaaatcattgcctgaaatgtgttttttggggggttttctgccacaaactagcagaaatattattctggcaatatccgaattcgtgtggtcgggatttttcatggatgataaacatacactgagaaggggaattgtcgattgacgatgtatttatctggcatatccagttctagaaagctaagggggaaaagaactagttacgcgctactcagttggtcaccgtatccattcagagaagaacagattaccaattaacagtcgtctacgcatctgacacgagcaaaaccataggaaagagagggtaggaaaaggagaaaaaaaaacgccccacataaacaccacgcaaaaataagacggcgcaacacaaagcaatatacatgatccaagaaactacatgggatcaagaattatcacaagccatcgtgtgctttcaccgaatcaaagatgcagcagatcagggcaaaaaagaaaaaaaaaatccgtgtactcttatcgaattgatgcaggaatcttctgcctctcaccttgcggccaccgagcgaggatgaactccttgagcgcggagacggtggtggaggggtcgtacttgctcgggccgatgtccgtaccatcaaaaagccggaacttgacctcgatcggctccttcccgccggccatctcccggccagatcgccgccccccacctcctactccccaagatccaagaaaccccggatcagaaatccatagcaccaaacagatcgcaagaaatccacggggccacgccaaagatcgggttttgatgaacaattcttgcttccgtgtgggggttgaaagcgagagggcggcgactcggtgggaggagaggaagagaaggggaggaagaaagaagagaagagacgaaagacgaggagggggcacaggcacactggggcttccttcctcggtaatttaacagatacacccaacgagaagcctcaattattttttccactagcacggagacgaagacggagccatccatggttgcgacctgtgaaagtgagaagcaggcggggaattctatgcccgagacgatggaatcaatcgtcggaactgcacgtcggcgacggctggtttgaccgcgtgaacctgcctcatcgttggcgtcttctcccctgtttttctcctgcgccactgctgctgcggctgagctcatgcgcatacattgctactctagctgctggcttcgctggaagtggttgtactggtacaaaagattggtttgattctgaacaaacacacacgcatgatgcatatttttagcagcttggatgagttttgcacgttatttacatctccagtcaggaaaaaaaaagttaatcttaattctttcttcttctgttgacgtcaaaatgactcctcttcctgagttttgaaagggtagcacatgaatggatttaatacagatagtaaatggatttaatacagatagtaaaagattatccttggaggttgaaatggtcggagacggaagcacggagctttttctttaaacgatggtcgttgtcacatgacagttgttgtgaaaatgtggagcaccagacgcaactctttttttctgaaaaatcttgacacgtctcttcatctaaatgtctctggttctcaagcagggtaattactgtttgcactttccggtgataaactggcacctgcaccccattagaggtcatgagtttgtgattagctagtctgagaaggttggctaatactctgacttgctaaccaatacgattagaaattagaattctcctttgacttacggatcaactaacacaattagaaaatagtagaattcccatccatacagcatctgatagttgcatgagacttgcatatggtttgtatattctcagaatctcaggtaacaatccacagacagggataaccaaacgaaggaagcacccaattattcgaggtcagctgctaaacatttcctggcaggcaaagcatctgacagctgaatctttgttaaggctgcatttgtcaggcttactactgtatcttttggtgatttggtcctcggctgaactaggaaacacgattttgcttatgtgcatatgcatacatttacaggagtgaaatctgaaaaaagtccaggctacaccaactatgacaaacctgaaatttcaagcaaaaagggaagacacgacgtggtaaccgcacagctgaacacacggacaaaacggcatacatatgcagtggttgggtttctttgttctatcgtatgatgcaatcaaaaaatggtataattatgattggaggacagcaaagactccggcaatttttgtatatatcacaaatgatttacaaggtcttcccgaaataatggaactgaatcttatacatgtcgctctccaattaatttctatactgatgttgtctcagccaagtactattcccttttcttttggctaaatgccaagtactactattagtttcataagcaacaagaataaaagcatgtacctgcattgctcttatttttataatatataaagaaaaaaagaaatcaaagcaatagtgcacgaatacctgaaaaaataattggtactatggaacaaattgtcacgctcaactttgaattagaacgagccactgcaaagatttccacggtttcaggtagaaaggagctgttttttagtggcaaagaccaccgaagtgtcatatagtggggctctagattccgtactacttgctttcgccaccgcaagcaatgatagaaggatgcagtgcaagcaaagtttgtagaattctcgtggcaaatactaacttacatatatactcacatcatcataaataataataatttttagctacgaatttagacacgatatatatttagattcgtaatcagaattttgtttttttaatggagggtgtaggggtcagtttccaaaccccctcaagctcaatcttatctccggttcctgactagtatgttaatcagcattgaaaacaaattcggtgatggtatattcttatcaatggatgtgacaattaaaatgttaatatatgctacatgcactcacgcagctgagataaaagtaatcacataaagaaggttaccagaagtaatggataatttctatgctcgaattgatacgggggatgacaccaacctacctaattagctggtattctgaatactgctaattggtactcctactataattataatagtctgcatcaagacaccacaacttgtctttatctacccaggagatcaacatctcattcgttttcaactgaaaatcatcacccctgttgtctattatgcaagttggaatctgatccgttacctctgagccttcagaaaagagttttgcagtttgcattacactgaattctgcctcattaactgatgattgggtgtgcatcttaggtgctctactccactaaccatttctcccctttttccctggtataattctttttctttacattccccaatgatttggcagtaaatattgatgctgcaatgctgcgtgatgtttgtctctatcttgcaaatctgcaggtctgttagtggcaaacatgcttgcttagtgtgcctgagatatatgccaaatggccaattattgtttatgctgttatgcacaatcctctctgaaacagcttttttctctgctactagcagtagtggagtcatgggcctactaagtgagagttgaaagctccactacatatgtaatcaatttgcattcatgccggtgtatgagtagattagaatggtagatgcatactctacaagaagaaaacaagatgaaagtgtaacttttcagacaagtggtaaataactatgatagaaaaagtgcaaagaaatagagtacctttgttcatgtactggtttgagcatcagttcacagaggataccagggctgtgagagagactaagactcgagatatttggtgatccaccgccaacgacaagctaacgttgtgtgctgtggcgagcaagtttcgttgtggatgaagaagagggaggttaatggaagatgctttgtgtttctgacgccttgatttgatttgatcgtctctgaatttgacagtgccatgattaggtcggtggtttcggacaactgtcgagttgtggcacaagctcgggtctttttgatgatcgttgccttctcagtagcagggtgaaacgtcggtctaccaactcgtgtttccacatttttatagagtacccgtccattctcttgcgatgaaatgtttgtgtctgaattctgaaatggtagctgtgattgactgaactgaactgaatacctagacgcttgtcacacttcgcagcaactgctttctgtagagttgagattgacagagaccgatccaaatccaacctatcttaaaaaaaaaaagcaaaatttgctaacattcaaaaaatgtgtaattagctgtgaggcaccacaaaaacgtgtatttgctataagacaccacgaaaaactggtaattagctgctggacacctacgggattattttattatatccgaaaaaattggagagagaaagaaccgtgtaagtatggttctacccttcaattttttttctttttgtttttctcaatccttctctactcctttttatttttctttctcttcttcttcctcccgtcatcttcttctctgcctctttccagggaaccgagaggaggtagagaagggcgctggtgctccggtggccgggagacgacgacgctggcggcggagtatgttcccgagtgcggcacaacaagggagggtggtagtaggtcgagggagtgagggaaatggccggaacgacgagtgcaaggccgtgaatcgggaagagagagaggttgggtggatggttcaaagtggtggcaaagggaaaggggaaatggatgaaatggttctactcggcgaggcgaggctaatggtgagaggttatggctggtgaggctccgaggaaggagatcgactggcggctggcttgacacggcatgagagagagagagaggatcggttttgtgtggagaaaagtggagctctgtccatggattggtcgacggcggcgacgctcacacgtggtggctgtggtatggttgggcggcagaggaggaacggcagggcgaggcatcggcgctttgggctgcggcgatggccgctcaaaccacggtgacgacagtggccgcctcctgctcgcactccacgccgccggcctcgcgctccctccctgaccgcgtccgcctccgtgccgtcggccgctcctggcgcgcggtcgccgctacccgctccctcgccgtcgacaacctcgcgccgcggctgctccctgctatttttttgtgtgtgatttcaggtggaggaagatggagccaggggcaatcttgccattttgaaaaatttcccgccttttttgattcggatattataaaatattctctggtgtcctatagccaattacataatttttgtagtgtccatttgccgtgtctcgtttttgcagtgtctcccagccaattacacgttttttgagtgtactgtagcaaattttgccaaaaaaaatgcctcactctagctcaggcccatatactattctgagccggaagttagctatgggctgaagcaatccaatgcatatatagcggaagttagcaaggcctataattaaaagcataagtatataggccatagctaaatactaaagatcagccttacctttctcaccatgcgccgtataccaatcttgccaactactcccttcatcccaaaaaatctcaacctagaactgtgatggaacataacctagtacaacgtatctagatataaagggatataatctagtacaacttatctagacatgctagattatgtcccatcacagttctaggttgagattttttggacggagggagtacgtgcaagcacaggcttcacagccgtccgatccgcctctatccgttccgcagcaatatctaacaaccgaatggacggataagataagctccaacgcagcgtaatcaaataaaaccagatcaggaagcggtggatcgatgacgactgctcggtcgatcgggccggtggcctattaattaggtcggcatcacgggcgccgcgactgtcctcttcctgccatctcggagagtaaagtaaacgcgtcctcctcctcctccgcccccacgtataaattccgcgtcaacccggggctcgcgccgagatcgatcggccgagccagatacaccgatccgatcgatgcccgcgcagagattgccttgccgtgcccgtgaccgtgacagcctcggcctccgatccctcctcgtcgccgatgccgcgggctacggccgcggccgcgtcgtgacgcggacgatcgtcgcggttcaccaggagacgacgacgagctgcaagggggatcagtgcaacggctgcagtgatgatgatgaggaggaggacgtccacgacggcgaggacgggtgctgggtggcgtacgggcgccgggggatgatgcgccggctgccgccgccgctcccgtcgctccggggcgcgatgaggcggacgtgcaccaaagacgggaggctcgtggtcaccgaagcgcccgccggcgccaggcggcgtcacgagtacatccgcgcgcgccgccggggcgggcgcgtgacaatgcagctcgtcgagagcaaggacttctacccgtgtccgtcgccggtggaagaggacgacgacgacgacgacattgtcaatgtcacgcaagcggtcagcgacacgtcgacagcggcggcaaccgtaggagaatgcgatcctggccacatgcagaaggcgccggcgacggcgccacctccgccatcgccgccatccattggatgcttcgaggacgtggtcaagtaccactcgatcgggagcacctcactgcatcagatcgttaggctaagaatggtgcactgagatataaacaagtaggataatttttgtagttaaatttgtacgcgtagggcacgacacgttgtaaatgtacatagtacaccaaatatctgccattagctatacaaaccataaagatttacacacagccaacaaagatttgtttggtccatgtgtataaatgcaggttgattagtcccatgatgggactacctatacatttgtcgacaaatttttctccaaaaatttgatagatgtaattatagtacaatcgtagtgtaattacactgtaacttatatgtaattacactgtaacttgcatgtaactacagtgtaacttatatgtaagtttcacataattttgaatcgttggatctattacaagatttgttttggtgagaaagaaaacaaatcatagcacacacatatgtgaaagaatttgttcccacgacctccattttaccgaaataacatgtaacggagagatttttgaaagttacatacaagttacactatagttacagtgtaattacatgcaagttacagtgtaattacactacgattgtactgtaattacatctgtcaaattttgggggaaaaatttgtcgacaaatatatagcaaaatcgatttgaattatataaggtgcagagctagacgtacgtgcacaaattaacatgataataattaatataataaaacaattttcagctttcatctagctacctggcacgcatatacatgatgcatcaagaagcgtacatgcattgatcaagtattgtatttgagtatttgacatgaagaaacgtgcacgaaacacttcccggataaaatataaataaataaatatcttatcctttttatcccctgcaataagactctttattatcgatatcttctttatcttctagaaaatcttcctaggtccttgtatggtgtaacttcataggtctttatatggtgtatagtgtttgggacttttgcacgcataaaaattttcatgtctgaaatgcaaagatctctatccaaaaatgaaaaaaaaagaaataaaaatgatatctgaccattgaccaagaaagattaaatgcgttgaatttagcttttattttcacgggtgcaaatggctgtggcaaccagaaaatagccaggtggccgtcttccccagccagctacccgggaaagcgaaggttttaaatacgtcacagggaaggactcgagccatgattcttgtcaactttcaagctgtgctggcgaatcaatggccacctgcttctccaaagggattcacggagcagcagagtcaattaaaagttctcagaatataagaaaaccttctaatcataacagccctgctaagagcaggtgcaataagctggctatgcgggctgcaaaaatatgccacatcatcttattcctatgtggagggaagagagaatagatgagagagaaggaagcggatgactaatttgtcgtcgggcgatacacttttctcgacgcgctaccgctcgattgcagccggccctggcgataaaaaacgcggtttgtggggcgcacaccacagccgatcccgcaacgctccctctgcttccccatcgacgcatatgcggcgcgcgatctctgtctcctcggcgctcgctcgatctccgcttccctccagcgcgccatctctggatgctgtcaggctaccgacgtgggcggccaggtgcagcggcgtgctcccaggccgggaagcggtgggcacggagacgtcgtccttgtcaaacagcaggtgcacgcatgccgggcggccctgcctggagcgctagagctaggtgcagcagcatggcaccccgcgtccctgacgtagacgaagcgagagaagctccaaaggcagcgacggtccggtccctgcctgggataataatattatgggttaatctagttagttgctatggtatttgagttatctattagtgcttgtagtttccatactacatagaacttggtttatatggtagtggtagtgtttgatgaataaaattcatgtcacaacacaaatggctacagagatataattcactcttgatcctacacattgacatgtgcatgttataattaattacttgattataagatgtagtcatccaatgaacaagttattgtacttatagttggctttaggagtaggctattagccagcagcgggctataccattagccttgctctaatctggtgatctctcggcacaggaacttaagctcatagagcaagtacaataggagaattaagcaggctataatatatccatcatggcaaaaagctgagttggcggagggaatcaaggacagagaacttaagcgggcgactatattaacgccggctgcacgtagcctccaagactaggtgaatttactgtaattggccatacccttgcttacgcatagtgattgggtactagctgttcaggataaatggtgattgaacagcaatcggtttgtgcatgcagcttttggcctgcccaaggaagaaaacgcaagctacatctatatactatatagcctattaaatgacatggtgaattttatagccagcaacgggcggtattattgatcctgctcttatagcaagttcaatagtatagccaactactagctccaattcatctatagccaatctaatagctcattcatacaatagttacatactatactattaatacatagtcccacctatcatagacacactgcgtcttggggtccgtgctacagctgactacaaatctgtagcccgctgctcttctctctcctgatttatctccttaaaatatgtttgcagttggcttatagcttgctattgtacctgctcttacagaattaaacagagcatcactcccgttagcatatgtgctccaataaagaaattttacttgagaaggttaaacagtaggggggtgtttgggagagaggggctaaactttagcccatctcacaaaagcataagtccctctcctagggatatatggactaaagtttagtctctagttcttaaacaccccctaaacactagtacgactactttcatcctgatgaaaaagagagaggactagctttcccaaaagggctgccgttttctgcaccgtccaaatcccagagagaaagaagcccattcggcctaacaaaggcgagagaggaacagggtgtgaaaaaccgccggtaaccgcgcggttaccgcccgtaccgcgggggtacggttacccgtaccgcgcggtacggattaataaaattcgtccaaatttaaaaatttaaaaaaaaagaaaaaaatctaaaaaaatagtgaaggcagtgcttgatttatagtggtttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaattttgaattcaaatttcgatttgtaaatttgtcgcggttttgcgcggttaccgcggttaccgccggtaaccgccgtaccgccgggtggcggtaaccgggcccccggcggtttttgaaaccctggagaggaaagggcgatgagccgaagatgatcaaaagtctctcttcctgtagcagcaacacgtgttcttgcaagcagagccattcggcgccgaccggtgtacctttcccaaccaacagcaacaatgcagctgctgcctgcctgcgcgtggggcgaaactcttttcgccccccttttactttcactttccccgtttcgctccctgataacagctatagcccggactctcgtagacgtggtcatcagcaaaaaaagtcgagtgcacaagcacaaactggtgattaggacttgcacagttgctgcacccatgctaaacacgccgtctcccgtaaaatcttactactagcacccatgttaggcctaccacaaaagggcccatgttttcctaggctataggagtatgcgtgatgcgtcgtcgcttctgtttttgtgcggcgcgtgttggtcttccgcatcatgagtccatatgcccgagaaaaagaagagttcagcggcatgtgacgctcacctcagctgctgcctcgtacagagcaaacgagggggaacgaagagctagctagcgtgccgagtcttggagagcagcggaagtctttcctggcttggtctttttttccttccattccctctcggtaggctgtgtttagatctaaagtttgaatccaaacttcagtgctttttcatcacatcaacatgtcatacacacataacttttcagtcacatcatctctaatttcaaccaaaatctaaactttgtacggaactaaacacaaccgtaatcaagcagaagccagcgctccgttcttctgcgccgggagctgattttttatatccagggaacgatatattggcaaaaatatgtttgacaggtagcataaggcctcctccaacaaggatgagtcagctagctcataaatttccacatcagcttttgtatgatgtggaagagagagaagataaggagagagaatgcactaactcttcttcaagagctaagctcctaaagaaaatgcgagaggaattgtgaaaccaaaacattttaaacaatgtgctatgagacaatttattagagagttagacttgttgctatcttttatatgaggtggacaagcatatgagctagtacactagctcaaccattaaaggaggcctaagaaacacgggaattgtctaatcggttagctctttttgccatatgatgattggatttggatacacagtgatactagtacggaacatgtcgtgcaatgaaattgacacgttgtttgggagtacaaatacagtggagagtggaactgtggactctagagacaacgtagaaagccaggaatactcaggcatgcgtacatctcgtactattccgtacgttttttttaaaaaaaacgattcgtttatactttgctaaagaatcaatcacacggagtggtattaatcaaacttaaatggactaactcaaataaaaaaaattcgtcgaaatcgaaatacagagcagccttcatttccacagtgagggtgtgtttagttcatgtcaaaaatgaaagtttggttgaaatggtaacgatgtgacggaaaaactaaagtttatgtgtagaaaaattttaatatgatgaaaaagttaaaagtttgaacataaagtttagaactaaacttg

SEQ ID NO: 30385 - DNA, 646 bp, Oryza sativa
catgtacagcctcgagaggaggctggtgccccgccatctcgtggtgaaacttctcaaggagaggggtctgatcgagcaagaccggtgcttcttcaacgcggtggcgccaactgaagagaagttcttggagaagtttgttgtcccctttgaggggtgcgtcccgggtctcgccgacgcctacgagtctgcctgtgccgggaagacgccggtgcaagctgagtagtgaccggacttgggggagaacaatggaggtgtgtatgtgtgtgtgtctcacttccattggataacttcattctactgatcaactatagcagggatggcagattcaattcatggtcattttagtgtaggtttcttgcagttgacaaggaggtggatgtgtataacaaccttgagaactgttcagttgtggttgaacaatgttcagtgggttttcatataaaatctgtgagcattacgtctcctatggtactcattttctttggtacaggcttacactctagctggcttctggcatgatcagcgatcacgatgtcctgatgtgcatcttccaattccaagttgaacgagagaaagtgaagaaccatctgagccaagatatactagataaattgcggactagggaagaacactctacataaggaga

SEQ ID NO: 30386 - DNA, 464 bp, Oryza sativa
ccaacatcaacacctttctttgataggaattcctttgcctccaagatatcctgcaaattaagtaaatacaactgagaatagactaataatttctttgaagcagaatggaagtgtgaattatctcaatatcagttgggttgtttcctttgaatcatgcaacggcaattgcgaagattttcatgttaccatagtgcaaactgcatactttaaaaatattcatttacatcacataataataccttgaacacccatttctcatatcaacagagaataaaggggggagatagagtaggaagtcgaaaattttcactggtatatactaactaacatcttcaagtcatagaagtcctagtttcaaactaattaagatcatcataggccccatgcacagaaattttaagctcatggatctagaacaactaaccctgctgtagtagtacagcttcttgcgggccagttgggaa

SEQ ID NO: 30387 - DNA, 822 bp, Oryza sativa
aaaaggccgagaggacaaaggccgtattgtcgaggaaaaaattgataatttaacaatttttcgttgtccaatctatatactaatataaaaaggaggagttgtcccctccaatgctacaagccaaatcatccggactaatctggaccgtccatccgcgcgcttctcttcctccaccgcacgatttcacagccgaggattccacgcgcgaagacatcgctcctcctccacccgcagccgcggagaccgcgcgcttctcttcctcgctcactcctcccagcgtcctcgcaggagcgactccccgctgccgccgcggccgtcctcctcgctcgctcctcctgctccccgctgccgccgctacgccgcgccatagccggagccgccgcggccgtcctccttcttccccaccgctgcgccccgctcttccccacctccttcttcccagatcgtgcttctcccactcggatcagccgacggagccgactttggccccttctccgccgccggaaccgacatcgacctcagcccgcggccgtccttcttcttccccaccgccgcggctgtcctcctcacgggcttctcctccgtcccgctgccggcgctacgccgcgtcctcgccggagccgccgccgtatcgttcttctcccactcggacccgtacgaatctccgtcctccaccttcgccgctcgcccctctctctctctctcttcgcccgtgactccatcccctccctagccgctgccctcgcggcctcgccatcgccaatccctccatgccttctcgggctcatggtggaggggcgggggctgccttcggtggagggg

SEQ ID NO: 30388 - DNA, 659 bp, Oryza sativa
  unsure (1)..(659): unsure at all n locations
cgagctcggtaccccatgttgatgtgatgaaaaagcactgaagtttggattcaaactttagatctaaacacagcctaccgagagggaatggaaggaaaaaaagaccaagccaggaaagacttccgctgctctccaagactcggcacgctagctagctcttcgttccccctcgtttgctctgtacgaggcagcagctgaggtgagcgtcacatgccgctgaactcttctttttctcggtcatatggactcatgatgcggaagaccaacacgcgccgcacaaaaacagaagcgacgacgcatcacgcatactcctatagcctaggaaaacatggtccctttgttgttaggcctaacatgggtgctagtagtaagattttacgggagacggcgtgttttagcatgggtgcagcaactgtgcaagtcctaatcaccagtttgtgcttgtgcactcgactttttttgctgatgaccacgtctacgagagtccgggctatagctgtaatcagggagcgaaacggggaaagtgaaaggaaaaggggggcgaaaagagattcgccccacgcgcaggcaggcagcagctgcattgttgctgttggttgggaaannnnnnnnnnnnnnnnnnnnnnnnnnnnnnnnnnnnnnnnnnnnnnnnnnnnnnn

SEQ ID NO: 30389 - DNA, 484 bp, Oryza sativa
  unsure (1)..(484): unsure at all n locations
gcgaattcgagctcggtaccccgtcgtctttcccgccccttccccatccacaggctttgcgcgcctcgcccacgagcatgcattcaagtgcgatgcgctcgcgcaccccacctgatggagccatggagatcgccgaagtctgtgatgactgtgcttgtgcgcgtgcaatggaagttcaccagcaagaggaatatgtagtggcggggaggaggagaccgtgtcggcgacggagagggaaagggaaggcgtgcgcaggaacgggaccctgtcgttaccaactccctcctcaagctctaccgctcgccggagagggggatgaagtcaggaacggaaatgaggaaggagggaggggatgaggacggcaacggagacggcgtgagagaggagacgcaaaaagggacgggagtggcatagttttaattatagaaatnnnnnnnnnnnnnnnnnnnnnnnnnnnnnnnnnnnnnnnnnnnnnnnnnnnnnn

SEQ ID NO: 30390 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnntgcacttccccttccttatcatcattactagccttttttcttgccttgcccttatccaaatgtcccaacaatctattgcacttccccttggcacgcacatcgttaggtgggtgaatgtcaatttgcgtaggaatgctacaaccaagaaattcctcgatctcgctaactctagtcctttgagtggctggcaccatctgtcttacttgttttgcaatgtcaagtacaccatttttcaagagttgcatgctatcaatggactgcttagctagatggattgtttcttccattgtgttgaatacatcaaacactaattttttcatcatagggtcagttgaggtgctctcactttcttccaacaaggtaccctcactatcaaacacaggttcctttttgcacatctttgtccaccttctgaggactaaatgttctggaagttgatttagcctagcacttctaaggacaagaatcacatggcggcaaggaattccaagagattcaaataacatacaagtgcatgaaatatccttggttgatgtgttgtataagacctttctttcccttagtgaactatcacttaccggagtgattttcacatccccctcgatttcgatgttctcaactatgcattttttcataacagctacaacctttttctgaaaaggtcaaatattttatgggtgaacac

SEQ ID NO: 30391 - DNA, 3676 bp, Oryza sativa
  unsure (1)..(3676): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaccagaaccagctcatttttcagtctcccttgttcctgaactcagtgagaggcctctttactactgtatattgaccatcaggcagggggatccttacatgatagaattatacactcctaaaaagattgtatatcagttttttttgcgggggaaatggggattatattactcagctaaagagtcctcacaaacaaaatgtgcgatgaaattacatttatcatccgggcagaactcagtcagagattcacaccgggctctattagctagagtatggctaacattattctgattccgctgaatcttcacgatgatcacttccctgtttcctgataacaattcaccaatgcccctgacgatgaatgtaagctcagagcgcccttgcacagctgactctatgaggttcttcaccaccaagcagtctgtctccactatgaatggaaggagagtccactgaagagccaagctaataccttccctgcaggcaagaagctctgcttccaacgggctgctacactgattaacaaaaccacaagcagagaaaattaccatccccatactgttccttagaacgacaccgatgccccatttttcagaatttatatcaatagaaccatctacattcagtttcatccagccctgttttagcttcacccatcgacaattattattcaaagggttttgcttgggtttttggatctttcgctcctcatgatacagagcctgcttccctgtaaccaaatctgcttggggattattcttcacttgttcaagcgagttaacatagctttgtaggaacgtttttgacacctcaattggggtttaccttgtactagtaaacaacaacaaatcctcctccaagttcactactttcagtgaagttctgtgtgctgcaattccaagtgagtcgatactatcgatatgttgttggtgtgaatagctccactggtagtagggttgtcaacgagccgagctcaagtgaactcgcctgcctaggctcgagctcgatacaagctcgagccgagcctataaaatgttcgagctttcaaacaagctcagttcgagtgcgatctagctcgatctcgactactaagcttgatttttaagtagaacaaggtatatttcaaggataaccttttaaaaataattaatttctagttcatcatattaatagaagaagaaaaaagaataaataaatatacaagaccaatacaagacatacaaataatatatttgatatcttaatttattaaataacaacaaaaatcatatattactagactcgttgaaagctcgagctcggctcgaagaagctcgcgagctttgggagaagctcgggctcggctcgtttggagctcgatccgagcttgagcagattgcgagcctcgagcttttttgaatagccctaactggtagcgcattacaagggagaacaatcttatgcgatcaggtctcatgaatgtggggatagacccattagaccaggtctcataggagtaatccatgcgtgtactggtgactatccggcaacagctgtacaatgcatgatagggctggctttgaatgggcggttttgacccatgaatttcactggaatgtctaggatgactattttttcccttttgttaccctatttataactgaatttgctgtttagattacatattgataatgtgtacgattccaatacaaaataaaacagccaataactgttgttgctgctcttctttagcccctactacctggcagataattgtgtgatggtttgagagtagcgagagctcccatcgaaggaaaatgttggcctagctgcaggagccggtatagagctgctagcattgctgttaagcaaaaccatgatgtccgccattgtaggtcgatttacggggttctcctggaggcacaggaggccgatattgatgcatttcagcacctcggcttcagggtaattttttcccaacgaatggtcgatcatctttgcaactgttccatctgaccagcgcctccacacctaccattggttacaggcatatctcttcagttttcagcggcaccaacatgtatttgtggctacctgcaaacgcaaatagtaccacatagtgctgtatgagctagcagggatactcactgtgcttattatatcttcgttttgttcaaacaaatagggtctgttgttcctctggcctgtcacaatctctatgatgagaacaccaaagctgaacacatcagattttgtcgagtattgtccacgcatgacgtattcgggagacatgtagccactgcttgcaacaacaaatagaatcacatgattagtttgttagctacatataagaacaaatatgtaaagtattggacttaattacaatgtcccgacgatacggttggtgacatctcgagtctgatcctgtccaaagagcctagcgaggccaaaatcaccgatcttagggttcatgtctgtgtctagcaagatgttgcttgccttcatgtcacggtggacaattttctttcgggagtcctggtgaagatactgtagtccgcgagctacgccttctatgattttgaatcgtgtcacccagtctagccctctccttttctctggatctaattaattgacaccagatgaaaaactcattgttataatgtcataccgatgcacatgagaagggtgtatatctagattcagagttaggttgttaatggtaccaaaaagaaagaagtcgaggcttttattgggcatgtattcataaacaagcatcctctctccctcttccaggcaaaaccccacaaggcgaacaaggtttctgtgatgaagtttggccactagaactagctcgttttttagctcttctagcccctggcttgaacccttcgccaacctcttcacggctacttcttgtccagaaagaagtccctaaatgcattgatttagtaattaattaatatcttactttttgcatgatagtaagaacacaaagatactatcttttttcttgagcccataaatgtataagtcctataccctattttggcactcaaaatttccacgttaatcgcagaaatagtaaacggatcaatccaagaatgaaagcgtaattcatatgaagtaaaacttgttaataactcatgatgacttactccatctccttaacaagtttagtaaccagcataataaccctattgctcctacagagagaaaaacataagtggtatgtcacaccccgaagttttcctcccaagccaaaattgtaatttttataaatgaccctaagaaaataccggtgcaaatcaggagtaaaccctaaggaaataatgcaaataataatcggatttgacatgtggaatttttcttgagttctacgtgtcgaaattcattaacatgatttttagtggaattttcagagctctagaaataattttaaccaattaaaattgagcaagcaatattttaattccagggaaaatcctttttcctttttctttttctttttcctctctttttcctccttttttcg

SEQ ID NO: 30392 - DNA, 2287 bp, Oryza sativa
cccgaagctcgtccgcccgccgacgtcgtcctcccgtggcttgccgtcgttgttcgccatcgtcttcctccgcgccggccaccctcggtgaggaatccctcccctttttttttccccttcctctcctcctagtgccgcgccgccgcttcaagttgcgcgccgtcgccttcggccgccgccgccgcctcccgtgccgccggacgccgccgtcgtcggccgcgtgccgtcgccgctaggcctggccggcaggtcggctttgatgccgagccgagccggcggccgcctttatcgtcgcccgttccctccccttcctagccgccgcttagcgcagccgccttcgcgtcgccgtttgcgccgtcgccttcgccgccggttgccgtcgccggcaacgcgttcgcgcgcgcgccgtcgccgtcgccgcggccggtcgggcggccttgagccaagccgagccgggtgcccgcgcccctttcctctcgagccgctgaccggtgggcccgcgtgccggcgcctttccccccctctcccgagccgctgaccagtgggcccgcgtgccggcgcccttcctccctctcccgagccgttgaccggtgggccccgcatgtcggcgccgcttcccctgtgctgacgtcagccctggaatatattgcgcaataattgatttaaggtttttcttgtatagtaataaacacagtgaatcttctaaaattcataactaattcatccgagctccgtttaagcccattcaagtctcagtaaatcaagaaaaatgtgtagaatccattaaaattggttttgttccctgtttcagtagtcttatagcttgtttgcaatgtttactttgtatgtcgctagattccaattcctccgacgctccggtgtacttcgagatagtcgccgaggttcctccagcagcagagcaaggcaagtcatgcttgtcacttgaacatgttgatcctatattgcaaatgttctattgttttctttcaaatattgcattgttttataatattaaatatgggatggttacctatcgttacggccatgttttttttttttgaataccatgctcccttgttagcttggggtataacatgattagagtttggactaggaattgcttagacatgcttagttcaactagttcacaatggggaaaagcataataatgtttagactgttggttccaatggttctgttggattagtgccaccgctttggcgtgggttaattaaaataaactacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtggcccgctggggacgggggtgaaacctgaggtgtggtgtgcttggctagagaggggttatgcgaagggtcctgtcacggcctctttccgatatgtcgtggtggcatgtcggcgcacgaaaacgtgtcgtggggctgtgtcttgtgggtacaattgtacacctctgatcagagcaaaactattcgaatagccgtgcccgcggttacgggcggtcaaccagattcaccgtgattagtctcaccttagtgtaaccttttgaatttggataatttaggtggatggttgggcctgtcgcaacgtgggttagcgttggacagtggatgtttaattaataattacaactgtttaaatctttcaatttctgtttataaatgctcgctttatgcaaatgaaccactttagctcttctttgatattttccgtgcatcatacccctattccggtatgacttgctgagtacagtgggtagtactcagtcttgctctacttttcccaacccccagagttcgagttcgggtcagatgaaggtttctccgaggagtaggctttgtccgtgccgtcgaggatgcctgtggagtggtgttcctgctgcagtttagtcaaggcttagctcttgttgtctttttttttcttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacatggtacaactaaaaatta

SEQ ID NO: 30393 - DNA, 6752 bp, Oryza sativa
ctttcaatttctgttcataaatgctcgctttatgcaaatgaaccactttagctattctttgatattttccgtgcatcatacccctattccggtatgacttgctgagtacagtgggtagtactcagtcttgctctacttttcccaacccccagagttcgagttcgggtcagatgaaggtttctccgaggagtaggctttgtccgtgccgtcgaggatgcctgtggagtggtgttcctgctgcagtttagtcaaggcttagctcttgttgtctttttttttcttccgctgcatttatgtaagacttttatgatgtttgtaagacgtggatctgaatgtcaacattgtcgtttgtgtaccccggctggtcctggacggggattttaatgcacattctgcttggaattctattcgggaatttctgggcgtgacatggtacaactaaaaattaaattcgtacaattagtgggaactttccaaattcgtacaactcaataatgaaaaaaaaagatctagccatccaattagtgggaacaactcatgttggtttagattaaaagaataatccatatgtggcacaacgtgttaattattagtggtacatttatttattttagagaagggtattttttttacctgcctctacatccaatcgaatatatacggccattgaaatagggaacttagctccgcaaacaacccaatctgaaattcgctcttatgaagatttgaacttaggaccttggggtactgctcaggtcattgtaatcattagtggcacatttatgatttttgatctattgaacacctgttgccccgatggagagaagaacctcttaccgatttcgggaaacttctaaatgaatgggatctaagtcaacaacaaacaatatataaaaaagactccaactcaaggacaactatgtattcattaattttgaattcaaattcatttattcataaaaaagtaacattagggctcatacttaatataacaaggaaatcttgaattgtgttgaatcaacaaaaaaaaaggttcgtatataatgtggaaatcaagatatagaattcaggcacatatttagttttaatgggaaaattgcatatctgccacatagttaaagtgcctcctctcttttgcctcaaagttgatagtctatgctaaacgtttttgagccatgtggcattttagcaaaagccactcaactttgtgggaaaatagaggaaatacttcaactatgtggaaaatgattaatttatctttttaattactatttttgtaactaataaaaaattgaaatgatttactttttaaaaaatatctaatgtgtaatattcatattatattgtatatacgtgatagttattaattatttttaatatcgaacattagttatttctaaatggtattcctatattgactctatactcaccttccaatattctttattttctaattctaaatttctattatatttcttatttttaaattcaaaatttcatttatttctaaattatactcctatatgtactctagactcctcttccaatattttttatttttaattccgaatttccattatttgtaaattatttatatatagactctaggctcttttttaaatattcctttttttccaattttgaattttcattatttctaattgtattatttaggactctaaactcatatttctatactataattaattataaattcctacatgtactctgtactcttcttataatatttcatattttaactcctaatttatattatttataaattatatttctatatgcactctagacttatctttcaatatttcttttttaaaaaaaatcctgaatttcagttatttttaaattgtatttctatatggactctatattcttcttctaatattccttattttttaatttctaattttcattatttctaaattatatttctatatcgactctaacctctacttttaatttttttattttttaattctgaattttcattagttctattgtataccggtatgcactatagtcttctcttcctatattccttatttttaatttcgaattttagatatttttaaattataattctatatggactatttatttatttttttccgattaattttataacatgagagcgaacgtggaggcttctttttctagtcctttaataagtcaataagttaatagttgtttaagacaaaaaatagagccaataattacataatagaaagtttatttttgtatgagtatgtacataaatataagtttatatttattaacatgtattgttcaataaaattttacaaaaatattagtgacgaaaagtaaaagatgcatctaaaatcgctaatgcatgggttgccgagtaattagctgaatttcttaaagcctaagatactatattgtaaattagcaatttcgcactaatatgcatgtcactcgtatttctaagcctaaggcttactcatcacaccataaaatcatgaacttattatttctcaaaataaagtatcaaccattcaaaaaagtttctaatataagtagctcttatgtagacattaaagactacaataccttataaactgcaccaaatcccccctcaccaagttttttgttttcgtcaaagttatccgttgccacttgtagtgatgacagagacagcaaggttgacttgatactttcgaagtcctcagccgtatcagctggcaattttgcatagaaatgttaatgtgttataaatattgatgatgaagaattctaattggaatttgttaagagtttatgccaaattgttcggatgacatacgtgcggataaattctctgctcttcgccatcttcgtttcttacgtatattccacatacagatggaaattgcggcaacggaggaaatggccactagtggcaaaataattaccagaatttgggtccctggcttatttctacctgcaattttactggaaaaaaaaagtgataatatcatgggtgacctgtatgagttcatgcatgattgcagtgctagctatttctcagtgaacaaaagggagtacctttcttttcggggagcagtaaacaaattaaagggagtgcttattcgtctgctaattaaaaatattaagatgggaaaagaaaataccgccaaatgcaatataatatttgctaaccccttcggtccaaatatttgtgatatttccaaattgtttttcctcaatttttttttctcaaaagtttatgcccctggctcaataggttgaaccagagaggagagagctcaggtggtgacgcgtgacctcgccagcagagcaggaggggtgactattccgggcgctgctgccttccccaactaggccgcaccgccgaaccgcctcttctggctgtgccacattgcctcttgctgccggctgtgctacccgcctttctcttccctagcgctgccatcgcgaggccggcagtgtacgtcgtcctcgcccccggccaccgggagatgaacacgtcagcgggccaggagggtgcgccactttgggatttctccgagggcgccatcaaggcacgtgtcatcgagctcgtggtggtagagccggcacggtcagggaaggcggcagagaacgaggtgggttgcaccagcgcgattggggaaggcggtcgcacggatggcgggggaggcggcacaagtgcacctgaggttgggggaaggcagcggtgcaggtgtggtctcccctcccttcgtctttctctcctcttgcttggcttgacagctagggtttggccggggtaggcggcacgtttggcggggaggagatctcggcggggagaggcggcacagttggtgggagaggaggcacggtgggggaatggggagaggcggcgtggtggaatagtggtggtgggccacgccggtgtcgccgcctcttctcctcttgcactcacgcttgcctgctcgattagacgagagagatcgagaagaaaccaggtccgatttaaccagttgacccaggggcataaacgtccgacaaaaattataattgaggcaaattaatttcgaaataaaaaaaccacgaaaatggcattgcagcaaatgcccgcggattgagagtggcgtttgattgaatcacattttgacattggcattctagcgaagccagtttttatgggtgaaagatatgtaaatttcttcagttccaaggggccatatcttacaacctttttaacttgtggtcaccggatctgacggtcatgaactccggggaggtcgacgaacggcggagaacgaagagaagaagtgcagagcggcatcctctgtctaacgacggagacgagaggccttgaggccgtttccttttttttttcttttcttttctttttctccccattaagcgggtgaagtaaccaagtttctgttttgcttggcgtgtttctactttggtttgataatgtaaaactttctagcattgctccacattcatatagatgatgttaataaatttagacacaaagccttacattatgaaacagagattttttttttctgaaaattaatgcagtcctaatctacagcttaaaaaaaatgtgtccatattaacttggagagttaccttatcgtactgtgttagacttttttacatgatgtttttttcccgatctagctgattgaatttagcaaatcccttaaatttaatattgtgaattttattacaatttatagtattataaactcacacaatatttctatatatgacccttaaaaaactatttttctatgtatgaatagggtaaacttaccctccaaataaaacatcttaggtcctatttaatttggattagattattgttgcggattatctacttaattataagaataaatttaatatattttaaaaatttcgacactagacgatttttcttaaaagctatcatggatatggataccacatagctaatagtagttgactaaactcggtaggtcccatcatataccaagtcttatacggaatcatatctcgtatataaaaggagttccgaataaggaaggacaaaggtaagaaaaaaaaaggaaaaacaagaagaggggcggatggaggaagaagatgaatctgacggatgggccccacgtgtagatggggaggaagatgaaaaatgtgacggtgatggcatgattttaatttcgtaaaatttgaatgacacactcacgaatagacgaattgtaatagcatttttttaatagccatatttgcaatggcatagatcgaattaaccctataaagaaacatgtgttttcaaacgaccacgctcatgcaagagaggatcaatgggaaaagggaacccaattctcatgaattatttttagcatacatggattatgttttagatatttgctagattttagttttattagatttttttttctaaactttcatctaattgaggccctcattggatcaaggactaaattttagttcctgtcacatctgatgtttgacgctaattagaagtattaaacttttactaatgacaaaatccattccataattctagactagtttgcgagacaaatttattaagcataattaatccatgattagcctatgtgatactccctccatctatttttgataggcatatttctaaatataaaaaatttatttttgataggcatatttcaatccaacaacctatcctcttaataactttctcggatttaatgcaggactctccattcttccacacaagattggctacatgggcatcgagaaatgtaaatattaatgtatcgcttgtttacgaggaataactagtagcatgtttaaatgggtgataagtagaattacttatcgttgatctgtatgccaagatgaaatatgactatcaaaagtagatagagggagtactatagtaaacatgtactaattatggattaattaagcttaaaaaatttgtcttgcaaaatagctatcatttatgcaattgtctttatgattagtcttcgtttaatacttctaattagtgtggagtacaatttagtctttgtatccaaacacaacctgaaactgtatattgttaatcttcgatgttgtgcgggctaaatgacagacgtgccaacttgtgcacgcacagcacattttctagtcaaaaccaaaattcaggtgtgtacggggattaagcaaagcacaaaaaatgtgtgtacagaacgaattaaggccacttggggatggaggttggttaggtccacgcaaataattttctcaattcgcgatcacacggctctaatggctgccccacaggccaacatcaaacctagcgtccctgtagtttccggggctcgccgggcgaagaacaaggagtggaggtgcgatttttgacgttcgtttgatggtgagtgcaagccacagtaagacacagcgatcgagcagcaactcaccttctctattattaatattacctgatgctgccggccgcagccccggcggtgagggcggcagccccgatggtgcggacagccctggtggtggtggtgagggcggcagccccgacaactgcaacagcggccggccggagaagaactcgtacgcctcaaaccggaagttgcaccgaacgccgaagaccctgccgccgggcttcccgacgaagtacttgggcatcatcctcctgattatgtccccgaggcagctccggcagtcggcctccgacatgtccggcgtgcactgagccagcgagaaaatattgtggtaaggcgagtcgaaga

SEQ ID NO: 30394 - DNA, 30202 bp, Oryza sativa
  unsure (1)..(30202): unsure at all n locations
ccaggcgacgaacatgccccggttatcggtgacgttggcgaggatgtcctggtcggagtatcggaggatgcaggggtcgttgaacagggtggcgcgcctgttgaacgcgcagagctgctgcgcggtgtcgaaggcggcggcgaggcaggcggcgcaggaggaggcgttggtgtcgccgcggcagagcgcgatggcgtacaccttgtccggcgccgtgccggctgcgccctcggcgaagagggcccgggaagacgacgcgttcgcggggagggcgctggcgagcgcacgcacgttcgcctggtaggcgctcccctccgtgtagttgccggcggtggcgttgcacagctgccacggcagcggctgcgcttccgcgagcggcccgtggaggagcgcgaggagcagggcaactgcggcgaggttgtaccaaaaagtaagatgtagtcgatgaccggccatggtggtactccccgagcctcgagcagaggtgagaggttgcgctcgccgaccggatggtataggacgaaaacggagcggatatggacgcacaatactcatactactcctagtctaaaagagtgcagcgggctaaggagttgactggctagaattttaggttggctcaagactgtgacataggctgtgttgtatgaagcattaaatgtagatgaaaaaaaatcaattgtacagtttgtatgtaaattacgagacgaatcttttgaggctaattacgccatgatttgataatgtggtgctacagtaaacatttgctaatgacagattaattaggcttaataaattcatctcgcaatttacagacaaaatatgtaatttgttttgttattagtctatgtttaatacttcaaatgtgcatccgtatacgttaaaaaaattttggaggaggaactagacacgaccataatctccatccatgactacaagagattataccttttcttttaagaattaataaggaaatagtacaaagacatgtgatgagataaaaggtgatgtgtgaaagaatacagtattataaaagtgtaggtgggagaataaattagtataaaagtagatggtagagaaataaactagtataaaagttggtagatgccagatggggaatacaggccatgtttggggagtttcaagtgccgcagcttctcccagaataagaagctccctcaaacagtccagcttttagtccagattctgagaagctgtagttgtagaatacataaaataaattagaaggaactagaagccagaagctgagaaacccagcttttgcagattctcagaagttggctaccaaccagctgcttctcagaatcttaaacttctctaaacaggtccatagtactgtcttagatcgtgaaactcctttatattttaggataaatttaatggtgaaaatcccttatattcacggcagagggagtggctgtgttcggcagcactacatcgtaataactgaatcaacaatagaaacactgttgagccgcagtatctagcttccgaacagaggccgtatttagttaccttcgaacttcaaaaaattctgtcacatcaaatatttagacacatatatgaagcattaaatgtgaacgaaaaaaaccaaatgcacagtttgtatataaattgcgagacgaaacttttgagcctaattacgccaatttaacaatgtggtgctacagtaaatatttgctaatgatggattaattagacttaataaattcatctcgcagtttacaggtgaaatacgtaatttattttgttattattctatgtttaatactttaaatgtgcgtccatatacataaaaaaaattttgaggggaactaaacacggccagagcctatatagcttagcttgagtgtttagatctctttccgtgttcttttgccttcgagtatctaaaaatccagtgcgtggattaatttcaatcaatattaaccattggttcttcgctatggaccagtttttctcctcccataggtcgtcggtcagttcatattttcagcagggttgacgtagtcagctgcccgtaatgctcaggataggggcccgattggatgaataaaaatcggacgtgtccggttctgcatgcatgcaagtatatcacaagttagttttttttcctcctttttctctctttaaatacctatttctcctaaattatttattcaatctacaatccaatcataccattgtattcattgtattcgttgtaattaaatctttaaagcatgaaatcgcatgactatattttggcgaaagaaaaatatatgtttcaatctgttaacacttgttgtttcatacatagtactgatatgattcaacgtgtatctttaccatgttttacaaaatttttaaatgtttcagttgttgattttttttatttcaccatataaattaatgttttacttgttggtcaactgcaacatttgactgccccatttttttaggaatcggatgaccgatccatagtttccttcttcaaacaattttttcttctaattataaacttccaatcggacgcccgatcttatctcaaaaaattagacagtcaaatgtttcagttaaccaccggtgaaacattaagttatacatggtaaaacaaacaaaataaatcatcgaaacatttaaaaagtgtgtgaaacagattgaaaacacacgttgaaacatatcgttgtcgtgtatgaaacatcatgtgttagtagattgaaacatatatttttctttcattaaaacataatcatgtgatatcttattttaaaaatttaattacaacaaatataatggtgtgattggatcgtagatcggataagtagtttagggaaaaaatcattttggagctcactaaatacatatatgcatgcatgcatgcaaggagtggagaaagagtatgtgtaagtagttaaataaattttgtgaaacacagtgaaaacagatgatgaaacatgtcgttatcacgtatgaaacattaagttttaatggtttgaaatatatatattttttcttttattgaatataatcatgagatatcttgtcgtaaaaattgaattataacaaaaataacggtacctgtgatcgaattgaaatcaaataaatagttcagaagaaaaaaacatttaaagtgaggaaaagaaagaagggaaactatcttagcacttatctgtatatatgtgacagtaagaagagagggcccgatttttctctccaaagcattttccatacggtacgccacctacgaagaacaatggagaccaggctcataagtcaccacgtaacgagtcaatagctgatctcaagggtagacattttgtattatctcatctcatatatcatatccatttacactagtagacttaatggtgtataaacgattttattagtgagaactactatagaccgttgtttagtgcgtctcacaaccgcccatccatccctccccctccacactgtcgacggctgttaagtaccaaattcacgccgtcaatatatgtataaaatggaaagcataaaacatccaacatagtgatagggtatatttctaacaatttccacgagtgttgatgtatatttggacataggtgacaaactaccaaagttgagagaaaatatacgtgaagaaggaggagaatcaaactcatatccaaacttatggagtcttgcacccaaaaaaccaattaaacaccttcaaatggtcccatctaccatggcaatatggattgagggtcctaaaatgaatgtctaggccgaaaaccggggccaatgaagctggctagggctcggccgaaccctgacagaggccattggcctaggcccaagttcagttcggcagataatgatctctcaatgacggttgtgactgtttccgtcactctaaccatcagtagaagggaaacttggcactaggaggatgaagatactcattggatgcttggaagaaactctatcctcccaaggcacttccaccatatacatacacttctcctccctcattctcacacacaccaaagtatgagctgaattataagaggttctattgtactttattgtatactaaaagtagggagagagtagagtagaagaagtcggaggaattccagagttgttggtaatcctctctcatttcctatactttgttaattactctgctttagtagaattatcattctgagtaactaagatttgagtaaattacactagcggtccttaaacttgtaacgaagtttcacttaggttcacaaacttgcaaaacatgcatcgagatccttaaacttagtttaatgtatcatcccggtccaaagcctggtttgaccggggtcttacctatgtggcatgccacgtggacgatgacatggctaaattttctttttttcctttttttctccccatcttttctctccttccttacctcgcgtggtggacgaggtttccggcaatgatcagcgtgcgtgctcaggcgccggctagaggagaggagtggcgcgtgttcgcgggcagcagacggcgaggagaggggcggcacgcatgctcgggcgccggccggtgggaggagaagagcagtgcgcgtgcgcgggcggcggccggcgaggagaggagcggcgcgcgagtgcgggcgctggctggcgggaggagaggagtcgtgggcggaggccgaaaggggaggagagggagaggcggccgccgcctgcgggtcctctcctcctgctgcggcgacatgcaacttctccctctacttcctctccctctgccgcccaagatgacgactatggtgaggagcgggtggcgcggccttgcaaccggcaccggagggggcgaagaggggggcagcgcacttcgttgggcggcggcgtgtcattcatgcggaagcgcccgaggcacgcgcggggggagatatcgccggccgcgcctagggaaggggtcgctgaccgccgccgcgcgtgtaggggaaggcgtcggtgagctcaacgcgagcggggagagtgcgagctcattggcggcagcgagcttgatggcaacaatggggcggcaaggcccgacaatgagctccacaaaagagaaggcgagctcgtcgaacttgagcagctgccgcagccgtttgccgcacgcgcctgcggccggccggagcggggcccttccccttcctctcctccttctccttcctatcgatgacgtcgctgccaccgtcggcctccgcgccccctcgccagccttgccggggcagaagggagaggaaggaggcaaagtggagaaaaaaagggagaagaagggagaaaaaataaaaaaattccatgtcatcgttcacgtagcatgccacgtaggcaacaccacggtcaaacgatgctttggaccaggatgatacattaaaccaagtttagggatctcgatatgcgttttgcaagttcgtgaacttaagtgaaacctcgttacatgcaagtttaaggaccgctagtgtaatttactcttaagatttgctcgttgagaattaactcttgattagtttctaattagcgtgcgggatcatttttcactatagttcagtaaaatatagtgattgctttagtgtttggccggcattagagtagttgttaattacgtagacgcgttgtctacataattaattttcagcgattgcttcgtatcccataattggtttgaggtgggtgtagaggtggtgacagctctcaattatattaaagtcttccctttatactattccctttacataatacactaaatgttcacaacattagattctgaaaaatatctgccacaatgttgttgttttaaagttgtaattgaatatactctaagtgaagaactggagtttttgcgatgaaggtcaatacattgggtgtaatgccaaatatataaatactcctgacaaatctatgcctgaattaagttgaatgagttatggtgattgactctaaaagtttatacaaattaaaaattaagttgaatgaattacgaataatgtctatggggtgattgaatccaaaagtctatacaattcaataagtttatgagtatataaaattattattaaaccaaatatacacaaatcctttattgtgcgcacaaatacaggtatatctttgtttggatattcggtttttgaaatattttatatttatattgtcaaaatatataatcatgtattgatggtttgatttacattaattatgaaaaatgtacagttgcattagcacgggcatattactagttgtagtagaatgtattttttttctttttcagtgtaattttgttataattgacgttaaataatttaggtatgatgttttctccggtgctggcatgttgctagagatttgacattttcttagcattatgttgtttttagtgtttgacagcctatgacatgcttaatttgatctgagcaatacgtttccaacctgttgcttataaaatccgagtgattttctagaaaaaaaaatctaccgactaatatatagatagttcctaccgttttaacaattctatttacaggcttacagccataatgcaggattcaggggtcagggcctccccatgcatcaatccaatatctagaagcactgtacacttaactggtttggcgactgaactaagaattcaggattcatctcggcacaagatctgtgattgacatatcattcgaagacaccgctgttgaatgcggattagagctgtcactggcactaacatcctggatgcagaaagccggcctggatagagaagggagacgaacagtgttgctgctaagcatgatgtttactgacgaaatcgtcggcctgcttgcaggtcttttctgaacacacaacagcccgatgtggatgcacttcaacatctgctcgatcggaggatggttgcccaaggatggatcaatcaactctacaacatttcccctggtccagtgcccccacacctgcaccaaattggttcatttattcaagtagtatgttgagaagtttgattaattattcatgaacagacttaaagtactcacatggtttaagagatcaagatcttgcccgctatcatatgagccactatttcttcttccagtgacgatctctagtaccaaaacgccgaaactaaatacgtccaacttgactgaataatgaccatgcatggcgtattcaggcgccatgtatccactgtaaaaaaacattacattgtaacctattatatttggtataccatatttgataaatgttggccatgatcatgttaaaattcaaacctaacatatcatacttactacttactatgttccggcaattcgatgagtgatatcttttgattgatccccatcaaatatcttcgccaagccaaaatcagaaatcttagggttgtaatcaaagtctaatagaatgttgcttgctttgaggtctcggtgcactatcttcaatcgagaatcttcgtgaaggtattgcaagccttgagcaattccatttataatcttgaaccttttgccccaatctagctctatgtttttgtctatatctgtcattcaaacaagaaaaaaacatactattaataattgatgttgtcaattaagccttttaaaagaaactactcattagttttatagttntatattacaagtcgttttaactttttctctactcaaatttctttagctttgatcaagtgtataaaatttagtaacatcgacaacaccaaattagtttcattacttgtagcattgaatacattttgttaatatgtttgttttgggtcaaaaatatcgttatattatctacaaattttatcaaactaaaaaatgattagtaaaaaagttaaagtgtaagaaacacatggagtactggagagaaaatcgtaccgaaaagaatggtatcaaggcttttatttgacatatattcatagacaagtattttctcttgctgttccaagcaaacaccaataagccttacaagattcttgtggtaaagcttagcaactaaaactagctcacttttaagctcttctattccttgtccggaactctgacaaagtcttttcacagctacttcttgaccttcaggcaggactccctatccatgtaaacatacttactgatcaacaaaaatataaccgactgataaagttgcatgtcgctgtatgatttgtaccttgtaaaccataccgaaccctcctctgccgatcattttagtttcagcaaaatcatctgtagcagctcgtagtgttgatagatcgagtagaagcgaatcaatactttgaatatcgtctgaaccaattgatgttgtttggacaaagatgaaaagaaagactaagcttaacaagaaatatgatttcacttattcaagaaaaaaaagagagagaaagaagggaaatgtgatttcactacaagctgggacacattaagaatcaaggtgatgaaattaaataaaaataacatttaaacaaatcaccatttccctgccgtctataaacttatcaattacttggcatgctaacatatcataaatttagctgacttacagggcagaaacgtctgttcttctggtcgtctcctcctccaacaacaaaagtatgctacgacgatgagcagcattgcagcaattgtaggcataacaatggctagaactatacctgtcttattcctctttttctctgcaaataaatactgttcgattcagatagtatctctgtagttagaactatgaccagaacctgaatgaaagaaaaccatttgcctacaagtagcatgtgtattttttcagggaattttccacagattctgacaataaaacttgacagaaacgcacaaagagccagattgctaattggcactatatctttttttttagaaaaaataatactccatccatttcggattataacttataagttgttttgactgaaatcactttacgtttaactaagtttatagataaatatagtaatatttagaacaccaaattagtttcattaaattaatattgaatattttgataatatatttgtcttgggttataaaatattactagttttttttctagaaacttgatcaaacttaacatagtttgactttaatcaaaatcaagaccgacttatactctaaagtggaggagtaactattttgttgacgtacagaaaacaggcaatgtgctcccaaatgatgaaaatgcatctcccatctctaactctacaagcagtcaacggagtcacacaaaacctttttgttcaattatttgcattaatttattcaaatgcgctaaggcgatttcacacatgcaaacaagtaaaaatggtttccatctgtcgctcacctcctcttctggtcgccgccgccgacgtcgctggcggcggcgcctccacgaacgccggaagatgcagcagcgggcggccggagaagaaagggaacacctcgtaccggaggttgcaccacaccccgaacaccccaccttccgtcctcccgccgctgtagagcttgggcagctgcacggtggtcagcgtcgtgaggcaggcccggcagacgtccgccgccttgtccggcgtgcactgcgccagcgcgtacatcctggggcggccgctgtcgccgtcgccgtcgacgcccttcttcttcgacgtgccgtaccgactcgacgtgttcgccgccgcggcgtactccgcggtggcgttggcgagcatggccacggccgcgtcgaacgccgccaccgccgcggcgccggcgcgctcacgagccgggagaagcgctggagcgagtacgtggcgacgtagtagtcgtcgtcgaggagaaagttgcggttggagtagcgaagctggcagaggtcgtggaagacgagcgcgtccttgacgagcgggcacacccgcggcgcgtcgcggagggcggccgcgacgcagcgctcgcaggcgtgggcgtcggcgacgtcgccgcggcagagcgcgtagccgtacaccttgtccgggacgtcgccggcggcgcccgtggcgtacatggccggagacgaggaggtgttcctgggaagggtggcggagagccggttgacgttggcctggaacgtgctgttctccgagtagcggccgctcgcgctgtaggggtcgcacaggtaccacggtggaggttcgtcttcaccggcggcgaggtggacgtggaggaggacggcgaggaggaaggctgcggcgacgccggcgaggtggtgcgccgccgcggccgcgggcattgtgctggcaatggtaaagctgtcacgagaggatcggaggttggcctacctgagagtttgacttgaaaccgctggttcatttaatttctctaatcatgcgagcaatcaaacagtgatgacagaaatattgaatttcgaatcatgcgagcaatcaaacagtgacagaaatatatctagagtcagcgatgagctcccttgctttgaattaatctaaccgtaaaccctaattcaatgattgatcgaagacgaagaaaatgtcgttgccggtagcatattgtcggagtacacatcatagctagcttagatgtcaacctacaatatgaaaaatcaacttaaatccactctaagaatcattctatgtattttagcgatttatagtactgtactgatcctgatatttaacatgtaaaaccattgacttctaaaaatatgtttaaccattcatcttattaaaaatcatgtaattattatttaattttttgtaacttggtttttgttaaacgtattttaagcaccatttacactcttacatatttgtgaaagattgaatagaatgaatggttaaagatatattaaaagttaacgtcgtcaaaacaaccagcgcatgtggtctgtgaatcatactaattaatctctaacggaaacaatccttgaaaaagaaaaaaaaaggacagaaaaaacatttaaattgccttggaaaaactcatctccgaatcgaatgattgccaaaatagctctcaactaaaatcgaccgtccacctagggcatctagtattacttattttctgatcttgaattttgcatagccgccggtcccgccagccatatactccaacgattagttcctggtcatcaaatatttctagtaatcagcgattagtctctgtttttatctccttgattttgacatctctgaagtcctttcagctgctacatcaaaggcaataatttgtcaatggtcatcagatatggttgacatgctctctgtcttttcttttctttcttcttcttctttttttgttttgttttttggctagagattgcccgaccatcttatgcagcagactagcagagtaccacagcctttaaacgccatggatggaagatgacacaagttcttgtttacaacgtttgagcaaatctccacacatgccaaacgattgtctattgctacaatattttgataggataaaatccattgaagctgatatagaaaggagcaaaattcggtttttaataggtgccaaagtaccaaatgatcctctagaaaggacgaaaggagtaatttaatttacacactagcgcatattttcatattaatccatttttttaaaaaaaatactaatacttaattaattctatgctattgggtcactccgtggaattagttcccaactcactccaacgaaaaataagagaaataaataatattataagaaagagtccatgatggacatttcttatttgaaacaggattataaactatcgtgactatataatacaatatgtcatctttagttagtgaaaccatatcattagggataacaagaataagagaaataaatggaccataaagtttatatataaatcaatttattaaaagaaaaaactgtaaaatgattgagtttgactttgaacccatgcctatgcaccgtacttcgcttgataaatgccatggacagggcggaacaggagtagggcagttagagataaagctttactcctaaccctaaatactcattaaaataacactccaaattttgaaaattaaaagaaaaaataacctatgatgattactttaattaagctttagggttgagaaaattttggcttcgcctctggtcctaggcaatagagaatcggatagtgagcttgggagtttattcaatatgttttcaaatttatgtttcctcgtgtttacatatgtgaacaaggggtgcataactttgactataattttcctatactttattagtgacgttgctgactactagaattggccagccggcatctcagtcacacttgcatccgaggatgatttaaacaagaatgaatatttggtagactcaaatagaccctattgaaatgtaatcgacgaaattaccctccttttaagtctcccttcgcagtaacgtaattgtgtctggtcaacgcacaatttcggtcagtaactccctggcccaccaccactcttctttgggggaaaatacgtggtggaaaccttgtagacagtagaaacttagaaactattgttggatcgaaaaatgggcgtccgatattcgtccacgtcatcccgactaaatattttactcacagatttactaatgagtaaaaattttactgcacataataacgtggatgaatcttaaacgtccatttagtccttcaagtttcaccgaaagctcaatttagtctttcaggttttattttgtccacgtagatcctctaagtacttgttttggcttaaaatcatccttgtacccacttaatataccatatggctatttttagtcgataattcttttagaaaatgtcacttttgcccttaatttgtatacatctatacaccggaaaaaaaaccaaaatgaataaatacgtcccattatttcaacatgtgcatataaaacttgagcttaatagctaccgtatacacttgcaagtacataatttatttttttttacatatattgctatgcattatctataaaaagaatttattgcatgcaatttttctcttatatatgtgaatgaggaggtataagtgtcatttatcatgagagttattggttatgtgggtttaaggataagtttgaattaaaataaaaacttgaaggactaatatggacagattgaaacattaagaactaaactgatcattgtatgaaacttgaaggaccactttagctattcaccattttttaatccactgtatttatcgtttccaccacatattttcctcttcttccgagtatttatggcgtacttgcaaagtggcaatacggtggcgtattttccccctcggccaccgaaacctctctctcctcgagctagaccaccatggcgacgacggtggcgacggccatgcgacgccgacgaaatctcactccctgcgacagccgcctcgccaccgcagtccccctgctcgtggcgttcctcctcctcctccacgcgccgccgttcgcggaagcgcagccgctgccgtggcagatgtgcgacaccgccggcggaaactacacggaggggagcacctaccaggccaacgtgcgcgccctcgccagcgctctcccggtgaacgcctcctcatcgcgcgccctcttcgccaagggcgccgccggcgcggcgccggacgtggtgtacgccatcgcgctctgccgcggcgacaccaacgcctcctcctgcgccgcctgcgtcgccaccgccttccaggacgcgcagcagctgtgcgcgttcaacaggcgcgccaccatgttcgacgacccctgtatcctccgctactccgaccaggacatcctcgccaacgccaccgacggccaggggaatttcatcgcctggaactacaacaacgtcagcgcggcgagggcggcggcgttcgacgccgcctccggccggctcgtcaacgccacggccggctacgcggcggcggacccggtcaggcggttcggcacgggggaggtcgggttcgacgacgcgacgtacccgaggatcttctcgctggcgcagtgcacgccggacttgtcggaggccgactgccggagctgcctcggccgcataatcaggtgggtgccccagtatttcgccgggaagcccggcggcagggtcttcggcgtgcggtgcaacttccggttcgagtcgtactcgttcttctccggccggccgctgctgcagttgccggggccgccgccggcgccggcgccgtcgccggccaacatggcgccaccatcaccaccggggaccatgggaggtgagttcagcgtccctttctgggtttgcagttttgcttccattttcttttggcatcagttttgggtgcgtagagattcagtgatatcgcttacaattctcatatttttctttcaagaagagaaaaagtaacttcttaccgtctgagtgaaaatctagacggtttggtgcagcttctagtaatagcagcttctagaagaatctctgactctcataacctccccaaacatgcccttaaaaaatcaatcagtggtaacttgtttcaaactattcaatgatccctattataagacctaaacattttctttgaaatattttaacacggaaatttgaatggtgtgacaaaatagttatttgcactttgcagtagtccatgaccataactccttccatgttgaagttctcatttcagatactagtcaatactataacccatgtattcacatgcatttgacttaattttattaatacctccaattttaaaatttgtacttacaaaattatatgctgctatatggatgagtaaatatgaagttgtacttgtcttgtattctaaatttagtagtatgttgcagaaaaataaaagcaagttgtaactactcttttaatccaagtcattataattcgtttccacctagatgatatccagattgtttttacatttcctctaatcaacgtgagaaattacttaatactcacatgcatgatttgtctgcaggaagaacaagacatagaacaggacgtgtcttggccattactctgcctattgctggagcaatattagcactcattgtcctgacatgcttttgtttttggagaaggagaacacctgcaaggaaggcctcaccagtgccatgtaagttgtccttcttcaggatattttatctataatctaattaaagcatcacaagtaaggttcgtcctagaacgttttttttttcgaatccaatgagaattgaagtgtttttttcagttaaaattcttaggttttattacttagtccggttagcctggaatgtcctctactaggtaaaacctttttttaaggaaatcttaatagatcaaactaattatttcatttcttgaagttcattatctactaattaaacatcccacggcattcagtttaactaagggtgtatttagttcacgccaaaattgaaagtttgatttaaattgaaacgatgtgacggaaaagttgaaagtttatgtgtgtaggaaagttttgatgtgatggaaaagtgaaagtttgaagaaaaaatttggaactaaactcggcctaaattcattgcaaatctttgaataaaaaactaaatttatcgcaaagcgggctaattagtttcaatatatatgagtcgttgtgcacctgttatcttgcaacagactcaacaaacccagatgacattcagagcatcgactcgctccttctggacctatcaacgctacgggctgcaacagacaacttcgctgaaagaaataagcttggcgaaggagggttcggtatcgtttacaaggtataccaatcaaattgtactatccaaccgtacctgcacgtgtgctcatctttttactagcttattaagtcatgcatttacgcgaccataatatcccttagtgaagcatattaatattatttatagtaaccaactaaaataagtgtttgtagaacatactttgcaagaaacgtagttataacaataacatgtatattctgatttgtaatgtggccggttcacgtgtccgattataaactatgtactttatctgtccacaaatataattgatcctatgtacttcatctatccactttaacattgaggtggaattatttggtgttccaaaatcacacctatcgtttggaaattccatatttttgtagactgactgcgtagatgagaagtacaattttccaaatgacatccatgaatagagatgtgtacgtaaaatttagtggtgtccaattactttccattgataaagtataagtttcttgttattcgtacttgatgcagagatctaggattttttttattaactagctgggtggcccgcgcaattgcgcggctagcacctaaacaaaatcatatatttttttagtatgattttacttaaaatttattaaatagctatctcattgttttaagactttgaaagaccaaaccttatcatcctcatgtttataattatatagtttttaaaagtcacaccagttactacccctcatgtcttctccttctttattttcttgcttgatataccactatttctattcattcttcttggaacctttaaaaattggattttatagtttttagagtttattgtcacgttgggtttcatttttataatttctagatgtcccgtcaaacgttgccattatactcctctacggcccgtccactgtctcttctctttattgtcattgagattttaaaaatcgaacataattatcgtttgggttcatttttactttctagaagtcctgctaaaccatcagcggctttgccactgtactcctctacggctcgcccgctgcctcccttctttattgtcattgagatttgagattttaaaatcgaacatgattatcattggttttttttactttttagaagttccgaacctttaaaaattggagttgtaattttattttttataatttttagaagtcccatcaaacgatgccactatgcccctctacagcccgtatgctgcctactctttattgtcattatgattctaaaaatcaaacataactattattggaattcatttttttattttctagaagtcctgtcaaccgtcggcggctctgcaactatactcttatacaccctgcccgctgcttctcctttttattgtcactgagattttaaaaatcgaatatgatgatcaatgtgttttttttttactttatagaagtctcgacaaccgccttactcgtttgattcacggcctacctgatgttcctccttttaatcgtcattaggattctatttggtgttttattaacaatttttatatgtcgtatcaaccgcctccactctacttctttataggcatgttacttaatttatctcgtcacgtgttttagatagtcttttatttcaataatctttatttttatcacaaattttagttatttataaattgcattcctaattaaaatctttttttttctaatttcagaattttttaaaaaaaatttagttaataccgtattgtgttctttcgatgtttttattttttattttcaatttcagttgtttgaaaattatatttctacttgaactctcttttagttttctagttttggatattattttatttttttattctaaattttaattaatctcgtattgggtttttatatggattcttctttcaatattgcttatttttaattccgaatttcagctaattttaaattatatttcttcttgaactcttcttttattttcttttgctaatttcggatttatttatatttattccgaattttaattaatctcgtattgggttcttatatggactcttctttttaatattccttatttttaatttcgaatttcagctatttttaaattgtactcctacttggactcttatttccttttctaaatttggattttattttattttatttttatttcgaattttgattaatctcgtattggcttctttcaatattgcttatttttaattccgaattttagctatttttaaattgtatttttacttggactttcctttccttttcttattttggattttattttatttttatttcgaattttgattaatctcatattgggttcttatatggaaacttttttcaatattgcttatttttaattccgaatttcagctatttttaaattgtacttctacttggactctccttttctttttttctttttctctgattaatgtgggaatttctagctcccacagcgaacgtggtgcctcctttcaaagctattttaacaatataatagatagatgttgggatgtttaatatccccttttcacaagggatcaattagtgctattttatctttcaaaagaaaaccatataagaaataaatctcatatacatttatggaccataaaaaacaaatctcatataaattttacacccgtcagtcagtcagctaactcaattaactgggcataggcccaagctcggtgctgtagcatgtggttcaacttttttttctctttttctttatttctttgctctctagtgtctactattcctatctctttgctacattgaaggagcgtcggaaaattctaaaataccctctttcatctaaggctatcatttattttatctattttgtcactttgtgaatctgacggctaatattaatcagatgaatgtggctcatactagttgcattctgaggttcgcttttcactaatagagatttcatgatgaatacatatccataattccattattaatactacatatacatccacttgcacagggagttcttcccgaaggtcgagaaatagctgtaaaaaggctctcacaaagctccagacaggggatagaagagctgaaaactgagctagttttagttgctaaacttcggcacaagaaccttgtgagccttgttggtgtttgcttggaagaaggcgagaaactactggtgtacgagtacctgccaaataagagcctcgacaccattcttttcggtacagttcagttctctcactgccctaacagtttgcgaaaatggaacatttttttttccattacatgaaaaatctgcacgcacaactacactatagattcgaatgctgatttctttgtttgaatggaagattatgagaaaagcaaagatcttgactgggggaagaggctcaatattgtaagcggagtcgctcgaggcttgcaatatctccacgaagactctcaactgagggtagttcatcgagacctcaaagcaagcaacgtgctgctggacttcgatcacaacccaaagatttcagactttgggttagcgaaactgtttgagtgggatcagacgcaagacgtcaccagtcacatcgctggaacatagtaagtactaagtggacctgcaattccatcgcacggtagtatgaaagtataattaacgatcatctccttatttttcagtggatacatggcaccggaatacgccatgcgtgggcagtattcagtcaagtcggacgcgttcagttttggtgttctgatcatagagattgtcacgggaaggagaaacagcagcttctccaactcggagcaatccattgacctcttgagtcttgtgagcatcattaatctctgctcctcatcatcatcaccatgacctgatcaatcacgaaaaccatcttcttaatcgagacatcatcctgaagaatttatcctgattacgcatgtaggtatgggagcactggacaacggggacgatcgaggagctgctggatccggcgataggcagccgtgcagtgaacgttctgctgaagctgatcaacatcgggctgctctgcgtccaggacaacccggcggacaggccggcgatgtcggcggtgaacgtgatgctcagcagcgacacggtctccctccaggccccgtcgaggccaacgttctccattcaggagatggacggcgccgccgacacggatctctacgagtcgggagcgtacccccggagcgcgttccagcccaccggcgacggcaacacgagagcagcggcggcggcgtcgccgaatgagttgtcgctctcggagctggaaccaagatgagcgtttcgaatttggagcgatttgtgcggatgaccgcagggtttttcttcaataacgaaagaatcaacacgtgtggcctctgcacttgtttgtcgataataataaataaatgccctcgttgatggttggttggagctctgcatatagttgcaagattgttttttttaggcgggtcacggggggtaaaatgtccttctgaatatattacgtcaaacgattttacacaagacaaagcttcaaactacgcaagcgcagaaaccctggagaataagagaaaaaaacataggaaagacaaggaagagaaacacgacaggaacacaaccacccccgagggcacttgagccaccctaacaggactaagagagagagggggtgcatgatgtttttcactaacaagatcacaaaaccaaactcctaatctgagctaaagccaattcctaacttgacaacatctactctacactgcccgaaaaaaaaatttactctacacgcaaccttcaagcaccaggaattgagaattgccggaaggccattctcatctatagataaattactccatccatctcgtaatatggcattaacaatagtgcacttgacatattactaaacctatcttgatcctacgacactatctcacgtggctcgatcttttagtgaaggcataactaccccatacaattgctacacagtgttgtctttaagaatctggggcctgggctaaatataaagtgagaccttatatataatgtcgacgatgtgctagagctatgctaaaaatactcacctaactacttgaggtgacgacctggccaaatataagaaaaattttatgcacttattaggaatccttactgcttggaacacacattcacaatgttgttactttaaagagcatctttacggttcagcggtcgataccaaaatcctggccgttggatctggcccgatccaaaagctggtagagtttggtaccgcgaggtaccaattctgtccttggtgcagtacctcgtggagaacagaggtggaagggaaaaaaatgtaatttcgcgtgcaatgaatgggaggaatggacgggaaccctagaattcctcttccgcgtcgccgcctttctcttccgatcagctgccaccatgtcccttttccacgccgccaccgtgttcctcttccgccctgccgctgtcgtgtttctccttcagtgttgcaagatcggcctccgcaccatcagcgacagtggaggcagaggcggatgagccggcgacggagtatgtggttgcggcgaccgagaagccgctccggtggcggcagagtagaggaggactagctggtgccggagtaggccacgggtgaggcgcgatgaaggaggcggcggtgcacacgcgcgtggggaacaaagactgtggcgcgtgtggaaggatagtcatcgaccgagcgcaccctagcttattttctctcccgatcctacccttcccagattcaatggttggatgaatttccgtaccgaccgataccagtaccactcggtacattctgctggacgataaaaaatctctattttaaaagtagagtgaagagattttaaatatgccataacacattagcatagagtgaaacatacgggttttttgaaggccctaatatctagggtccaaacggtcgtttatcttgcacgtctcgagggacgggtcatatacacgtattcggtacaatctctaacatgcggcattccatatacaggtgtaattattctgattgctgtaatcgacatggacggtgtaactataataatatacaggtgggaacaatctttgcagagttacaaccagtatcaaactgagttacattctgcataaccactatgacacttccttttatctattctttattatagacaaacgagtgcagaggccatgacccatgagttgattctttagttattgagaagaagatcatgcagtcatctactcatctgcacaaatcgctccaacaaacactcatcttggctccagctcggtgagcgacacctcattcggcgacgccactgctctcgtcttgctgtcgccggtggaccgaagcgcgctcgagtagagatccgtgtcggcggcgctgtccgtctcctggatgcagaacgttggcctcgacggggcctggatggagaacgtctcgctgctgagcatcacgctcaccgccgacatcgtcggcctgtccgccgggttgtcctggacgcagagcagcccgatgttgatcagcttcagcagatcgtcagctgaacggccgcgcatcgccggatccagcagctcctcgatcgtccccgttgtccagtgctcccagacctgcatgcataatcaggataaatttgtcaggatgattttcaattaagaagatggttttcgtatcatgtttgattgatcaggtctcatggtaatgaggaggagcagagattaatgatgctcacaagactcaagaggtcaatggattgctccgagttggagaagctgctgtttctccttcccgtgacaatctctaggatcataactccgaaactgaacgcgtccgacttgactgaatactgcccacgcatggcgtactccggcgccatgtatccgctgaaaataataggagatgatcttgtaatgaacctgtacctactttcataataccgtgccatggaattgcaggggatatatatatacttactatgttccagcaatgtgactggtgacgtcttgcgtttgatcccactcaaacagtttcgctaacccaaagtccgagatctttgggttgtgatcgaagtccagcagcacgttgcttgctttgaggtcccgatgaactaccctcagttgagaatcttcgtggagatattgcaagcctcgagcgactccgcttacaatcttgagcctcttcccccaatcaagatctttgcttttctcataatcttccattcaaacacaaaggaaatcagcatcaagtcctatagtgtaatggtatgtatgcatgtatctctttcatgtatgaaaaagaggaacgcttcgatttcgcaaaggcagtgaggggattgtaccgaaaagaatggtgtcgaggctcttattcggcatgtattcgtacacaagtagtttctcatctccttccaagcaaacaccaacaaggctcacaaggttcttgtgccgaagttttgcgactaaaactagctcagttttcagttcttctatcccttgtcttgaactttgtgagagccttttcactgctatttcttgaccttcagaaagaactccctgtgtacagatgaatatatgggaaactattctaatccctcgaggggattttcctcgtttgctcaaaaaccatctaaacggttatgaaaaattctggaaaaatttgataacattcatacaacatatatatacaacttcacaaaatcttatccaaactcaactcacacgtcgagatataaaaaagacaaattcagcgtatgaatagtagtgcactgtttatatctaaatttgtctttttgtttctcgatgtgtagattgaatttgaacatgaattttggtggactagtaggtatcattatactctacattgtcaatttttttcagaatttttcacaactatttgcatcgaatttgaaagaaaaaggtatacgaggggatatccccttgagggattataatccactcccatgaatatatagataaacttgttaataatgaacacgaatgtattcactttctaataaaaagatgaacaagggttacatatggtttgatttgtaccttgtaaacggcaccaaaccctccttcgccaagcttatttctgtcagcgaagttgtctgttgcagcccgtagcgttgataggtccagaaggagcgagtcgatgctttgaatatcatccggattagttgagactgtagcaagataacaggtgaacgatgactcatattgcaaagctagcttgctttgcccccgccaaaaaaaaaaaaaaaaaaaaaaagctagcttgctttgcaacgaatttagttaaactaaatgccatcgattgtttaactttagtacactacgaacttcgctaaatgaaataatcaactttgcctaatgagattttctctaaaaaaatgttttatcaagtaaagggccatttccctacctccaagggtaaccagaccaagtaaggccttagatgagcatagggatttaactgaaaagaacacttaaagttctcacaggatttggaaaaagaacacattctaggaactgtattattgcaggttacaagtacaatatcctgaagcaagaggacttacatggcagtgatgaggccttatttgctggtgttctctttctccggaaacaaaagcatgtcaaggcaatgaaggctaatgctgctccagcaataggcagagtaatggccaagatccgtcctgttctatggcttgttcttcctgcaaagtgcaaacaaatcatgcgtataattattaggattcgcttcggtccaagaaaaagtacctcgaggtactagtacctcacggtactaaattgtttccgatcgttggatctagctagccatgataggcattcttaaatctaacgatcggaaacgatttggtattatgaggtaccgatatctcaaggtattttttgttagaccgaagtaaatcttataattattagatagtcttagtaaaatctggctatcatctaggtggaaatgaattataataacttagattataaaaagtagtccatgactccatgtcagttttgttccttaattatttattttgattttcataatcgaattaatgagatactaattaaatttagaatacaagacatgtacaactttaatttactaatccatatggcctccgcatgtacagttttgtaagtaccagttttaaatttgaaagtattaataaaactaaattatttataagtgaaataagcatatataaacaaagtactctgaacacacgggttattggctagtttcaaaatgagaacttcaataaaatgtaaatgtatccatggatggtgttatagtcatggaccacagcaaagtgcaaataactgtttcgtctacaccgtaaaagtttttccttatcttctctcttccacattactatataggtgttgaatatagacgagagatatataaagagaccaaaacatcctaaaacgtaaatggaggaagtacagtaattcaaaaaaagttttttttcctacaatagagatcgttgaattagtttgaaaccagttagtacgactaagattggttatgcttaatgtttctctttctttttaaaagaatgtagtaaacatttttctcggttttacggaagatacaaacacaccgtcacgcacgtcacactgactcacacacccatcagtgtactcctaacacatgttttaagaaacgggaatcagcgagacatctctaacccgatagaattcctattaaaaacgcactcgcatgtacatgatatttgtggggcacaaagatataaacccctgcaactcaaccattgcaccatcggggcttaataaaacgaatcttaaagtagtaattgtgttagatacataaggcatgttcggtagggttctaaatctaatattgagctggagttgtgaagctgagccctacccttgctatctattttgtgaagctaatcacctactatactcttaaaaacattgaggattagtagtgtttggtttggctctaactccatcaaacaatgatcaagtacctgaagcctggtcaaacaaatgcatactataatgcagaacttctaatcgaagtctaagtttcatcttcaattgcccaacaaccttaccccacctatagatggccaaatgggcccgggcacaactaggcctgggcccgagagcagtcaggccaacacgacccgacctacatgacgggctaggccgggcctgcccacgggttgcactaacggctcaataaggcttgggctagcccggaggcacggaagcccactgtattcctctgaataagtctatttgtccttatttctttgggccgtgtcctttatagctgaaataagtctattttgcatcccttatttctttgggctatatcttatatgactaaataagtctatttttcctccccattattggactgtactgtgccgggacagaggccaaagtacgacccaacggttgggccggccatataggctcgacatcagtcaggtcgggccatgcctgggccgagccaaaactccgtgccctgagccaggctgacgggcctgggccttttggccatcaatacccctcctgtggatcatcgcgtttgtgacatcagctgtctctaccgcccccgtagcacagatggccgcctgagccacctacccctgcttcgtagccaaccttgaaaattagtcctcgatcttgaccaatctcaccttcttggcttcttccccaaccttccgctttattagcagttgagtactgtacgttcaagaaaggctgctttcatcttggtcatgatatataactaggtgacaaatatcagaagcaggaccccagcgattacacgagattttccagtagtagttcttccccgcctcaccggagataaacgataataagcaggaattttgccggcgatttgatggtcaattcgttactacttactgtgtgtttagtttcacgctaaaattgaaagtttaaaaaaaaaattgaaagtttatctgtgtaggaaagttaagttttaatgtgatggaaaaattgaaagtttgagaaaaaaagttgggatctaaacaaggactaaatttcaactccaaattattaagtcctaagttggaggcgattccacttaatgtctacccaaaattgatgcgcctcgtgctcagcgattccattatactccctccgtcccaaaataagtacaaccatggttttttgcgcccaactttaaccattcgtcatatttaaaaaaattttgaaaaaaaaaacataagtcacgagtaaagtaccattcatgttttatcatcttataacaacaaaacttctaattataaaaaaatttcaaataaaacgaacgatcaaagttggacgcggaaactcatggttgcacttattctgggacggaggtagtaaaatttagggtgtgtttagttcacgctaaaattagaagtttgattgaaattgaaatgatgtgacggaaaagttggaagtttgtgtgtgtagaaaagttttgatgtgataaaagagttaaaagtttgaataaaaagttaggaactaaaccagtccttaaagcgaaactaggaaaaaaaagagaaaagcagaaagcgacatccgagtatccgacgagcgatcatgtgtggtttctgtttcggcaactcaccttcactggtcaccggtggtgtcatgttagccggcggcggcggcggccccgacagctgcagcagcggccggccggagaagaactcgtacgcctcgaaccggaagttgcaccgtacgccgaacaccctgccgccgggcttcccgacgaagtacttgggcgtcgccttcctgattatgtccccgaggcagctccggcagtcggcctccgacatgtccggcgtgcactgcgccagcgagaagatcctcgggtacgtcgcgtcgtcggacccgacctcccccgtgccgaaccgcctcaccgggtccgccgccgcgtagtccgccgtggcgttgacgagccggccggaggcggcgtcgtacgccgccgccttcgccgcgctgacgttgttgtagttccaggccacgaacctcccgctgttgtcggtgacgttggcgaggatgtccaggtcggagtagcggaggatgcaggggtcgttgaacagggtggcgcgcttgttgaacgcgcagagctgctgcgcggtgtcgaaggcggtggcgacgcaggcggcgcaggaggaggcgttggtgtcgccgcggcagagcgcgatggcgtacaccacgtccggcgccgtgccggcggcgccctcggcgaagagggccggggaagacgacgcgttcccggggagggcgctggcgagcgcgcgcacgttggcctggtaggtgctcccctccgtgtagttgccggcggtggcgttgcacagttgccacggcagcggctgcgctcccgcgcgcggaggcgcgtggaggaacaccgccacgagcagggcgactgcggcgaggttgtagcagagagaaagagagagaggaaggtgttgcccgcgtcgcatggccgtcgccgccaccgccgtcgccatggtggtctagctgctcgaggaaaggtcgcagttgcagaggaaatagaagagcggtggggctagggagttgactaactagaattgtgtgttgactagagagagacacgtgcccgtcagccagcgagactctcttgagagagtagtaaatttttttttaacacagaacaaacacagtgacccacaatgcacgtgcactcgtccatatgaacaaacgcacaacttatttgtaggagcatcttcagaagaccgagataatatatcttaagatttatcacgatcgtctaccactgaaataaaaattagccgtaaatacgagcaccactattaaatttaggagttcctcatgagactctcttaagagagtaatttagtcgacattttgatttgtttattttgagtctcacaaatattaattctttttttaaaagagaaagtattaattctggtttaagatcatcctgggacgaaactgagatgtcacctgaccaattctagtcaacactccattaatgaatataggtctcttgtattgtatcccttgttcattaacgtagcaaaaggaaacaatattttgaaaaactgaataaacctgatccccgttgcccaggtcacacatattattcttcatttctcctttcataattgatgcgaataaggggcaataataactaaccatgattcgcgaggtggcacaagtgaatttagatgtattcgaaaaggataaatttatatattgaaacattggatattaaattgaatctcagatgaaatttgatggactaatggcccgtttggtatggctaatataactctagattttaagtgtagactgtagttgtgaagctgtctaaacttaactctacttattcattttgtgagaccacttcaacttgattcacttctttttttagagttgaaagttgaaaccgtttggttaaactcatgctccaaaagagacggagctagagttgaaggtgtgtcaactaggtcgtaagttgcgcatgaaaaaaaaaaacctcttcaaaatcgcaccaacggctgagctttaacatacctaggccattactcccttcgtcccgaaaaaaagaattaggactggatgtgacatattctagttcaatgaatcttgacatagatatgtccagattcgtagtactaaaatgtgtcacacccaatactagcttggttttttatgggacggagggagtaggcgtcctcacgatttacaaaagcaaaggataactaggaaatccggatttctggaccgggtcaaaatacaaatagctcagtttttataggggagaaaaaatcaaactaaaatttaattgtttgataagaaatttttagattttgtcggtttttattggtttaccaacggcttctgcagaatcacaaaatatcgctcgttaccgagggtggtgaaccctggcgcacggtgataaaaatgaaaaatatacgccaaccagactcgatgaccaatcgttgtcttcgatgtagcatctgaaagggctgcagagatgtcaagatcaaggaggaaaaaacagagactacgaggcttccctgcagtactattgtaattgtattatttgaagatgctcaggagtagatagagtagtttttgtttggcgggactggcggctacgcaagatttaagatttaagatcaattcgaaaaaaaataatactccatctgttctaaaataaatacacactccaatttaaatttgaactaataaggtgtacttattttagaacgaagagagcagcagatgacacactggttgagagatgagctgagcgatattttggcaaattccgaaatgagattttctccaagccacttacctagtctttttaaggcccattttcgttagagattacacttggatcttttttttttgtcatcatgtgttgatcattttcttttccacaaaacttgcttgtttgggagnnnnnnnnnnnnnnnnnnnnnnnnnnnnnnnnnnnnnnnnnnnnnnnnnnnnnnn

SEQ ID NO: 30395 - DNA, 21271 bp, Oryza sativa
  unsure (1)..(21271): unsure at all n locations
tctgttctaaaataaatacacactccaatttaaatttgaactaataaggtgtacttattttagaacgaagagagcagcagatgacacactggttgagagatgagctgagcgatattttggcaaattccgaaatgagattttctccaagccacttacctagtctttttaaggcccattttcgttagagattacacttggatcttttttttttgtcatcatgtgttgatcattttcttttccacaaaacttgcttgtttgtcacggagttgaggggcttatgctctgtaaagttaaaaggctccataaatttgtcgcatcagaaaacattgaatgtctcctcctcatcttttttctctccctttcactctccgcaccttgagaaatttgtatatctgccatctaaaaaaattagattcgctagaataccatcattaaaatagaatttgatcaaatgccactctcaaacgaagggcattcgttataatgccattgctctgtttcttacatttccaaattatatttcctcgatttttttctcgaatgtgtatgcccctggatgaataggtcgaattagatcacatttcatctccctattctcagttctagaaccaagcaagctcgagaggagagtttgcaattgcaaccgcacaacctcaccggtgtcgcccaccacctgctcgctggtagcctcaccgcctcaacccacacatccatggcacattggtccatcgccaagccattcggcgttaccaccgctgtggctctgcacctctctcctcgttgccgccatctctccactaatgccaccgctaggggagcgttgcggttgccgactctgcgaaaaccgaccaaaccaccaccgccaccgccaccgccaccgcccctacacctgcgtctgagtttccccgtcccaccacctccaacaacaacggccttgtcatttcctctaccgcgcgtggcgaagacgaaagaaggaaactaactactagcacaacggcttcaccgagtaagcgctcggctcctgcccgatgaggactcctatgtctctttcctcaaggattgcaccggcaacttcgccgtctctggcctccctttgcctctcaccaaccggctggtgctcgcctatgcggtgtttggggacacggaggcagcgtgccaggtgttcaacgaaatgtcagacaagagcggaatcacctgggcgatcatggtctcggcctactccgatgggtgcttctatcacgacacgttacattggtctcctctcgcgcttactcggttctagaacacacaatggagggatgaaatgtggtctggttcaacctattcatctaggggcataaatgtccgagagaaaataaatttgaggaaaaataatttggaaatgcaagaaacgatgaaaatgatattttagcgaataccccttgcttgagagtggcatttgatctaatcccattttgacgatgatattataacgaaaccaattcttatggatggtctatatgcaaatttctccatgtaggatgtcatgttgtagttctatatatgcgtggggtaatttaaaagctaatactaaaaataaacatcgaagaaactaattaaagtcaaatttaaaattaagttataaaatttaaatattaatagaggttgattttatataaaacaaatgatgtgcctaaaccactttctccggtcaaacactccgtccccacctatcactcgactagtcgaattcccgaacctcctctacactagccgcctcgtgacaacttaccattaccatcgccagcacaatgcgccgccaccgtccctacctcgacggcgtcgccgccgccgccgcaaccttcctcctcgccgtcctcctccacgcgccgctcgccgccggagaggacgagcctccgccatgggtcctgtgcgggccgtaccctcccagcggcaactactcgaagaacggcacgtaccaggtcaacctcgacctcctctccaccaccctccccaagaacacctcctcgtctccggccatgtacgccacgggcaccgtcggcgacgtccccgacaaggtgtacggcctcgcgctgtgccgcggcgacgccaacgcctccgcctgcgagcgctgcgtcgcggccgccctccgcgacgcgccgcggaggtgcccgctcgtcaaggacgtgctcgtcttttacgacctctgccagctccgctactccaaccgcgacttcttcctcgacgatgactacttcgtcaccacctacaccctccagcgctcccgccgcgtgggcgccgcggcggcggcagcgttcgacgcggccgtcgcagtgctcgtcaacgccaccgcggactacgcggcggcggactcgtcgaggcggtacggcacgggggaggaggagggcgtcgacggcgacagcgaccgccccaagatctacgcgctggcgcagtgcacgccggacatgacgcccgaagtctgccggacctgcctctcgacggtgatcgggcaactgcccaaagaattcagcgggaggacgggagggggcatgttcggggtgtggtgcaacttccggtacgaggtgttccctttcttctccggccgcccgctgctccagcttccggcgttcgtggagacgccgccgccgccgccttcgccatcggcgaccagtggaggtgagcaacacaaaccacttttctcttttgggtgtgaaaggcacacagattaattaattgcagataatcttgcaaaaagaccaactatgactctttcgtggaaattcgtggaaattccacggcaaaatatacagtctctaagtgcagttcacactttctgaaattctgaatcggattgtatttatttgcagagaaaacgaaaaataggattggtacagttctagcgatagttatgcctgcaatagctgcaatactgctcatggttgtagcatgcttttgttgctggaagaggatcaagaagagacgaccagaagaacagacgtttctgtcctgtaagtctgctaaaaattatggtatgttagcacagcaagaaatggataagttttgttgaccggcagggaattggtggttgaattgaaaatagtttgcttttatttattttcattatcttgaatcttaatgccaagctgtgtccccggcttctagtgaaatcatatttcccttttttttttttcctgaatgaatgaaaccagacttcttgataagcttaatcttgtttatcatctttgtcccaacagattcagttagttcagacgatattcagagcattgattcgcttatacttgatctaccaacaatacgagttgctacagatgattttgctgatactaaaatgatcggccaaggaggatttggtatggtttacaaggtagaaaatcataccacatgtacctttatcagttatatttttgttggttatatagtaagtatctttacttggatagggagtcctacctgatggccaagaaatagccgtgaagaggctttgccagagttccagacaaggaataggagagctgaaaagtgagctgattttggttgctaagctttaccacaagaatctagtaaggcttattggtgtttgcttggagcagcaagagaaaatacttgtctatgaatatatgccaaatggaagccttgatatcgttcttttcggtacggttttctcactagtagtttttccaaaagaaaaaaaagaacaattatactagtgccaaatgccgccagagttattagttacattacaatgctatggtttttcttgtttgagcctcagataccgacaagaacagggagctagattgggggaaaagattcaagattataaatgggattgctcgaggcttgcaataccttcatgaagattctcaattgaagatagtgcaccgggacctcaaagcaagcaacatcctattggactttgattacagccctaagatttctgattttggcttagcaaagatatttggaggggatcaatcagaagatgtcactaatcgaatcgccggaacatagtaagcatgatcatggtcaacatttatcaaaattaaggtaacaaatataatactaggttgtaatgtaatgttctttgtcgcagtggatacatggcaccagaatacgctatgcgtggtaattattcaatcaaatcggacgtgttcagcttcggcgttttggtattagagattatcaccggaagaagaaacactggctcatatgatagtgggcaagatgttgatctcttaaacctagtgagtacttcaagtttgttcatgaataattaaccaaacttctcaacatatatattacttgaatagatcaaccaatttggtgcaggtgtgggagcactggacaaggggaaacgttgtagagctgattgatccatccatgggcgaccatcctccaatcgagcagatgttgaagtgcatccacatcgggttgttgtgtgttcagaaaaaacctgcaagcaggccgacgatttcgtcagtaaacatcatgcttagcagcaacactgttcgtctcccttctctatccaggccggcgttctgcatccaggaggttagtgccagtgacagctctaatccgtattcagaacgctatccaagaccaagacattccgggtattctgataattcaacagtggtgtcttcgaatgatttgtcaatcacagagcttgtgccgagatgaatcctgaatttttagttcagtcgtgtacaatgcttctagatattacatatgaggttgatgcgtggggatgccctactgcatcacgtcagtatattattatttattgaatccaccattgtggctgtaattagaattaataagatggtatttcttagaaattgaaactgaccggagtggataataaaagtcaggagtgatcacgatgtatggcatgatgaattgtcactgttgtcaattatgctgttattagacctacggagtgatgtggaaagctctgattttttccgttgaactattaaatacattgaaaaacttgtttgcttctaatacattcaaccactgataaactatgagaatgacattttggaccggagttttctgtcgataggtcttgcgagaactgcccgcagcaacggggcacttccgcacttgggctaatagattatgttagaaaatgataggcaaatgatagatgtttaataaccggagatacgactttgaactttttaacgcacaaacctttgaaaaaaaaaaacccaccgacgcacaaccgtcgatgatcactgtgagagggaagtcacactcacacattggtattgtgcttttaaaatgacttagtaacatatccctaagttgtaacaggtcatatccatataaatatcgatagtctataagattgatttgaaataaaatatttaatctagtggttacctacttactctaggtatgcgagcacggtccatgcggtggaaggaggagacaggagtaagacaattccgcttttaagatagtagagaaagttacatactcgtacgttgaacaagtcagatcctatataattaaggatagactggaagctcatatattaacgggctaggcctatttataattaaaaagggacgcgttgcgctcgttgggacatcatgcacacatacctcaagactagttggttgggacggtagtgttttctagacgagcacagctacatgtactaactttttttttacagaactcttaatgatatcaatagtttgatcttaatagatataaattatagacaatctagatgggcttacagcatgacatcgtaatctatctatctatcttctatctattatatactaaaagtccattaaacttcctacaaacgctctcaagccgccacgtggagctcctacaaatactcttaggccgccatgtggcacaatataatctcaccgtcgattttcacttaaattggtggacccattattttataccgttagattagatctttacctgccgttgattttcacttaaattggtggacccgctattttataccaatgaattaaatctacctttctcccgtacatatgtatggtttgccggaaggattagtaactatggttgttagaagttgagattaattagctgtcatattgtgttactactaatcatagctatatttattatatgcacggcaatatatatatataaggaagctaggagattaacaagaagattatacatagcaaattaaattagttagtgtattatacatgatttgtggaaggaggttaacggtaatataacatatacagctaattaaatcagtttgcatggctttaccgtgatattacgtagctaattcgaaccaagccatctccagttaaatcgtccagcttaaataggtgtatctaatattacctttttaagtcattatgatgactttaaaattaaaaaagattttaaaaaacaaaatacatgataattggtttttgacctaaatgatttagaaaaaatagaaaaacaaagtcccctctacctcaccctcaccattagatacgcaaaacactttctgccccctccacttctctctatattttttgagtagctttgataaagacaaacaaccacagttattttaagctacacatatcatatctaatctaactgttgctctatacataattaaaccaacaatttaagattcaaaataaattaaaatcgataatacatattaccatcagaacaaaatcaatggtctttaaaatataactttttaccatataaaaatatattactccacaaatatgtgcaaatataaactagatctataatataaataaaaaatgtcaaatcaattatttctaaacgttcatcttttaaattatataaccaatttgtgatcccgttgtatttctttaattaaataaaatatttgtgtcttataaaatttatattgcggttctaaatacatcaccacatcttgggcaaatatataataattaatgttacggtaattttaaataatttcgtatcatattttaggatgtcaaatatcacttgataaatgtactacgtaattgcgaaaaaaataaaacaatttagttgtgttttttcaagtagatctgatttaattttaatttgtttggattaagccaagtgacactctaaaatctatccattgattttgttttaaattggtgggtccaatatttttaaccattagatcgaataaaaaaagtatgtgctcccaccttctccacacccttccatggtacggacgtactctcctcatctcctctttcctttcctctctcttgggaaaaaaatcttcaaattttctaaaccattagatctatctcaaaatttaccaattaaatttgtaaacaataaataaattgccagcgcatctgcgcgggctaccttcctagtgttagtaataagagtttagtaatagaaactttagtacgtataggcttttcatttctagacaaggcagtgtctctgggacgtgtttggttgggccaaattcggcccgtatctggtcccagcgctgataggaaccgttacaattgtttgcttacgatgggccgttatctggtactgtgggatccaataccggcccaattgctaagcaacacaacactgatacggagaggaatcgcgttcccggcaaggcggcgccgcctcctccaacgaacgccgccgcttcgatcctcgcgatggcgccgcacggccgctcgattccacgagacccaacgccgcctaccgccacctcaaaccgccgccaccgaccgccgccgacgaggcggcgaccgctgttatcttcacgagtaaccggcatccgcggaacgacaccgtcgaccacctccaactcccggattacaggctacgttccggtgaggaagatctcgaggggaagcttctttcgttgtaccatgttggtcgggtgattttgatccgatttatgttcaacctcttgctgatttacgttcctgttgctctcacaatttcctgcttcttttttttttttttttgcttgatgcaatcttgttttggtttgtcgaattagacccaatttttaatcccctgcctacattcaaattacgtcccccgatccaaacattgtgggtggaaactgaaaccattacagcaagcagccaaacaaactcagtaaatggctccaatgtttagcattaagtgcttgaaccaacattgaacgaatcctagtaagcttggcatcacgtgacgtggttgaacgaatgcgctcaaacaaggtcaggatcttgcttgtagggaaatgtgtctttacgtccgttcaaaatgatccgtattctgtactatgaaaataacagatgaattactgcagcacaagactcaagatattgtcacatttatggctgtggagttgcaacagattaggatatgatttgaatattgaagtgcgaatcaagagtaacagaaagaatcaatatgtcaattctttcaaaagaaaaaccattgtatcaagcatgtgtcttatttgctacagtatcagtgtgcaacagtacaaacatgacttccgttgatttaaacaggctgataacaggagatattattaagctctaacaatttcaaattgattttattgagccaaaaactcggtacctagctagcgcagcttaataagagtttgttgtacaattcccggtaaatgcaaggaagaggaggccgaggttctttcaattctcatcctacaatactcatctgggctcaagttctgtgatcggcgcttcattttgcgacatttttcttgagttgtgtgggttctgctctgaatttgcaccttagctagcagtagcaccaatctcctggacccaaaatgaaggcctggacaagcatgggagacggactgtaccagtactactaagcatggcattaacagctgacatcaatggcctatcagcaggtttcggttgaacacagagtagcccaatgtggatgcacttcagcaccttatcaactggatagtggtttcccaatgatggatcgatcaactcgatggctttatcgctagtccagtgctcccatgtctgcatcaaatcaatgggttagtgttcgatttaagttataattgggagaagaagttagctcggtatagaataattgggtccatgtactcacaacatatatgagatcaaccacatggtcagaaccgtaggagccaaagtttcttcttcctgtgatgatctctaaaaccaggacaccgaaactatacacgtctaacttcattgaatattgtccgcgcatcgcatactctggagacatgtatccactgtagcaagaacataacttttactgcatgatctattgacttcattattttaaaggattggccatacttactaagtcccagcgatacggtgagtgataacttgtgattgatccctttcgaatatcttagctagaccaaagtcagaaatcttaggattataagcagaatccaagagaacattgcttgctttgaggtcacgatgaactatcttcagttgagaatcttcgtgaagatattgcaatcctctagctatgccatttatgatcttgaacctctggccccaatcaagctctttgattctctctgcatctgccactcaagcaagaaaacaccaattatgacatgtaggtatgagttaggcgtatttgcactatcatcatgaaatttaatttctttttgggaaacagggagatgagagaaatagtaccaaaaagaatggtatcgaggcttctattgggcatatattcatatgcaagtattttctcattttcttctaagcaaacgccaataagcctgacaagattgttgtggttcagcttagcaaccaaaagtagttcagttttcagctcttcaattccttgtctggaagtctgtgcgagccttttcaccgctatttcctgaccttctggtagatctccctgcggcaggtgaaaaaagaagttgcggcctcatcatatattgagagagaaaacccacactgttacacatggtgtgagtggtaccttgtaaactacaccgaagccaccttcaccaagccttttgtgttcagaaaagttatctgtagcagttcgtagtgtttgtagatcaagaacgagtgaagcaaaactctgcatctcatcttcgctagactctattggaagagagaagtaaataattaattacgcagtatatgactaacagatggaaagagtccttgtaccccctccattttatgttataagattaagatgctttgatcttttctaacaaaaatttatagtggtttatagaataatttaacaatatccacgatatcaaattagtctaattaaatcaaacgttgactatattttgctaatttgtttgatataaatttggttaagcttaaataggtttgactagaaaaaaaattagaacgtaaggatggaagtactatcttaattaatgacactaatatgactaaaagtctttctactaactttggagctaccaggagatttcgccgaactataacttgggatgttgattgatgccttgtccaaatatttggtagctccaagttataattttattgtgcggacaattgagaagtaccatatatagagaagatctatagactaaatataagcatctttgaaaagtggtccaacacggcaactagaaataactgccttcaatattagatactgattttttttttgtgtgagaaagagagaatggaatttgattaaacgaaatttctaatgaatcacttgaattgagccaacttttcataaaaataacaagacaggttcattaattagtttccgtgatattccattctaacaaaatggataagatgaatttacttggtcgtaatgtttttcttgctagtctccgcctcctccaactcgtcgaacagaaccatgctgcaatagtagctaatactagagcaattgtaggcattgaaatggctagtattgcacttctcttgtttttcgatctttctgcaaatataatttaaccagccttataagttatcgaagaaaacacactttgcacacaggaaaatatcaggcaagtgataaataaaagaaaaggagaaaaaaagtatgtccaacatacctccggctgcggtcaccggtggcgccggtgaaggcgacggccccgggagttgcaacagagagcggccagagaagaaagggtatacctcaaaccataagttgcatcgcacgcccaaaactcgccctcccatcctcccaatcaaattcccagataccatcctcccaactatatcctcgaggcagctccggcaagcagtcgccgccatgtctggcgtgcactgcgccagcgagtagatcttgggaaaagttgtctcgtcgaacgcctcctcccccgtgccgaaccgcctgacggagtccgttgctgcgtagtcggcggtggtgttgatgagtcggacgacggcggcctcaaaagccggagccactgccgcgctgacattttgggctttccaagcaacgaccatcccttggctattggaggtagggctgatcgggaaggcgtcgttggcgaagcggaggatgcaggtgtcgtcgtagacgattacggtcttgacgagcgggcagagttcctgggcgctctgaatggccgcggcaacgcaggtagcgcaggaggaagagttggtatcgccacgacagagcgcgagggcgtagatggcatcgggaactgtgcccgaggagccggaggcgaagagggagggggaggaggaggcgtacgatggcagggaggtggctaagtactgtatgtttgcgtgatacgtgccgtgctccgtgtagttgccgctgtcaccacacaaaggcaccagcgtctgcgcatcggtgaggggcgcgtggagcagcagcaaggcgaggccggcggctgcggcggcgaggtagtagcaggccatggacatgatggtttgtgactgaggaagagatcagaaggggccggatacgtacggagacgccggctggagtgccgtagagccgtggcccatgtatgcgtggacagtggacttccaggtcttggatgtgagtctctttccatgcatgtgaccaatcaaacgaggcaaattttcctagcctaattgtcatgtgtgccatgtctgagacggcaggacaacttctaaacttgcaagtgtgcgtatatgttgctgggccagggggaagtatccagtgcaatactactattcggtgggagaaattcaatcttcaatgtggaccgtcggatgaaaagtgtactgctcagatcgaagcacttcccacattgttggttgtttatgcaaaaatgtctctatgttatgtgccaaaatgcttccagtccctctattatagcagaagccaaggctgaacatttgactctcctctctctccaaaacatttcagctttccccattgagggctagggtttctagtacactgtggattcagctcgtcgcactgagcggcggcgcagtctcaggttgggcgctagtgcacctcgtcgccgtcgtgtttctggccggtatgcggcggggtgaggggccgctagcttgttggcggcgaggtctgggacagagatagaaggaaaggtaagtggatcgattcggtcttgtgtattatttggtgccgcactgctaagtaatgaaaagatagagtcgtatagatggttgctgcagacattcttgcgagcaatgggaggtgttgaacctaggctaataataactgacgaatgtgctagtatgaaggcagcaattagtgttgatttccctacgagcacccacaggttatgcatgtggcatattatgaggaaattaaaggataaggtaggctatcccctaagagaggacaaagagttccttgatcggtttaacaaatgtgtatggtgtactgaaactgatgaggaatttgaggcacaatggacttccattatttctgactatggtctagaagaccatgagtggttgacaacgaggtatcgtatccgggaatcatggataccagtttacttcaaggacatttctcttggggcattcttcgaacgacttcaagatctgagagtaccaactcctttttctgtcattttataggcttcaaacttgctttggtggagttttggctcaggtttgatacagctctagaagaacaacgtcacaaagagctagaaaatgacaatgttacagttcattctaaccaaaaactaaaaacagaatgggggtttgagaagcatggaagggaggtgttcacccatgagatatttgacacttttcagaaagaggttgtagctgttatggagaaatgcatagttgagaacatcgaaatcgagggggatgtgaaaatcactacggtaagtgatagttcactaagggaaagaaaagtcttatacaacacatcaaccaaggatatttcatgcacttgtatgttatttgaatctcttggaattccttgccgccatgtgattcttgtccttagaagtgctaggctaaatcaacttccagaacatttagtcctcagaaggtggacaaagatgtgcaaaaaggaacctgtgtttgatagtgagggtaccttgttggaagaaagtgagagcacctcaactgaccctatgatgaaaaaattagtgtttgatgtattcaacacaatggaagaaacaatccatctagctaagcagtccattgatagcatgcaactcttgaaaaatggtgtacttgacattgcaaaacaagtaagacagatggtgccagccactcaaaggactagagttagcgagatcgaggaatttcttggttgtagcattcctacgcaaattgacattcacccacctaacgatgtgcgtgccaaggggaagtgcaatagattgttgggacatttggataagggcaaggcaagaaaaaaggctagtaatgatgataaggaaggggaagtgcagcaaaacaacaagaagaaaaggaaggcaaatggctctaaaaagccactagatccatgaatcaagttagtgcccttgctccatcttttttttgtttttctgtttttgttgcctttgattaaacggtgtagttaatctattcaaattgatggcaggtgttagcttggagtaagtttgtcattttggagcaagtttatgatgattcattttgggtaacctcttcttttggttgtctgggattatcttggtgtatttgccatattgatagaagcattattttggcaatttatggcaatttaattttggcaaccaagcaaacactacaggtgaatatgtttataattgaacaactctatctgaatctgtcatgttatttttttctaaacatttcactatttacatttgatggtggttccccatacaaccctggtttacaatttgctgctatgtattatggaggtgctggtgtgtgtgggtggatttatctaaacctatcatggtttgcttctaaacatttaactacttgcgtttggtggcaggtttccttggagcctatcttggtttacaatttgctgttatggagcatggcgatggtgatctgcaatttcaagatctgtcatttacaagtttgttaggatcaaacatcggggaccatacttccaatttcattattttgctacctagtttatatagggtggtctttgttctctaatcaaatgtgtgatgtatcaacaatttgatatgtcgattagtcctatgtcatgtactaagattcattctgtgacctactgaactagttgtgttacatagcaaaatgttggtagcatgtcagcatggttttttctttttaacttgcatttggcttcctggctcctgctactcaaaactattatgttgttctctccttgtcatgcaagctgaaaatatttggagccttggcatctaaacttaaatgaatgcatagtttgttcgccacacacagatacatatggtttcttgtatgttcgattcccaagattgcaaaaatgttttataagtttaagcagattgtgcaaatgtgtcatccatgaccatgtggaaaactatccaatacatctgtgtcataagttctgctcaaacatttcagaagataaatatcgttcactacaaagacgtaagctgcctcatctgcctgtctgttgcattcttctccttaaatctgaatgtgctcattatcagagaagtccttgtgcacaatactgatctgaatgtgcccttcaccagaaaaatctttgtgtgcagcagtgatattaaaatagcattctataaattttgtggatcataaatgttactttcatcgtattgtcatgatgagcccaaattcattaacaagatatactttgctagagagatgaagaacaacagcaccagacacggctactaccatggcaatgaataagagatgcatctgtactgcacactttgtagatcagctagaaaaaaaaaggggttcaacaacacatcagagtcagtggtggcataggagacgccatttttgcaagcgtagtgataaccctttctcttcctcgccgtcgtcgtcgtcgccgccactgccactgttttttcaacagtacctggtccgattaaaacaagagcaacccctgcaacctcaattgcatcctggatgtaagtggttaaactaaagattagatggacgaaaaagagttcaacataatattatgaaaagctcgaaagctacagaaattaatgaatttgcaaatttcacattaattagattagaaaagctcgaaaggtacagttgcatggattccattaagagactgaaacatctgaaatgaaaacatctgaaatgaaatgaaatgaaaactggccgcagcaccagacatcttggaagcggctttggcaatctcctcctttgcttccccaagataacgaagaagaatctcaaaagattggttatcctgatcaccgagcctaactatctcattcgcagtgctttgcaaaacattatgcctgaatactcttgcctgggccatcccaacatcatctggaaaggtcccaaggtgtgctgggatagagtcacgagctttcttggtccatcgcatcattaatatggcattgaggaatagtacgcacgcccagatgtagcataacctgcaaaaatacattttgccattccgatgaaagtcaagttaattctacttgcaagtgaggcaagatgttttactaaaaattatggtaaataactgacacttatcgcatgacatcagagaatgccaaagtactcactcaaaccacactcgcacgtttaactctgacatgtgttatgaagaatcacactgtacgtcgttttgcaccatttttccctatcaatttgatcaaaaagaagaagaatgttatgtaaacgttaatatctatccaccagtagcacatctaatgttatttacagcataatcaactaatgttttgacataataaccaccagtagcacatttcagcagcctcatcctcgctgggcaaccacatcttctggtttaatctggtttaccctgcagaattcaatttaatcttttaactcttcttcttaattttttttgaacttaacagcttacaaaaatgtaatacagaaaagaggggatcaagatttttataaaatgcgtcgctgtctgattctaaaggactagtcgttctctcagaagaactatctgctactttctcagacatagcctcaaagaaaacttctctcctttcagtggaagctttcctgagagtggaacattacagaaagtttcaggacaaggtcgaaagaaactaaatcatatataagaacaaaaaaaagtgcatttacaaacataactcattctgtaacctacactcgcttaaccgttggttcacaagaatctggagcagtaaaccgagatctgcttctacctcgtgtgaagaatggataaaaatgttcgaatcctcctcggccaagtaataaaaatcatatcaacaccaacggtagacataacgaaaaaatccctgaaaaatttttttacaaaaggaaaggtagttgttctagatctatggaacattgaaacttgaaagtttaaaaaatgtaccgacgaccttgggcttggcggctgccgttggcgcaacagagaagcggagcggcgcgtgcgcggccatggggctggcccgcgcgtcgtcgaggtcacgggcggagctgtagaccgcgcggcggagccacccgttggatctcgcccgccgcctgtcccactccgtggcggcgccgacgagggagtcgttcggcatcgcgtacatttcgcctccatctctattgtgtttgattcgatgagatgaaaggggaatttcgtggggactatggagtagaagagagtgaattatggggtgttgcgtgcaaaatgcgcactgacacttgggggggcatctgcatatattttaaagtgatcctagctcatgacctgcttcaatccaagccgcacatttcgcatctggtgatccaccttgctgattgcattctcccactgggaagtgcgattgcacacgatacttccccgctgggccagtatgttccggtcacagctgtagcctgtagcgcgtgtgtttggtcgctgatgagccggcgtgttgtgcacttgtgccacagacgccgttggagacactgcggtacataagcagctgccttaccactggagacctattagactcctttgtctttctggtctcctggcaatcgtagaaggagcggaactctagggttttcgactactctctctctttgattttagtagtgctagagtccatccttcggttttagtggtgccacgcttttgggggccttttttgagtttagggactaatccccaccccaccctcccagcaaatctttttaattgtgttttttctggttttcgtttcttttttccttgttccctgccaacgaccttctgccggtttgcattgtgtaactaaactctgttttcttcttctaatatattggcgtataatcctttagcgcgttcgcgaaatagaaaaaccatcggagacctcatcgttgatgaaaatacataaagtcaaatgaccaactcctacttcaagttgctgatctctgcgcaatcttccccaaacctccaaatctctagatcgatttctaccgcaacatgtaccaaatttggcgcaacaccaatagattgtcataattcgtgacacctcaccacttatatgtggatgttcttgtcaccgccgctgattcatgcctacagttgccacagagacaaacttgcctgggagggacgaattacaccgtggatcgtggacgacactgcttctgccggatgccgtacgtcccatttgccgccgccgatgcatgcttaccgctgtcgcgaacgagctcaccgtggaggggctgaggacaccgtggatgatgttgccaccgccggacaccgtccccttgcccgctaccgctagatcttgccatcccaagaactgccactgctgatgcatgcctatcgctgcctgggagagggagtagaggtaggaggcttggatggatggagggagaagctcgcctagctaggagagggagtaagaatgcgagggagagatgaactctcctcagtgctgggtcgatcggccttttaatgtggccgaagattttcgtaggtggttctctttacttattatttgtgaaaatcgattttcacatgcagtgaattaggaggaccaccagcaaaaataaacatattttcacaagcggtcctctttaatggcagcctataaaagttgattttcacatgtgggtttatcctgcatgagctcctcgactattattacaggcgggatatttttctgtttggctgtaaaaaaatgaacccttacctacgaaaatagtttttttttaagtaatgatgatttgcatattgaagtgccaactgggaaccaagaataacataaagaatcagtgcatcaattctttcaaaagaaaaaccagtgtatcaagcatgtgtcgtatttgctacagtatctttgtgcaacaatgcaaacatgctcctgttgatttaaacaggatgacagcaggatacattattaacatctaataatttccacttgactttgttgagccgaaaacacaacacctagatagccagattaataagagtccgttgtacaaatatcggtaactgtatgaaagaagaagcggatattctttcaactcatcttacaagatttatctaggctcaagctctgtgatcggtgcttcactttgatacattttcgttgagttgtgtgggtcaagcaggttctgctctgaatttacatctgagctagcaccaatctcctgaaaccaaaaggcaggtctggacaaggaagggagacggattgtaccagtaagcatgacattaacagcagacatcaatggcctatcagcaggtttcggctgaacacagagcagcccaatttggatgcacttgagcaccttgtcaactggatagtgatttcccaatgatggatcgatcaactcgagggctttatcgctagtccagtgctcccatgtctacatcaaatcaatgggttaatgtacgataaaattaactctaactaggagaagtatagcctagtatagaaggaaaatatgtactgcaaacttcatatgtagtgcaaaccaaggagctactatagaatgcacaaatggacatctctaagatttatccacgtcaccatgagtaattttcagacgtccatttgtacatcctacggtagtttcagatttatgaagtttgtactacatatttttcccagaataaataaattaattaatatagtgttcgtgtactcacagcatttatgagatcataatcttgttgatcagaaccataggagccaaagtttcttctccctgtgatgatctctaaaaccaggacaccaaagctaaacacgtctgacttgattgaatattgtccacgcattgcatactctggtgacatgtatccactgtaagaataacattatttttactgcattaccagataactaataaaattgtcattttaaaggactggacatatacttactaagtaccagctatacgatgggtgataacttttgattgatccctttcgaatatcttagctaacccaaaatcagaaatcttaggattataagcagaatccaacagaacattgcttgctttgaggtcacgatgaactatcttcagttgagaatcttcatgaagatattgcaaccctctagctattccatttatgatcttgaacctctgtccccaattgagctctttgattttctgcgcatctaccactcacacaagaaaacaccaattcgatatatataagtgtgacttgatcatgttttgcattaccatgatgagagatcttttttttggaaaacagggagctgtgagaaatagtaccaaaaagaatggtatcaaggcttctattaggcatatattcatatacaagtatcttctcattttcttccaagcagacgccaataagcttgacaagattgttgtggttcagcttagcaaccaaaagtagttcagttttcagctcttctattccttgtttggaagtcttcgcgagcctcttcactgctatttcttgacctttaggtaggtctccctgcaagcaggtgaagagaagttatggcctcatgattttatagcccttgatagttaccagaagataccgtataaaaaaacatcaattttatagaaaaaagtacggtacctgtcggtacttagctatttaacaagagtaaaatttctctttataaattgagagaaaacccagacaattacatccaagtggtaccttgtacactacaccgaagccaccttcaccaagccttttgtgctcagaaaagtcatctgtagcaactcttagtgttgacagatcaagaatgagcgagccgatactttgcatgtcatctgtactagactccgttggaactaggaagagaaaagtaaacaatgaagcattatgttaagagaagtaactgcctttaatgttaagacaagtgacttatttttagaaaaaaaaagatgatagaatttgactaaacaaaatctattgtattattaagacatccttaaaaggagacccaatgttcgctctagaggctagaaattctcacattaatcaaagaaaaagaaaaatatctaaacagttagatcatggtcggtccggattataacgatatagattgattgatatagttgtaaacaaaatacaatatattcatagaaatagaagtaaagagttgcatatgaaattaagcctatagaaacataatcgaggagttgtatagnnnnnnnnnnnnnnnnnnnnnnnnnnnnnnnnnnnnnnnnnnnnnnnnnnnnnnnnnnnn

SEQ ID NO: 30396 - DNA, 2130 bp, Oryza sativa
cggtacctgtcggtacttagctatttacaagagtaaaatttctctttataaattgagagaaaacccagacaattacatccaagtggtaccttgtacactacaccgaagccaccttcaccaagccttttgtgctcagaaaagtcatctgtagcaactcttagtgttgacagatcaagaatgagcgagccgatactttgcatgtcatctgtactagactccgttggaactaggaagagaaaagtaaacaatgaagcattatgttaagagaagtaactgcctttaatgttaagacaagtgacttatttttagaaaaaaaaagatgatagaatttgactaaacaaaatctattgtattattaagacatccttaaaaggagacccaatgttcgctctagaggctagaaattctcacattaatcaaagaaaaagaaaaatatctaaacagttagatcatggtcggtccggattataacgatatagattgattgatatagttgtaaacaaaatacaatatattcatagaaatagaagtaaagagttgcatatgaaattaagcctatagaaacataatcgaggagttgtatatgggaccttataaaaatagaagctaagcgctgtatataaaatccaaatgtacttttacatataatggtatctatatagaaataaaatttcagagttatatattataggtgaattatctagctccgtgcaaaactgaatggggctatcccctagtttataatgaatttagccaactgccatcaggatagttcattagttcccgtgctgcgtttttaataaaatggctaagaatatttacttagctctaaggttcttgctgctagtcttctcctccacctccaagaacaaaaccatgctacgatggaagataaagcaattgcaggcaccagaatgccgatcattgtacttctcttgtgtttcgatctttctgcaaaccaacattgtaagttacagaatacatatatgaagtcccaactaaatttactatatgtatgtagaaacaattgaaaacaacatggcttaggttttgttgtttctttagtactaaacactcattgtcacaattacatttatttccaaatactctctctgtttcaaattacatgttttagctttgttctaagctaaacattgctaatttgattattaatttctaaaatttcatattgtttaacaacatgcgaattacatatttctcgtggggaatgtaattatttagagtaaatttcataaaaccccgggtattggggcatcgataacacaaaaccccagttattgtgatttgtttcaaggaaccccatgttttgggataaaatgtttaaagaaaccccatttcaatacaggaaagatttttgtgtgcagtcgatttcaatttttccgtgcggatggtcggcccgcacgcacccaagggtctgggaaaatcgcgattttcgcatgcgggtgcctcacccgcacgagaaaataaaaaatcgaaacaaaaaaaaagaaaaacaaaaccctaaccccaatccaccgcctccgccgctgccctagccgtggcccgtcgctgtcacccccacggtcgccgcctacggatccgctgcccgctcccgtcgccggccgaagacgcccctccccttcactggatctgcagggggagggcaggggaggggaggggcatcaactcacatcgatccagatccggcgcgggccatctccgtcccaccaccttccaccgccttccaccggcgcccccatgcctcccctccgccggatctgcaaggggagagaggggagggaccgcgcgccgccgtggtcgcccgccgctgctgttgttgccgcccttcttcccgcccgctgtcgagggagagggagggaggggccgagcatcgccgcccccatgcctcccctcggccggatctgcaaggcgagggaggggaggggtcgcgtgccgccgtggtcgcccgctgccgccctagcttgctgtcaccgcccttcttcccgcccacaaccgagggagagggagggaagggcgagcgctaccgccgtatcgcctgccgacgcctgctgtagccactggccggccaggaaaagagaggagaggagtggagtgggagagagggagaga

SEQ ID NO: 30397 - DNA, 31692 bp, Oryza sativa
ggcttagcgccggtccctccattttcctgtgctgttccacatacggtccgcctggaaacaaaaggatccggcgtccatgaaaatctttcatgtagtatatttatgtaaaatactcatattacatatgattatgttttttttttgcataaatttacatttgttgactcaaagtacacattcctcttgtctagtttatatttttttctcaatttgtcactatataaaaaaatggacataatcctaagtgataatgtcataataattggttaaatatacacataaatgatcagaccgcgatgaacaacgattattgaaaagcagctaatgtgtatatgtactaaaaatatcacatacaatttttacaatatattagtcaaatagaagatataagcttgtagctggggttttatgaaacactttgccccaaaacctagggttatgcgttacggatggcccaaaacttgcggttttgtgaaaattgctctaaaaacataaatcttatgatattcaactatacaattttccaaaatcaatgattaaagttaagaatgtttgatttacgacaaaggtaaaacgaaaagtaattgaaacggacggattaacaataacatattttactcaaaataatatcatggagctttgagaaaaggttaacttgggccctgtttggaagattagcccaagactaatcttgagagctaatatttagtcatgaattggtaggctaaacattagcctaaggtggtatgtttggatccatgggctaattgaaggctaaatggtggagagagagtagaaagagaggagagagagagagagctgctttttgattgtccccacccaaaattagctccattagcaccacttaaaggggctaatgttttgaggggggctaatgcactttaacctcaaattagcccacatgtttggatccttgagagctaattcagggctaaaaggtgggggctaataattagcccatgaaaccaaacaggaccttgtacacaggggttgtgtccccaactcattggtagtggtagacttggtagtcagtgaaagggagggccaggcgctgcttggaaataaatatatcgtgggaatgattccaaaacacatgcgaatagtagtgtttacctcttactgcaaatagattatttcctagaaatacacatagtcaaatctttcttttttgctggatgtatactcaaacctttttaaataattcattgataaaaaatattatgatctaatatgcaatattagtagatttgttatgaaaaatactttcatataacaatattttttaataatttatataaaatatagttagaaaaaaaatatgaatgaaacacgtgccctagagactatatatggcgatgtccaaaacgtgaagtaaaaaataacagaggtagtgatagtgtgttatgcaaatttaggtgatgggaaagaataaatagttgggtaaaaacgattttacccataaccccaagagcaaatatcatacaactaataataaatagaaagagtggaaaagaaattaacactgcaagcttcactcgtgttcatccaacatacctccgttcaccggagcagaagacgacgccggcgagcccgggagttgcaacagcggctggccgaagaagaaaggatacgtctcgaaccggaagttgcaccgtacgcccaacacgcgcccgcccttcctcccggctaaatacgtgggcaccatcctcacgagtatatcctcgaggcagctccggcaggcatccgccgacatgtccggcgtgcactgcgccagcgagtagatcttgggatagacctcgccggcgacggcgagcgccgcctcctcccccgtggcgaatcgcctgaccgagtccgccgccgcgtgctcggcggtggcgttcgccagccgggcgaaggcggcgtcgaacgcggccgccgccgccgcgctgacattgttgtcgtcccacgcgacgaacattcctttgttatagggagggctgaccgggaacaccaggttggagaagcggacgatgcaggggtcgtcgtagatggcgacggtcttgacgagcgcgcagtgcttctgggcggcctggatggccgcggcgacgcaggtggcgcaagaggaggcgttggtggtgtcgccgcggcagagcgcgagggcgtagatggcgtcggggggtgcgcccgaggagccggaggcgaagagggagggggaggaagaggcgtacgccgggagggaggtggccaggtactgtatgttggattggtacgtgctgttcgccgtgtagttgccgctgctcgtgttgcagcgatgccatggcatgggctgcgcgtcggtggcgtgaggcgcgttgaggaacacgccgacgaggcatgctgcggcggcgaggtagaagtacgccatgtaggtggtgcatgtagctagcttgacgaagggtgggcgagcttggacgaagttggcaggtctagtagggagagctagcgccatattgttgtgtttgtacatacggcgttcgtgaaaagaaaatttttcgtgtgtcacatcggatatttaacttgatgtcggaagggttttcggacacgaatgaaaaaactaatttcataacttgcctggaaaccgcgagacaaatcttttgagcacacatgtaggttactgtagcacttatggctaattatggactaattaggctcaaaagattcgtctcgcgatttcccccctaactgtgcaattagtttttaatctatatttaatgcatcatgtatgtgtccaaagattcgacgtgatatttctgagaaaattttttggaactagaccgggccttagtaggtctttttctttttcagtttttcccatgctctgtcggccctcttaattattgtggcattcagactgttgcatcatctaggattctaaattcttcaaggaatatttcatcgtctatcacatgtcatctaaacagttatcggaaaaactaaaaaaaatagtaagatggattaatatgtgacttcacaaataattatgcttaaatatgacttctacaagttgtaaaaaaaagataaattaaactctaattagtatatgtgtatattcacagtcatgcaagagacgatgtgacacccccttgagagtttagcatactctctctcaacaacggtatgttgttgtgtatttgtaaccagtaacctatttagcgggaaagtattttctataacatgcatatgatataaatagttaaataaaaatgtgaaaacatttggtacgatgtgttgtgataatataagttattacacaaacatgtaactacaaattcgatgaaaatccacatccccatgtttgccctctttcctccgttggcgtttcttcacctatcctgccaagataactacttttatttcttttaatatacgatgttgtacagtttgttttactaaataaattatgtacttattatttattttgttggatttgttttctcattaaatgacttttaaacctgatttatattttttttatatttataaaacccctagatagaacgaatggtacggaagttaacagtgttatataataatgaagaaagaaactagtagaaactctggtcgattgacttgtggttgagcctgtgaccaatcaattgaggcaactattcatggcctcataagtgggcttgatcacttgacctatcaattgaggaactattcaactattcattgtcttataagtcacgactcagctaaaggcatgtgggctatgtttatttggaaaacttctagcaacaagatatatattctgtttttgtgtagaaaaagctgtaacttttccaaacatcactgatttacaactagtttgtattttcttatataaattagtaaactgggtttttcaacttctccatattcttataagttaaataaccagtcgtttctcagtgaaataaccagtcgtttctctgtcagaaactaacagggtagaataaacagacccaaaaaggaaaactagaatcaacagattcagaaaggaaaacttactttatgtttgttactttgtatctgttcatatttatttttcagtctatggtatagtaggtatagcgactggaccgtgatgcatgcatgtcgcctggatatatagcaaccagctcaagatctttcacccaatgcattaagattaaatgtttatttaacgtcgattaatctttcaagttgaagaaaatccactgttctccccatctgacatggcatccagcgtatccaaccgcatgaagaatcgggagcgcctgctgcagtacgtgctgagtccgccttccaccagccgacgtaatgggatcacctatacattttcaataactttttcttttaaaaatttgacaaatacaattatagtgtaatcgtggtgtaattatattagctataatgtgacttaattgtatgtaacatttaaaaatcttttcgtggcatgctatttgcgtgaaacggaggtcatggactaaatcctttcacttgtgtgtgttgtgatttttttcccatcattgattgcacaaatcttgaaacaaatctaacggttcaaaattatgtaaaagttatattatagttatatgcaagttacaatgtaattacatctgttaaatttttttaaaaaattgttcacaatatataacaaaattggacgtaattcacgtacacgcgcatgattaaatgattgaaacgttttttagagatctggacgccaaaatattctccttgttgatctccttttagttattaacccaacatgcggtttaacatttttcatgtttcactacatgcgaaacatatatacgcatcacatacgaatgcgccatcaagacatgatctcactaaacttttaataaacaatcatggtatattaacttagcagacgggtgtaatttagtgcaataacctgagaaatgagcattttaatacaataacttaatgggtgagtgaaatttagtacaagaacttacttagtaagtatacaatctagtacaggaacttaataagtatacaattacatcaacttgcatgatgggtatgttttggtataataacttaagagttaatataacaactgaattatttcgagcatttttttatacacattcaatttttaagttcttattttgtcaacatatatacttgtctatattgtataagcatacttatttttttcattttagtaattaaaagtcagttaaattttactagtagaatgttttgtatttcagttgagatcaataaggtgaagaaaaaatctataccagtcgtgctaaattgggatgaacaacataagataatatctgcagtatggctatgttatggcatactgatatcgtgaaataattaacttatcaagcactcataaatcaaaacagcacatacctagctaagtttttacgccaaaatactaaattgtcaagttctttatattataatggacccacatgtcacagtattgtacttggatgttcaattatcaagttcttatattagatggcactgacctattaagttgttgccaagttatttttatataattgtaatgtattctttaataaaatacacccacacatatataatttttttgtgaaccaggatttaaaccctaacggtggattgcataacacctcttgtgcttctccaatgtgtggattgatctcaccatgaggattatttgaagaacaattaatttttaatttgaaatttggattgaaattactagtaaccaaaccttacttgaacggagatttctattgttgttgatatcacatctatttgaatttaatcatatattgaccactgttattttcttagcaatacaggcttaaactagaagttgattccaccgcatttacaactaactaatatcacatttggattttacaattataataacaaaacagtaaattaagagtaaaaaatggtaacgcttgataattattgtttcctaattttagaataacatttaaaaagactaataaggtacaatttcgacctattatttgtgtcacgcttcgaaaggtacaatttgtccaaaactttctccattagcatggtttagataattttttccaagcagtttgctaactttatagtatgcatactatttttttgtccctattgtttgtagatcatccatcagttttctctcgcatcactcacgcacagttcagctatacaatagcatgtttcgttcaatatgagttctctatacggtcataatgataccatctaaatcaacgaccagatcttcctaattaaagaaattcttaagagatagggatagatactagtaccgattaaaattggaagactcgttgattgacttggactttgattttgttgccaatcgatcgttactggagacaactgttcttggcttcacacttggcaacttaattagcatgcagataggacagtacaagaaaacttgcattgtgtctaaacatgattaatttcactgtgtgactggacccctgatgcacttgccagctggatagcaaccaagtcaaaatctgtgcgagattggtcaccactggagaaacgattttcgcatgttccttccccttaattttgcaggcaatcattttttcttcgaattcattattttacttgcgatagatttttggatgctcctgtctttcaactttttatctatgggatcttacatcaagatttgtgttcctataaatccaacttacatcaagctggatactccccttgcaggccggatgttggttttgtacgtcctgaaaaattggcctgctacacgaggacgatcgtttagcataagcccatatcctgaaagaaatgggcctgcttctgtttcaccagagccagcaggccgagcccccaacctgaagtgaaatcgctgggtcgcctggcctcatttctgtcgtgctggactcctggccctctcacgttttaggaaaaagttcacatgagatccctcaccttgtcaccgagttataaaatcgtccctgaactgaaaaaccagatatatgtcagctctcaactttacaaaaccagaccactctaggttcttacacgctattgacccccattttgtccaacatgatgactgagtcaacgtgggacccacatatcaatgacacaaactctcattcttctccctctgttgctctccccccgttctcactcaagctggtggaggtgcgtcggtccacgcatggaggccgacgggataaggggtcttcgcggtgaagaacactgaggctagcggttgagaaagcaggagcaggacccggaggaggatgtcaaggccggcgtcccatcggacggagtcagcgagggtggtggccgcgccatgggtagcttgaggaggggcccaaccccctagttggcgacgaggcaggcggagcaccgggagtggtggtgaaagatgaggctgacaatggtcagtagaagtagcccaggggcaaggtgcccaacccatccccctggcggcgatggggtctatggaatctggcgccagcagagggggcgccctggcagtgacccgcgagcaccgctcacggaggaggtcgggcaggggcggtgtcgatgagagcttagtagagccggagtagagggggcgaagatctgggagggaaaggagagcagcccaatgacaccgacgaagagcccttcgttgtcctgggcgcagccagtggcgacactggagaccggcatggagtcgacgtgccacccgctttctttgccgagcttcctccactctttctctctcccctaaaactcttcccgctgcaactagactgttggctgcctccaattcccaatgccgtcgcagctgggaccacctcctgccgccgttgagatcacccacaacggccggagccgtgcctcctcctctacctttcctccctgcctgacgcaacaaagagaggaagatgccacctaggacgaagaccttgtcaaaggagccatgtttggtagacacgactttaaattatagatggggcggagaacagagatattcactcgataaaaacaatcgaaaacaacacatatcgtatttatagttcaatcgcataactgtctgaatcattgtttgtagcgggcgtgcattgtgaagaaacggactaatctgttgggcgttcacaccttgttagcccatgattactataaggggtagggggtcttggtgggtgtggggctttacaggttgtagctgggtcggtcgactcaccctgcttaatgggtagatctacccctgcgtgggtgccatgtcagccaaaatcgggggacaatactgtcaagggatctcgttttaaactggttttggaagttggaagttggggcatacgttgtatatggtttttgggttcaggaacgattttgtaactcggcgatgcgacgagggacctcgagtgaactttttcctccgttttacccaagcttttgtgccggccatttgcccattttcgctcattttcgctcaatctgctactgacttggtcacaaattacactctgtaatggaaactttcttttaagttaacggtccagagcaatctgcattctacagcactagcgagctgtgtgtactgcagtaatttctcagataagcagatttttggaatcccaatatacagtgatgtgtcctacgcttctgtaggtgattctgtagcattgggctcgtgtggccaagctcttgaccacttatcacaaaatgacaatatatacagtttcaagttccaactcgaaacaaaaacaagcaacaagccaactacactagcgatggcaagctctgctttaggccctgctacctgggagacaattgtgtcacggtttgagaataaccagagcttccatcggagaaagatgctactggaatatgaactacaggggccggcagagtgctagtagcatcgctattaagtaaaaccatgacatcggccattgttggacgatctatagggttctgctggacacacaggagaccaatgttaacacattttagcacctcgccttcagggtagtttcttcccaaggagtgatctatgatctccttaatgtttccctctgcccagtgcctccatacctagtattagatacataaatatcttcagtaatcagtatgcatggttatatgttagaaagtactaaaagtgcaagtggcaatcaatggtgcattagtcttggtgaattagcaaaatatatactccctcttttattaataaataatattgttaacttttgacataatgtttgattattcgtcatatttaaaaattatataaatatcatttgttctgttgtgacatgttttatcattaaaaaagctttacgtaagacttatacttcagcacatttacactaagttacgtcatctatttagaaaatggaggtagtatatacttactatgcttattatatcttcgtttggctcaaagaaatagggcccgttgttccttctccggcccgtcacgatctctatgacgagaatgccgaagctgaacacatctgatttcgtggagtactgcccatgcgtcacgtactcaggagacatgtacccactgcatcaacatccaacaagaataatcacatggttagaatgagaattgcatagttaattattttattacatatatatttatgaactaattacaatgtcccaacgatgcggtttgtaatctctcgagtctggtcttgtccgaagagcctagcaagtccaaagtccccaatctttgggttcatgtctgcgtctagcaagatgttgctcgccttcatgtctcggtgtacgatctttttctgggagtcctgatggagatattgaaggccccgagcaatgccttcaatgatcctaaatcgtgtagtccaatctagctgtctccttttctcttcatctaattagcatgaatcatgttcattgcagaaacatgaaaagatggtaacatatctaaattcaggggtgatatcagtagtaccaaaaagaaaggtgtcgagacttttgttgggcatgtactcgtagacgagcatcctctctccctcttctaggcaaaaccccacaagctgcacaagattcttgtgatgaagtttggccaccaaaactagctcgtttttcacctcttccaacccttggtttgaacccttcgctagcctcttcactgctacgtcttgtctgaaaagaagcccctgaaaaatttggtttaataccttcttacatggagatatggatagaaaaaactgaattttgaatggcttaaaagcttggtgctgtaactaatttacaatattaggcgatcttgaatgatatttgccaaatagtattaattaattaaattatcaaagtaacaattaaggatcagtacactcatagtaaaaagttatcatttcatatttttaccatgcttaattcgccccgtgaaataaaaaattatttcctcaaaagaacacataaaaggttacttccataccttataaacagcaccgaatcccccttcgccgagtttcatgctttcattgaaattatccgtcgctacttgcagtgatgccagagatagcagggttgacttgacactttcgaagtcctcagctgcatcagctgtcaaattttcatgaatttgataaactgttaatgaatacggatgattaacaatgtatagtggaatttgataagaattttatgccaatgatgagaaggatcactcacgtccggtgaaatgctctgctttccctcgtcttctcttcttgcgtatattccacaagaggatggaaactgcagctacgattgcaactgccactatcggcaagacgatttccagaattttgtttgctgaattattcttgactgcattttggagggaaaataatcagttcaagtattcaaaacagagcacctgttttcttgtctgagcagctgattattgagctaccagctgctcaacgaacaaaattgactttctcttcgcagtggcggatccttcatgggtctatgggggtctcgagccctccattacccgtgtcgtaaccataggagcccccacgaagaccccactaaaattttttatcatacattaattagaagatgggtttataatttttgtatagtttgttcagaccctcatattaattctttctggatccgtctctgtctcttcgtgtgccaatttatgatttttctaagactcaatgaaaacaatgagctatgaagatagtcatcgttaattgacatactactaatatatatacgtgacatgatgtaatacagcatttgccatgctaaactatgggtcttgactgtctgcgcggtgattatctgacataacaccaagaatgtgacgagtaacaaaagtcagacttatcagttcaaaagtaatccggtataacataaacaatgcagaaatccatgaaccataaaaaagtataatgacttatattttctcatatttgcagtaaatttgaacccagcaaattttcaaatatcatgtttaaaaattaacgatatcttatatttaaaaatggagggagtatatgttatcgaaatgacgcggtattgtcacctcccgtagtgcccggcgcagcatccggcgacgccgccgccgccgccggcgagaggccgtcggcccacagcttcagcatcggggctccggtgtagaacttgtcctgggatacctccgacctcaagctgcacctcgtgccgacgatcctcgcccccaccgtggtccgcgggaacgtcttccaccacctggcgacgaggtcctcgaggcagctccggcacagcgccggcgacaggtccggcgtgcactgcgccgccgagtagatgttcgggaaccccgggtcggcgcccacccgctgccccgtggcgaacagcctcgtggtgttcactaccgcgtacatcagggtggcgctgaggagttccgtgacggcgcggtcgtaaccggcgacgtcggcgggggtgacgttgtctctgttcatgagcggcgccttgcccgagttgttggcggaggccaagaaatcccctgcccgccagaaccgggtgtagcactggttgtagacgagaatggcgtccctggtgcggttgcacgccgggaacacgtcctgtcggaccctggtgccgcagtagtagcagtcggaggagctcacgtcgccgcggcagaggatgaggccgtagacggcgtccggggcggcgccgagcgcgccggcggcgaagagagtgggcgacgtggaggcgttctgctggagggcggcgatgaggctctggaggttggtgtcgtaggtgctgttcgccgtgtacgtgccgccgccgccgcctccgcggcggccgcagagctgccacggctggccggcggcgagcgggagcgcggcggccgcgaagaggagaacggcgaacgtggagcgccgccgcatggcgcccgtggacgcagctgtcacagtcagcaggatgcacagtgggatggaagctagcaaaagaggatagaattttcgcgcggcattgaaatgtttttttctcgtgcacgtacgtacgatggtgttggcaagttgccatggcgatagcccacagagactgaggtcaccacacaacgttaggcagatgttcatgagaaacacccagagtcttccagctagcttcacaaggtggtgaggtagacgacctgaattcgaagtcactcttctaattatttgatattaggtcattttctattattcgtgtttttttagacagatgcttacgtcgtaaagtacgttcattcaggggggacgtttcatcgatcattcgttgtcgaaaataaaggtgagcggaaaccaccacgcagcagctgtttcaacatgcgagtactagtagtaattagcacgcacttaatcgattggaacacttgacccattcttaactagaaataatcaaatggttgggtgtggagtgcgtgcacctggcgcccccgtggaaaaaaccagccgcggtagctgcaacaacttgcatggatggtcagatggatatccattactcctacgctaaaagtatcttatgagaaactaattaattgaagtcaaaagggaaaaagaaagtgacatactactggttttcctcgtatctccatgtttataatttaactttacaattcttgattacaaactgataaaagatacaatttcaacggaaaacaaaacaagcatcaacgagcaaatcctatatacctatacaaatcatccccacttagtgtagttattagcaatttcctgctttgaggttgagccacgtcaccacttatttccatccgttggattcacgttcttaacggtgcaaattgcttcctcgaggccttttctcttgctcgctgaggccagcccaattttcccacctgggccagccagtgaacctttcctcttcctccttccgactagtgtcgtaggcggcgcatcaccaggcctctccatcgtgcgttgtcgagtcctcttcccctcatcgattcgcctcctccttgatggctcgatcaaaaactgtcatttggttcatcttccatggttccaccatcccacggtctctccctctgcgaaaccaacagcctcttccacttctcaaggaatataagaggaaaagaactggaagggtagctattaaaggatcttcttgcatgctgagctcccacaaacaagcaacaacacaacgaatcaatctgttcgcctacgcagctacacccacgtccaactactatcctacaggatacatgtatacctggtagcaatggcactaacaagttgttcatccatacccacgaaaacgtttcttcctggtccagatacaaagatccatcaaatccatttcccctgttagcgcggtttccatctgtaaaagggctcatgtaatcatgtccaactcatctggtggcttcggttcgatgcagcattttagcaggcattttagcctccccttttgctatgaaacaaattgttgcagcacaacagctggattcgccaatcttcatattgatttattggacacaaaccgacacaattgtttctccttcagtgagattgtttcattgcacacaagcagcccattcattcgtgtcttcctggcctataccttttttctgttcccatggggtcttcttgctgaatcaggtgcttctcttccctcattttcccatgttcagctgatcagctcattggctcacaaggttgaaacagatggctttgggatgagtttattggttgtactcattcctcctgtatagaaaaaggcaatgctcctgtttgtcttcatctgcctagccattggctagatctgcatgatatcacttttttatccttcataaaatttaatgtcacatttcccctccattcatgttatatcatgctgatggattttatcatagatgctcttactagctaattgggaaagtaaattctggtcattaatttctacctctattcatatttgagctatactacgattcaacgagaatgatttctggaactttttttttttgatagaaggccagatggcccagcttttatataaagagagtttttacatccacaggctggggagaccagctcaaacaagaaaggagcgttttcagccaatactttggcccaacacaaatagtaggtagcagacgagaaagaaaacatgcgaacttagatgtaactcttcttgagtagggggaaaaggacaaaacaaagttcaagattatcaccttcagtcgactccatttctttggttcacagaaagaagttgcagctcccaggatcatccatttcaataactccgtctttgcttctccattttgtttcatcagcttagcccactctattattttatttattattgtaatattatttattccaatcaaataatataacgccatctcttatatatctctatcagtctgtcatatattgctaaaaagaatagtacaactaatcctcatttaatttgtagcatagcgcaataaacaggtctttgattgttatacacctttcctgtccttacacatatattacgcaagtttcacaatctcctcataagatgagtttgtattatttccaaaatttgtagtcaagaaaattcattttcctataatcgatgaaacaggatgaagctctgctaaggagtacttggacctatccaacccatatagtatgttaaatgtgatggatcaaatgtcctcatagaatttcgctttcttttattggtatgcactatgtctaaatgtgatggatcaattgttctcttagaatttcacttcattttgtttagatacattatatcccgcagcaactcgcggggtattttctagtaccaactatgttttagccccctgctatctaggagacaattgtgtaacggtttgagagtaaccagagttcccctcgatggaaattgttgggctatgagttgcaaaagccggcagagtgctggtagcatcgctgttaagcaaaaccatgacatctgccattgtaggccgatctacagggttttgctgcacgcacaggagaccgatgcttacacatttcagcagctcagcttcagggtagtttcttcccaaggagtggtcagtcatctctacaatatttccctcttcccagtgcctccgtacctagaatcagttacatattgtgagttatatgttaatattgcagatcatatattgcatggttatcttcaaatgcaaatattaaaatgtaagcggtatcaatatactccgtatttgtctatgagttagcaggatactcactatgcttattaaatcttcgttttgttctaagaaatgggggccgctgtttctccgtcccgtcacgatctctatgacgagaatgccaaagctaaacacgtctgactttgtagagtactgcccacggatcacgtattcaggagacatgtacccactgcatgcaacaacaagaaaaaaatgtacatgttagtttgttagctacatataagcacaaacagataaagtgtttgacttcgttacaatgttccaacgatgcgattggtgacatctctagtctgatcctgcccaaagagcctagcgaggccgaagtcgccgatctttgggttcatgtctgcatctagcaagacgttgctcgccttcatgtcacggtggatgatcttcttctgtgagtcctggtgaagatattgtagtcctctagcaatgccttcgatgatcttgaatcgtgttgcccaatcaagttgtctgctttgctccgagtctaattgacacgtgatgaagagattattgtaattattgcatgtcagcaaacgaaaggggtatatatatgtagattaaaaggtaattataattgtaccgaaaagaaatatgtcaaggcttttattcggtatgtacttgtagacaagcaacctctctcccttctctaggcaaaaccccacaagacgaacaagattcttgtgatgcagtttggccactagaactagctcgttcttaagctcttctagcccttggtttgaaccctttgccagcctcttcacggctacctcttgtccaaaaagaagtccctgaataattcttagtttattagctaatttgctttatacatggagatatggacagaaatggtgaattttgtaatgacttaagactctaacatgcatatgctactaatttacaatatttggtttttccaataaagccagatcaaagatcttttgtaaaaataaactataacaaattagcaatggagtactagtgcgctcaggaatcaagacatatttagaatttcatatttttaccgttctcgattcataccttcaaatcaataattcttttctaaaaggaaatcagcaattgttcaaaagttacctgtgaactactactctcccgtcccaaaatataaagaattatgggtggatgtgatatattttagcctgttcagattcgtagtactggaatgtattatattcacttaaattttttatattttgggatggagggagtaccatctattatattattaaaggaatagaaaaagtagcctccacgttcgctctcatggcctagaaattctcacattaatcggaaaaaaagaaaaagcaaagctgaaatttggaattaaaaaataagaaatattagaataggagagtacagtccgctctcatggcatagaaattctcacattaatcgaagaaaaagaaaaagcaaagctgaaattcagaattaaaaaataaggaatattagaataggagagtacagtccatatagaaatacaatttagaaataactgaaattcggaattaaaaaataaggaatattagaagaggagactagagtccataaagaaatacaattaagaaataactgaaattcagaattaaaaataaggaatattagaagaggagactagagtccatatagaaatacaattaggaagtaactgaaattcggaattaaaaataaggaatattagaagtagagcatagagtccatatagaaatataattagaaaataactgaaattcggaattaaaaataaggaatattagaagtagagtatagagtccatataaaaatacaattaagaaaaagaatagaaattcggaaataaaaaaataaggaatattagaagtagagtacagagtccatataggaatttaaaactaactaaaattcagaatacacataataaaattaaaagtagagtttagagtccgtataaaaatacaatttacaagtaactaaaattcgaaattaagaaaaacacgggaagaagagtttaaagtcaatataggaatacgatttagaagtaactaaaattcgaaattaaaaattaaagaatattgaaagatgagtttagagtccacatagaaatacaattagaaataataaaaattcagaaataaaaataaataatattggaagaagagcttagagtctatatagaaatacaatttacagaaaattcggaataaaaaaagaaatattaaaagacaggtctatagtacatataggaatatatataatttacaaataactaaaatttgatattaaaaataattaataactaacacgtatataaaaatacaatatgaatattacacattagtagtttcataaagttattgtaaaatttaaaattatgtttcattttaatatatttgaaaaatataatgagaaagcaaatatgctattatatgagagaaaatataatgatgctagccgcgcaatctgcgcgggccagcatgctagtttaccttataaactgcaccaaatcccccttcaccgagtttcttgctttcgtggaagttatctgttgctacttgcaatgacgctagagttatcaaggtcgacttgacactttcaaggtcctcagatgcgtcaactggaaaatttacatgaatttgatatagttaattgatattcgaatgttagatggaatttttgaagaattctacgctaaattttgtagaggactcacgttcagagaaatgttctgcttttcttgatcttcttttcctacgcacattccatatacaaaaggaagttgcagctacgattgcaacggccactatcggcacgacgattaccagaactttgcttgctgaattattcttacctgcacttttgcatagaaaatgatcagttcaagtatccaaagtactgtaccttttcttctatgtagcacctcattacaacaacacagtgctaggctgctagctgcttctcaacaaacaaaatataattgtgaatgcacgttaactattttcaatttaatttgttttttttattggattttgtagaagttgaatttaaccatgtatttttgtggactgatatttttcatattaatttaaatagattatttggatggcatatgtaagaaatgagcggatatctccagttctccgcgaggattgaaaatacatctccaactaaatactctctccgttttgaaatgtttgacaccgttgactttttagcatatgtttgaccgttcgtcttattcaaaaacttttatgaaatatgtaaaattatatgcctacatgaaaatatatttaacaatgaattaaataatagaaaaagaattaatagttacttaaaattttttaataagacgaacggtcaaacatgtactaaaaagttaatggcgtcaaacatttcgaaacggagggagtatgttgtatgctcacctcccgtcgtagccgccggcgccggcccttgcgccggcgcgagtccgtcggcccgcagcaccaccatcggttggccagtgtagaacgtgccctggttcagctccgacctcaggttacaccgcgtgccggcgatcctcgcgccctccacgttcaccgggaacgtgtcccaccactgccccacgaggccgtcgaggcagctccggcacagcggccgcgacagcgccggcgagcactgcgccatggagtagatgtcgctgaaccccgggtcgctccccacccgctgccccgtcgcgaacatcctcgtcgagttctccaccgcgtaccgcacggtggcgttcaggaggctgaccaccgcggcgtcgtacgccctgacgtcggcggcgcgggtgatgttggtggagctcatgagggcgacctcgccggagttgttggtggcagcggcgaggaagtcggcgtcggagacgcggacgtagcactggttgtagacgagggcggcgtccctggtgcggttgcagactcgccccacgtcctggccggccctggtgccgcagtcgttgcagtcggaggtgctcaggtcgccgcggcagagcatgacgccgtagacggcgtcgcggccgccggagccgacggcgccggaggcgtagagggtgggggaggaggaggcgttcccctggagggcgctgatgaggtccaggaggttggtttcgtaggtgctgttcgccgcgtacgtgccgccggtgccgcagctcggccacggctggccggcggcgagcggcagcgcgaccgccgcgaccgcgaggaggacggcgtggacgagcgacgagcgccgccgcatggcgccggccggtcagagtagcttagcagaggcagtggtgggatgatggaaagctagtaagctcgatcgatgtagcaatggcacagcattcgttttgagtttttgagctggaatgcgtatcattttggatgtgacagctctgggcaagtggccaacttggcatgcgatggccccaccacaggtcagactgaattcactgaaccccgttacttactctagttgtttatatgtcatctgaagtaaatagttattaaatttttctaaaaaaattgacaacatatactaatataaaatatatcactccacaaatatgtaaaaccaaattcaacttctacaagttgtaaaaaaaattaaactgaaaataattatcgtacattcgcagctatatttgttactgtatttttttagaacttatagaaattaattgaatttaagttcgtatgtttgtggagtgatatatttcgtattaatcaatgttatcaaatgtttttaaattttttttaactatttatatgatatgcataaaatgaaattactttcgcttacttacttgtcaaaacccacgtgcatgcatggacgcagttgatatgatagataacagttgctgaaaggaaaaggggaatggaaataaacaaagctgatcgtgactagtctcaagggaaacctccccgtagccgctgtttcgacatgtttaattagctcctaaaatgtacggagtattaaacaagatacttgtagaactcaatatataattaatactccctccatattttaatgtataacgccattgactttttaaccaacgtttgacaactcgtcttatttaaaaattttatgcaaatataaaaatacttatatcatgcttaaagaacatttgatgataaatcaagtcacaataaaataaattataattatataaagtttttgaataagacgaaaggttaaacgtttgtcaaaaagtcaacattgtcattgaaatacggagggagtaaaatttaggagcaatggattattggtcacgggagtgcttgcaccttcgcgcggtcgggccccatgaaaaaggcagtcgcgcggcaacttgcatgaagaatgtcgatcatatacttcccgaaaatctactgatcggtctaccgatttcacaaaattttatcgaacgctcagactgaccagtgtactactcaagatttaaaatgtttttttctcattaaccgcttatccgattatatcattgtattgttgtaattaaatctttataacaagatatcgcattattatattataataaaaaatatatatatttaaaattgtcagaacctaatgttttatacgtgatagtgatatatacccgtatgtgtcttcagtgtattttacaaaattcccgaaactacctaccactactctctctccatcttatccatacatgcacattctattgagcttcaaaatgatttttctcctaaactaattatccaatctacgatctgattacaccgttgtattcgttgtaattaaatctttacaataagatatcacatgattatattttaatgaaagaaaaacgtatgcttcaatccgttaatactagttgtttcatatgtgacagcgacatgtttcaacgtatatctttaccaagtttcatataacttttaaatgttccaattgatggttttttcatcattataacttgatgtttcgctcgttggtcaactggaatatttgaccgtccgattatttgggcatcgtgcgtctgatggatagattctttttatacttcctccgtttttaatatataacgccatcgatttattgatatacgtttgatcatttgtctttttaaaaaaaactactcctaaaaaatatataattatcatttatttcattataacttgatttaccatcaaatattctttaaacatgacttaaatatttttatatttataaattcttttaataaaacaaatgatcaaatgtaaacaaaaagtcaatggtgtcgtatattagaaaaagaaagatagtgctaccttagggtgaattaattagagccaaaaacaaaataaaaggatactgggagtggcatgtttttaattagtggaagtttttttgaactcccacatacggcaaagggagcggttttattttccttttattttaaaaacatgccactcccatcactttttcactatctcgttcccccatgtttaatcgtttccatctccctcctctttcttcaccatctattcctccatccctgcgactgcaaagaggacagcggtgatgacggcagtggtggcagtggctcccgagcactcccgccgtggatggtgtcgaggacggcgacggcggcagctcccgagacctcctgtcacggatagaggacaacgacggtggcggctccctcccgccatgcccgagctcccacaccgcctccgctgcctgctcctttggctccggagcccaccttcctcctcctctgccggtgccttctcgtcggccccctcccgaggctgcccgctccacgccgcgctgtcccagcgctgtgcgcccgcggtcgcctccctcgccctctactaccgcatccgcgaggcctcgccgcccaccccgttcaccttctccctcctcctcgccgccctcgcgtcgtcgtctttcccgccccttccccatccacaggctttgcgcgcctcgcccacgagcatgcattcaagtgcgatgcgctcgcgcaccccacctgatggagccatggagatcgccgaagtctgtgatgactgtgcttgtgcgcgtgcaatggaagttcaccagcaagaggaatatgtagtggcggggaggaggagaccgtgtcggcgacggagagggaaagggaaggcgtgcgcaggaacgggaccctgtcgttaccaactccctcctcaagctctaccgctcgccggagagggggatgaagtcaggaacggaaatgaggaaggagggaggggatgaggacggcaacggagacggcgtgagagaggagacggaaaaagggacgggagtggcatagttttaattatagaaatttccagtggcatgtggccgatatgatgaatagtagtggcatttttttaatttcgcaaagttgcagtaacatggatccaattaacccttttaaaaactatccaatccattgtcaatatgtcatggagtagaagcaattgataaatcagtagtacattgtaacttggagacgaactggatgaaaattttttgaacaaatcaaaataatacaatggtaaggaatagatatttgctctttactgggacaaccggacaaaatgttagcaaaatattggttggttcgaatataagaaccaagccaaccggaggcggttgtatggtagaaacaccaaaatcaattcttcttgcaaaattaaaagattaccctcaaactttacgaagttgcaccggtcagatcgttgtgatgacgtcgtcggtcagaccgcctgtcgatctccttgtctgcttgatgatgttgttgctaccgccgccagtccaaccgtccgttgtactccagttagaccgtcaggatcaagaaaaaaacaaaacggcgaaactcttgaaagtatattgactttatatgcatcaatatgtgtttagaaagtgcatctaaaacacttggtttgtgctccttcgatttgccactgccgtttgatttagttcaaataaacggacgaaaataattcataacaaagaaaaaacatgatccccctcactgcccatctgttctgatcagtgctcttcactccaccgtgaagaatcagctcctctctctaggaaccctaatccccaaatcccctcgtcactttctccacatcaagagcaaatcaacccaaaaaatgggtccccaaaccccctcaacagcggcggcagggcagtatagcagcaggcggcaggaggtggcggcggcaagggagcagcagctgccggcggcgttaagagcaacagccgggcggcggcagcagcagcacgcgtcaggagcaacaaggcaacagcaggagcaacatggaacattacatactccacatcgaaaatgcttgcgaccccctagctagtttattatgcatttttatgtgggttctgaaccgatccttcttgatctactagctagaacatttatttatgggagtagctatatttatggcgccatattttttattaaaaaatagtcgctatgtatttacattgtaagtcactaaattacatatgtaattttagtgtatttacaatgtaaattccaaaattacatatgtaagtcctaaaattacatatgtaattctcaaaattacatgtgtaagttgatgtaattcccaaaactataaatttgtgatgacaccaatatttagtttttaagattaattagtaatcctacttagcaaatactaacattaaagcaacagaagagatcagaagagaacaaaatcggagggatatgtgtacacgtgcgatttctgcatccgacggttgaaacaaccaactgaaatctatcgtaatttgtggcgacatatttttagcaataccgttatttatttatttattttgcttatgttgtaggaatggttcggcttcttgacaattattgttagagttgaatctcatttgaccatatcagttttggagggcaaatcaatatgtaagctttttatggcaaatatgatgtcaatcttgaatttttgtgtgcaggggtatccttatcctattctttctgaaaaccagccttctaacggtgttagtctaatttgttagttacatattttataagggttaattagatttataccattataaatttatctgttttaaaatataccattataatttatctaattggaaggatgccattgcaatacttctaaaatcggatacatgccattctatacgtttgagatgggttttgaatcggtttttgtctattgtattttcgtacagaccaaactaccccttatcctaccactcaagcaccgtaaaaataaatcaccatacgacccacagcatttcaaatcaagattgaaatcgctcgtgccagtgcaatgaaaaaaacagatttgaaccacaatatttcaaataaataaactgaaatcgctgatgttaaaaaaaaattcagaatcgatatgcagtatttgatcctgaaaaaaatacagagaggagaaaaaaaagggaaaaaggaaaggaaaatgccactggagctcgccgttgtctccaagaacttgtcgcgctgcgactaggactagctcgcctccgccaccttctgtttgcttcgtcgtcgatgcgaccgttgctgctttctccgcggccagcgttgccgctgccgccgtctccgccgccgccgtttccttcaccgctgccgctgcttgtggtgcgtcgccactgccgaagccctcggtgccccgccgctgcttgctccgctgccagcgccgctgccacttgctttgtgcgtgatgccgaggccctgctggctccgtcgtcgccgttgcttgcttcaccgctgcagcttgttgcgtcgccacagcgaaagccctcggtgccggtgccggagcctccgccgccaccgccgcttgctctgctatcgccactgctcgctcgctcggctagggtttggagctacatttggggatgattttaagctgtgaagactgaagaccaacggtagtttggtccatacgaaaatacaatatataaaaacaattcaaaacccatctcaagcgtataaaatggcatgaaccagattttagaagtattgcaatggcatcttttcaattagatgaattataatagcatatttccaaacagacaaatttgtaatgctatgatccaattaacccataataggaaattcacaatactggatcaaacaagtgacaaatatgccctatttatttataccataacgtgaatgcccctaactaggaatccaactagaactagacttctaatcacataggaaatctaagaaaccagagaaacaacatccccgtacaactccacactctaatctttccaaacttggattccaatccaaatttgactactctttctatacttgcacaacacctcgtgtatgatatatggaaactttcatctccacgtgcattgttctctagcctagacatcccgcgtgatatccttgattgtttggatctcagcttctcccaagcctagtcctaatctatcactggctatactcctatggcctcaagcaatatttgcacatgaactaacaaagaaataccatatttgagtacaagttcacactaaattgactgacatcaacacacaaacaatattacatacatatagaaacaatctagaagtcataaacatgaagtaacatagaaattccacgaaaacaatccgaaaccaactccccacggaatctgccgatctgaccggcaacctagtgccaccctgcactgtttacccgcgaaaacagtattcaccataatttctaaaacactcacttttgactatttgttcatcatataggttgaatctaacaacttgatttcacaatggaaagggctatctctgaacccaatctttaacacataaagaggagagaaggagttgagacgaaaagcatggagcgagctgcctgagagattgaatgggataggaatctcccaatgtggacacttttcattaatcctttcttactataaaattgatgcccattaactcctaaaactcatcatgcaagtgtgcgacatcatcacccacactagcaattattatctagagtattttaaatatcatgcaaacattacgtatcatttacaattttgctgtattattagaactcaatatacaagcaatggcaaattattatctactcatcattttcacattatttaaacatatacatttaccatttttataatgtataacatgcattcattcacatatcccgcaacaaagcacggggtatcaactagttaaactatatataacccctgaggagtaatagtcccccgaaactcttcattaattgaagttggatgctacggattgcaaatcgagaatgaatagtttcaatatgaaacaacagaaagcaacaacatcggtgacaaatctagctcccagctaccaaccagaccattatgttgagtaacctgttgagtaaccagagcttccatcaatcgaagatgttggcctaggtgcaggaaccggtagagggcaagtagcgtcgctgttaagcaaaaccatgacatccaccattgtaggtctatctacagggttttgctgggcacataggagtccgatgttgatgcattttaccacctcagcctcattgtagtttcttcccaaggaatggtcgatcatctctgctgttgtcccctcttcccagtgcctccatacctagcaatagtcacaaatatgtatgtcttcagcagtcagcagtaattacgatagacatgtgcagctatccacaaatatgcaaatattgcaatgcaaagcaatatcatgaattcctatgtgaactaccggggatactcactatgctcaatatatctacaccattttgctcagagaaatatggcccactgttccttctttggcctgtcacgatctctattacgagaatgccgaagctgaacacgtctgatttcgtagagtactgcccgcacatcacgtattcaggagatatgtaaccgctgcatcagcaaggaggattgtatttcattagtttgttagttaatataagcacaaaaatatgaagtattccatcaacttaattacaatgtcccagcaatgcggctcgtgacttctcgagtctggtcctgcgcgaagagcttagcgaggccaaagtccccaatcttagggttcatgtcagcgtccagcaaaatattgcttgccttcatatcacggtggatgatcttcttctgagagtcctcgtgaagatattggagtccccgagcggtaccttctatgatcttaaatcgtgtggcccagtctagctgtttcctttgctctgtgtcttttttcaccaaatgtaaaaaaaatgtcactattattggtggagtgaaatgattacaggagtaacaaatgatcaaagataatgctaatagtaccaaaaagatgggtgtcgaggcttttgtttggcatatactcatagacgagcagtctctcccctttttcgaggcaaaaaccaatgagacgaacaagattcttgtgatgaagtttggcaacaagaattagctcatttttcagctcttgtagcccctggtgagagtccttggccatcctcttcacggccacttcttgcccggaaagaactccctaaataatttagcttagtatcttactttcttactaacttatacatggagacatgaacagaaatacaaaattttgtaatgggttaaaaatataataatataacataactaattttaaaggttactataaaaaatcaaagtttctatgtgatttctttatagaaaaagcaatcttaatgaaagataaccttcataaaaggaattggagaggagacaagcaatatagtgtctacaatgtgcaagaaacaattcaagacctatttttattgccatgttgctcattttgcacgacaatgtgttcttttccttacaatatgcctcctcctgaggtgcccaaaaaaaaatagtaactcgcttcggggagtgcctagacacttgaaattcatcaatttggcattgaaaaaaaatgataaaagatttttataacagaaaaatgatgtctaactctgcaatgcaggttatcttcttatcgtccaactgatccaaatgttggtctatgttattacgatgggaggagcagtatattatgctatattcttagagttagttaccaaaggtcttttactttctatgggtggcgtaatacatataggcttactttttgctagaatttatgtgtctttttaagtctatcaattggttttcttccaaaggtatttgaggatttgtcccatcacctatgtctttttcaagttaacttgttacctatgtattatatggctaaagtcgaggatgtaatatattttcactattaataaaatacaataactaacctgcactaatagtttttctaaacaagaggcaggagcttcgccatttgtttcaagagaacacaaaatttgcgactcactcacaattgagcagtagtgcattcatacttctaggtactcccttcgtccataaatatttgacgccgttatttgaccggattcgtcttactcaaaaaatttaggtaattattaattattttcctatcatttgattcattgttacatatactactactacttaagtttttaataatattcatagaagtttttgaataagacgaacggtccaacatgtttaaaaaaaatcaatgtcatcaaatatttagggacgaagggagtattaggctgtgtttagatccaaagtttggatccaaacttcagtccttttccatcacatcaacctgtcatacatacacaacttttcagtcacatcattttcaatttcaaccaaaatccaaactttgtgctcaactaaacacaactttaatttagaatttatattttgaccatagtcaattcacaccatcaaatcgacacatttttctcaaaagaaatcaacaatgattcagaagtagacgtaaagactactggcctattaccttataaacttcaccgaatcccccctcaccaatcttcttgcttttgtggaagttatcggttgccacttgcagtgatgtcagagataacagtgctgacttgacactttcaaaatcctcggttctatcagctgccaaatttgcatgaatttgacgaaatgttaacggacgccagtgtataagaatgttaatatttatgccaaaattatgtgcagggactcacgtctggagtctgcttttgccaatcttctcttcttacgcacattccagatacaaagggaaattgcagctacgatggcaactgtcactgtcggcaaggtaattaccagaattttgcttgctgaattattcttacctgcatttttgcagtgaaaaataatgagttcaagtacgtgaagaactaaatatgaaacggattacacaataatacagttctatgcttctagctgctgctcagtgaacaaattttagttattttttcgcttgataataatccatcaatctatctatctatctcatgagaaaagaaaagaaaagaaaagaattttgactataaatggtataaatggatcgacaatagttgtatataaattaatttgtatatacaaaaacataaagtaaaagatacccaccaccaacaacaatatgtgcacgcaaaaagtgagagaaaacctaaaaaataatcgaattccttcaatataaaattttcatcgctccttgatatattacacggtagaaatagttttttaaggctttaaaaatatatacaatacactacggtctttgaggaggtaccatgaggtaccaaaaatttagtgtaaaatttggtacctcatggtacctcatagtacctaggtaccgagagaatccaaatttacaatagaaaaaagggtacctcatggtaccttctcaagtaccgtaaaattgctctttttttaaaagaaaaccgttgcaacacacagactgtacgctagttgcatatgtaatataatcatatttatgtaagggagaatagctactatagtccataaagtttcaatgtaggattagtttagtccctaaccttttaatggtctaaaaaacccttaaactttttcataaggcttagaataatccttgggtccaaaaaatcattatatggatatgccatgtcatcattcatgcaaaatctatgatgaattacccaatttacttttacgtatatcatagaaaaagaatgtaagggtgaattagacataaccataggaacaaatacttttcccatttttttcacccttttacgtatatttttactcttacatataccatatatatatttttaacttttttccttttttctaatttttctatgatatacgtaagagtaaattagacaaatcatatagattttacataggagggtgacatggcatgtccatatagtgattttggtaggaccaagaacaatattagcccacgtgacaaatttaaaggacttgtttggacactatgaaatattaaggactaaaatgatctaggagcaaaattttagggatcatattggctattctccctttatatatgtaacataaactaagaggagtataaatcaaatttaagttaacagttaaaatcaagccccgtgcaaaattacccgggaaaaatatgggacagcatgagcgagacgaggaagtataatactgtagtttaattaatcacctcccgtaatggcaggcacaacatccggcgccggcgtgagcccgtcggccttgaccggcaacagcaccatcggtctgccggtatagaaggggcccggccccagctcggacctcaaggagcagcgcgggccggataccctcgcgccttcgccgttccgcgggaacaaaaaccccttccaccactggtccacgaggccgtcgaggcagctccggcactgccccggcgacaggtccggcgagcactgcgccatggagtagatgttacggaaccccgggtcggtgcccacccgctggcccgtggcgaacagcctcgtggagttctccaccgcgtactgcacggtggcgttgaagaactcggtgaccgcgcgg

SEQ ID NO: 30398 - DNA, 2342 bp, Oryza sativa
atggcgtccttggtgcggttgcaggtcggccccgcgaccgcgtccctcgagacgttggtgccacagccggcgcagtcggaggagctcaggtcgccgcggcagagcaagaggccgtagacggtgtccggggcggagccgagggcgccggaggcgaaaagggtgggcgaggaccccgagaaggcgttcgtgcggaggatgagcgcgaggttcttgaggttggtttcgtaggtgctccctgctgtgaacgtgccgccgttgccgcatttcggccacggctgggcggccagcgactcgaggagcgcgaccgccgcgaagaagagaacggcatggacgacagacgagcgtcggcgtcgcaacattgcgccgatagagctaggatgcagctagctaggggcgtgggatagatggcagtataaaactaacacggggtgcatccccttaaaaaggatattcgatcgcgtcaaaaaaaaagaaggatattgatctcgtctttggcaagttgggcatgccatgcatagtccatatagactgaattctctgatcaccattaggtacgtgtgtacttatgtgcatgcagacgtgtttcatcgtttgaacgaagaaaaagggaaatggaattattcaagttggtcgtcgagattaacagtatcttgggaacgaactcatagccgctatttcttttattttttacagctcgcactagacagtgcaaagttcatattgatatagcaggaaaaaaaattacaagattacaaccctacactaaaataaaataaaataaatctatactacctacgtgtatgaaatgttgacatatatatgtaactgataaatctatatactaaagcagggaatacaaatcaactgcaggaatttgaactagtgaaatgggcagatcagcttgacaacttgtatttgattgaaatggcttattgacctaattactattagtagaattcagacaaaactagctagctgacaaactaacaaaactagataccgattgctcacaaaaatataatcaaatcaagaagtcaattaactagcttccatgaaattactagagctagctgaaccaagtttttttttgaggggtaaaagcaggagctctgcctatttcataaaaggagaagagagggaaaccgagcttgtacaagcaaggttacaaaaggatcccaaggggaccccttccaaggtcaagttggtcaagttgaaccaagctgaaccaagttttaaattcacaaaactaactgctgacaaaattagatcaagtcatatttagtagccaacaaaactaacaacaccatgaactaattaattattgattaaactagctgctaacaaaactgcatttagttatatatgaattcagacaaaactaacaaaatcaggtactaattgctgacaaaactaactgttgaccaaattgctccttggcttatacaaattcagtcgaaactaaaactttaacaaaactgaccaccaagcactgacaaaactgacattaagatatttggtttagctaacaaaataggcgaaaaaacaaatttgactgtaaatatacgttaactagatgttgtttaatttgtttttttcgttacgagatataaaagttgaatttgaacttatatgtttgtggagtgttatatcacatgttaatacatcttcttaattttttccaatttttttcgtaaccatttgagtaacatgcaaataacgatgtcccctcgagggattaaaatatatagtttcccgtctagtgactattcttgtttattatgttcaggtcctaacaaaactagtccacaaaattctggtgttatttattgacgacataatatatctagccacatttaaagtttggaaaaaagctagcataacaacattgactcaatatgcatctacatgcatggctacaaaacattttagaatgggattattgtcaacatgttcgcacgcatagccgcacatactaggaccccaaccagcaaaatcgttgagcttgcctcggatgtagaaggtggagcatgacctcggcatcgtagagcacgacgagctcgtacgccttcttgaccagaccattcttgtgcttggaaaaggtcacctgtctgttgatcttgttctcgatccgcttcagctccaccctccccgtcacaatgcctaccttatccacaaccttctcaccctcacgctactgctctacaacctagaaacctttctcctgcagctaacatctagctcaatcgattgatctcacgaaacgaagctatggaatgtacctagacagagaaaaaaaaaggtgaggaggaggaagggaagaggagagtccagttttaaatagg

SEQ ID NO: 30399 - DNA, 1868 bp, Oryza sativa
agtaatgtaggcgtatgaacaaggtacatcaaaggttatcttggtgagccaaatcaacacaaatcttggagtgatctagcggccacaaattcggcttacaaaaccaaaaacaatagcaggtagatgggtagcaaatccctaatttaataataattaaattataaattactccacccatctcaaaatatacatgcctagtactacgaatccaaatataaatatgtaacatatgcaaatcttcacttaactacttcactaacttaagtttgaaattcgcaattaatgattagcaggttgtaataggcgtgcatgcacttttttaagctaaacaagtatttacaaagaaaaacaatatgttagcttggaagactggtacctaccctaatctcgaggttactgtttaacaatataattgcttgtctggtcttccttctcgggcgcccctaatgggacccgcccctcccctatactcctctcccttctctcttttcatcatatatttttttaaaaaaacaaagttagtaaaaaaaatagaaaaaaaattaatactctcattcatgtgcatagactttataccgtaaactttgcacgcataaattttatatatagaaatattctatatataaaatatttgaatccgaatttgaatttggattgggtatataaacttttaacttataaacattcgctctacaaactttagatggataaattttagatgtgtaaactttaggtgtataaacttactaaaagagaaaaataatgcacacataaactttacgtatagaaatattctatatataaaatatttgaatccgaatttaaatttgaatcgggtatataaacttttgacgcataaatattcgctctacaaactttaggtggataaattttagatgtgtaaactttaggtgtataaacttactaaaagaggaaagtaaagcggtgccaaaaatggaaactgcgtgggggggaggggaaccgatcgcccctcgcgatcgatcgctcgataggtttttcgttctcgttaagtcacactatagactcatgccttgcgcagctgcgtgaaaatgtgtcatacaacgccataagcccattttgtgttcccattgatggtcttgtttcagaggataatttctcaatccatcatgttaaacctctattggatgggtcataatcttgacagattctggtgcatgcattgaactttagttcaaattaccggcctacaaatgttggtgagctggattgaagcccatttaacaaggcctaataatagcttttgaatagacgggtttgacctcatgagtttctgttaacggtgaaatttggcaacagtttcttgatttacctcattggtgtcaccttgtttataactaatcatgactataaattaacagcaaaatcatgacatccgccattgtaggtcgatctactgggttctgctggacacacaggaggccgatgttgacacatttcagcacctcggcttcagggtagtttctgtccaaggaatagtctaccatctctacaatatttccctctgtccagtgcctccatacctagcattagttatatatagatctccagttatcagtaatatagatggtacatatgagtggttttctggaaacataagcaatattagtgtattgatttgtaggaattagaagggatactcactaggcttactaaatcttcgttttgctctgcaaaatagggcccactgtttctttgccctgtcacaatctctaagatgagaatgccaaaactaaacacgtctgatttcgtagagaattgcccgcgaatcacatactcaggagccatgtatccactgcatgcagtaagaatgaaattgcatgttagta

SEQ ID NO: 30400 - DNA, 862 bp, Oryza sativa
  unsure (1)..(862): unsure at all n locations
nnnnnnnnnnnnnnnnnnnnnnnnnnnnnnnnnnnnnnnnnnnnnnnnnnnnnnnnnnnnnnnnnnnnnnnnnnattcagggctaaaaggtgggggctaataattagcccatgaaaccaaacaggaccttgtacacaggggttgtgtccccaactcattggtagtggtagacttggtagtcagtgaaagggagggccaggcgctgcttggaaataaatatatcgtgggaatgattccaaaacacatgcgaatagtagtgtttacctcttactgcaaatagattatttcctagaaatacacatagtcaaatctttcttttttgctggatgtatactcaaacctttttaaataattcattgataaaaaatattatgatctaatatgcaatattagtagatttgttatgaaaaatactttcatataacaatattttttaataatttatataaaatatagttagaaaaaaaatatgaatgaaacacgtgccctagagactatatatggcgatgtccaaaacgtgaagtaaaaaataacagaggtagtgatagtgtgttatgcaaatttaggtgatgggaaagaataaatagttgggtaaaaacgattttacccataaccccaagagcaaatatcatacaactaataataaatagaaagagtggaaaagaaattaacactgcaagcttcactcgtgttcatccaacatacctgcgttcaccggagcagaagacgacgccggcgagcccgggagttgcaacagcggctggccgaaagagaaaggatacgtctcgaacccgaagttggaccgtacgcccaacacgcgcccgncctttcttccggctaaatacgtgggcaccatcctcac

SEQ ID NO: 30401 - DNA, 1203 bp, Oryza sativa
tgacgatctctagtaccaaaacgccgaaactaaatacgtccaacttgactgaataatgaccatgcatggcgtttcaggcgccatgtatccactgtaaaaaaacattacattgtaccttattatatttggtataccatatttgataaatgttggccatgatcatgttaaaattcaaacctaacatatcatacttactacttactatgttccggcaattcgatgagtgatatcttttgattgatccccatcaaatatcttcgccaagccaaaatcagaaatcttagggttgtaatcaaagtctaatagaatgttgcttgctttgaggtctcggtgcactatcttcaatcgagaatcttcgtgaaggtattgcaagccttgagcaattccatttataatcttgaaccttttgccccaatctagctctatgtttttgtctatatctgtcattcaaacaagaaaaaaacatactattaataattgatgttgtcaattaagccttttaaaagaaactactcattagttttatagttttatattacaagtcgttttaactttttctctactcaaatttctttagctttgatcaagtgtataaaatttagtaacatcgacaacaccaaattagtttcattacttgtagcattgaatacattttgttaatatgtttgttttgggtcaaaaatatcgttatattatctacaaattttatcaaactaaaaaatgattagtaaaaaagttaaagtgtaagaaacacatggagtactggagagaaaatcgtaccgaaaagaatggtatcaaggcttttatttgacatatattcatagacaagtattttctcttgctgttccaagcaaacaccaataagccttacaagattcttgtggtaaagcttagcaactaaaactagctcacttttaagctcttctattccttgtccggaactctgacaaagtcttttcacagctacttcttgaccttcaggcaggactccctatccatgtaaacatacttactgatcaacaaaaatataaccgactgataaagttgcatgtcgctgtatgatttgtaccttgtaaaccataccgaaccctcctctgccgatcattttagtttcagcaaaatcatctgtagcagctcgtagtgttgatagatcgagtagaagcgaatcaatactttgaatatcgtctgaaccaattgatgttg

SEQ ID NO: 30402 - DNA, 620 bp, Oryza sativa
acgtatggtgggttaggtgtccgcctccaggtgcccacctacccgcatttatggcatcccgagcggtcgcgccacgccgcatgtaatacggtgtgcagtgcactcaaccggtctgtgaccgatcgaatgaatgatgggacccaagatgtcaggcgcaccatcgcgtgtgtcaggcgacgtgtagcccgacatatcccatcaaataatgatggtgagaggttctcatcctcttatcccagccggagtcggtcctcccgctttggtcaaagcaaggctcctgtttcccggtgtaataggagcccagaagtcttcacccattaaatggtgactgacaggggcaccccccgtgtcaggcggcaagatttgacaggacccatcatcaagacgacgtgtgcttggcttcccaagtcaagagacaagacatgcatttaatgcaaatattataatacttatccaccggagctaggttaggttgttgggcccatatggtaaccccttgatgtataaaaggaggtccaggcctagtggtggaggggggacttccgagcgaactggcgtttgggtctcataaccccaagcactggtgttctacattcaatcaatcatgcacaggagtaggg

SEQ ID NO: 30403 - DNA, 672 bp, Oryza sativa
cgtcaccatcttcgtccccaaggactcggcgttcgccgccatcaagcagtccaccttttccaacctcaccggcgaccagctcaagacgctgctgctgtaccacgcgttccccaagttctactccctggccgagttcaagaacctcagcgagctcaacccggtgaacacgttcgccggcgcgccgtacacgctgaacctcaccgacgacatgggcaccatctccgtgcagtcgatgtggtccaggcccaagatctcgagcagcgtgtacgccacgaggcccgtggcggtgtacgcgctcaacaaggtgctcctgcccatgcagatcttcagcaaggacccgccgctggcgccggcgcccgccccggcgccggtgtccggggcgtccgacctcgcgcccggcccggcgtccggcaagacgggcgccggcggcggcaaggcggactcgacgagcgccgcgtgcggcgtcggcgccggcgtcgtcaatggcttggtgatggcattggctggtagcttgatgctcctgtggtgatgatcagagagagagagagagagagagttcttggagtcaaatttgcaacagcagcacattgttcatgcttctccacacttgattctattttgaattgatttgaaagagccattcttttggacatagtaggcaatgtttgtagg

SEQ ID NO: 30404 - DNA, 592 bp, Oryza sativa
catccggtagttgccaaaggcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaaatggagcatgtcacattaaggaggagtcttgcactcttgcatgtgttccacttccttttatatgtgagcaaat

SEQ ID NO: 30405 - DNA, 697 bp, Oryza sativa
gaattctcgcgttaatttggctaccacgacctcgtaaaggccaaacagcggggatcccgtgattagccgacttccaaagcatggcctcctctgcattgctttcgccacttcggtccaagacctttgttgttgattgaagattcggttgttctgttccttccaaattatccaagtcaccagtgtcacgacttcacgatagtgtcacgaccagtgtctcttctttcttctctcataacaccaagtaatctcaattatttttaggcctcaaaattcataagtaccattttgttttatttttaatattcatatttcatcttatttgtacatattgtgcaacttaatttcccgcaacaacgtgacagagtatttatctagttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgt

SEQ ID NO: 30406 - DNA, 560 bp, Oryza sativa
cccgaggtagggcggcgaccactccttcccagagactggatggaggaggctgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatat

SEQ ID NO: 30407 - DNA, 1661 bp, Oryza sativa
  unsure (1)..(1661): unsure at all n locations
nnnnnnnnnnnnnnnnnnnnnnnnnnnnnnnnnnnnnnnnnnnnnnnnnnnnnnnnnnnnnnnntgtccttatcggatgtcatgtttgttaccaaacgcaacatgaccaaagctgttgagagtatgtcgaagcaattggatcaagtgtcttcagctttagctgtatgctttacatgctgaatcgttacatatttgaagtagttttccttcgcatatgctgactagtgttttctaaattcaattaatttcaggcaacaaaaaggcatctaagtcagcgcctggaaaatttagatgggaaaatggatgagcaagtggaggtctccaaaattattagaaacgaggtttgttgatttgtgatgctgctagcccttcaactttttacacatggaaatttttgaagttcctttttttttttctctggagcaataattattgtttcatttttttcattacatcaagtctaattagcatctgataactttattattaaattgtgtttctacctgaggtgcataactcttattagtttgatttgtgtagtcgcatctgaaaaggtggatcaggattttctttgtcatgccaatattgtttcaagctaaaaactgtgccctcgataaagccaggaagcacttgacatggctattataggatatgcattgaaatatggtggaattgttggcttttactataatcattgacagcatattccaagtgatcgatcttgcccataaaccataaaacaacatcatgaagccaagaatatatacaagcgcaagcataagcataatgatatttgtcatcaatgaatggtctttagttgcattaaaatataccttcttaaaaatagctactgtaaatctgcaagtactcatctatggaaagataaattttacagcatttttcattttcttctcgaaagcagaaaagttttgttcttcccaatgttatgcaaaagacatgattctgttctctatgcacaggtgaatgatgtcaaagatgatctgtctcaaattggatttgatattgcagcaatccaacagatggttgctggattggtgagttttattagtttataacccttgagcatgaacctgtgtcagaacacttctttggttatcctgacctttatgttctcctttgacattatcaggaagggaagatcgagttgcttgataataaacaggtggctaaacatacccatcaatatttaacgtgctgattttttccttttgcctaacctcttgtgtttaccgacaggatgcaactaatgctggtgtatggtacctctgccaaatagctggaggtctaaaagatggaataaatgccaagttttttcaggtgagtagatatcatttataaaggttcaggattgcatgcaaggtctaaggatgccttatcttggatagttcgcttttcttttggctcatactgctcattgtgctgtaatgatccttctatgctctccattccacaggaagctaatgaaaaactcaagctcacagagttggctcagtctgaaagaaaggcagtgaaggtaatacacaattaatatgcagatgtttgtcctccattcaggtaatttcggtttctttatgccaatccatatnnnnnnnnnnnnnnnnnnnnnnnnnnnnnnnnnnnnnnnnnnnnnnnnnnnnnnn

SEQ ID NO: 30408 - DNA, 1253 bp, Oryza sativa
catcctgaattcccactttttgctatcaaaacttagaatactcctgctggatcctcttagaaaccaatatgttattgttgcatgccttgagcattacctttccagggttgacaagaaaattcaatatgtttaacgtgtaatcatctttttggtctatttacaaacgttttccatttactctggagaacaaaaaaggcaacccccaccatgcaacaatatttaggctatgtacatggccagatcaacaacttcattgccaacgacaataagtcgaaaaagaaaattttaaaaaattcttgcaaaaacaaaacaaatgcattttttgaacttcatttttgcttatattatgttatccccgttgagactcaattgtcagtccttaattctatcaaacctcttcaagtatgcagctctaggtgttgagaagtaagtacattccgatttgcccaaactagtaccccacacataaactgctaatttattttttttttcacttccagccttcataatctggagagttgcttgtttgtccttttcccttacttctcgtaagcctatctttgaaatttgttccatttcatgttctctttaaatatctgctgtaaataattgccagttgtttgtaggtacatgctagctgaaggctttggtttgtctggtattgtctctattctgtttactggaattgtaagttagcctgtgacaatattttctctagattttattcttattacatattatagataagcaactttgcaggaagatattataaacatgcttacaagaagtgaatttttatttcaggttatgaagagatacaccttctataacttatcagaagattctcagcgttttacagctcgttttttccatctactttcatcactagcagaggctttcgtgtaagcaagaccttcaagtgcaataatttaacaagtccaaatactgaaactgtaatgcatttacacaggttcatatacatgggatttgatattgcgatggagcgtcaaagctggtcacatattggattcatttttttctcagttgtatccttcgcattgattacacaccaactcttacccatgcttgttacgaatacaataatttcttcttgtttccttaatttttttcccttttgcttatgcatccagatctttatattacttgcaaggtattttcttctccaacggaactgtctatcttttggtctgatgttggactagttgctgagtttttggagatgctttctgtgt

SEQ ID NO: 30409 - DNA, 629 bp, Oryza sativa
gaaattttgaggagacgatctttgataacagggtatcgagacaagggagggatttaaattgagatctttggcacaacttagactcaacactcaaggaatgaaattttcgcaattaggatttttgccgaattagtttttaacgtctcacgaaaagcggagcgttacactaactgagctaccacgcgagttaaaggaggaggagggcgagcgaggaagaggaacggagggctatcgcttcgggacagggcgccgtgacgagcgacggcggcgcgggagcaagctctccgggagcggccgggaaaggggaagaagaggtgcccggagctcctcgtcacacgtccatgcacgcaccggcctccctggtgcttggcgacgaacggcgacggtgcgagccgagcagggcgacaaggcgcggcaggcgaagacgagagggatagagaggaggaggagcttggcttgggttttataggcacgggaagtcggttttgggggaggaaaccgacttaggtggtcaagggagctcggctggcagtcgtgctcggagctagcggccaagcggcggcagtggaggtggtcacgggtggccgggctgagagggaaaaagcaaaaaggggagaggaaaggagctc

SEQ ID NO: 30410 - DNA, 8477 bp, Oryza sativa
tgcctccattgtttggaaggacgcgacttggagcagcggacagggggtgacgccggtggtgaccacggaggtctctgcctcccggttttggatgctagcggcgtgcagcggcagagcggcagcgcgcgaaattggtccatccaaaatagagggatgcaaaatagacttcttccaagaaattgatttggagaagatttgaacatggaatttgacttggacttctggattgggatctggatgagaggaagggtctaggaaatgatcaaaaggggaaattttggatattttgggggtcgggcgaaaatttggtgaggatttcaaagagaggacttgaattttggaatttgatttggagacttgaatcggaattggaatctcgaggtgggcgattttgatggcgacgagagggaacaacgatggagattgaattgagatccatggcacgacttaaactcacactcaaagaacgaaattttcgcaattaggattttgccgaattagtttttaacgtctcacgaaaagcggagcgttacatctgcacccttgaatcgagcagggtgagaacgatatcatgcaggaatccggaaaactcaaatcataccttaatgggaaatcctctcatttttgcatgtcacttaaaaagtcatcaaaaaatttgaaaagatttgataggatagaccaatatgtgatatgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagccgtacagatgccgtattgcggttaggaaaaagaaagaaacaaaagcgaaaaacgggagtcgagaaggtgtgcggcgccggcgtggttgtgattgacgctccgaggcgtcgtctcgcttccagtagcccagacggcgcgccgttttcatgggccttagaccttccacgacttgctcataggtcacgggtgatgcacgaatttaggccgaggggtttcccatgtgatgaaaatagggggggtaagtactaaagctaaaaattggaccaggtgcctgagaacccccttcgtctattgggctccgcacctacggccacggcctcgtcgtcaacagctgggagccccagccgagcatcctccgccgccgtgttcgtgacacactgcgggtggaactcggtactggaagggatcaccgcgggcgtgccgatgctctgctggccgctgtacgcggaacagaggatgaacaaggtgctcatgggtggaggagatgggcgtcggcgtggagatggagggatggctggaagggcgtgtcaccgccggcgaggtggaggcgaaggtgaggctggtcatggagtccgagcaaggaaggaagctgagagaccgcgtcgaggcgcacagggaagccacggccatggcctggaaagacggcggctcgtcgcgcgccgcgttcgcgcagctgctgtccgacattgacgacgcccgtggcaagcagagtagtgtcagcgtttagctccactttagaacacgaaaataatttcacaattcccactgaaatcatgtttgtagtactcgaaatcgtttcatcgaaacgttgattttattgctgacaccaaataattcagatcaaacaaaattttccatcccggattacatagctgaaaggctgaaatgccatttcagcaagaggacagtacgcacttgattagtatacactctgtaaatactacaaaaatctctcgatacacctgcaaatctgtaggcagaatctctgacgcctggcgatggcgatggcgatgatcaggcagctttggcgagctccctctcgacggccctcttgaggaagctgccttcctcgacgaccatctgaacggggaggaagccgaggccgctggcgacggcgagcatcacctccttcatctcggcgcggaactcctcacggtcgacggcgccgtcgccgtcgcggtcgaaccgggcgaacaggccgcggtacaggtcgacgagctcggcgtccgtggcggcggcgccgtcgacgccgaagtgggtctccagcacgcggaggctcatcagctcaccggccatgtcggcgtaggacagcctgccgtcccggtcgccgtccagcgccgcgaaccggtcgtccaccgtcgagttgaaggccccctcgtcctccacgaagctctccaccgtcctcccatccaaaatctccacgctcatctcgcccgatcgaattcttggctagctctcagctggttcaggtgttgtaggtgtttgacgagatgtgagaacgagttgccgctatttatactgtcgaatccgcgtgtctacaacgcgttaattaatcagattattgcgcatggtttttggcctggtaatatgctgtgggatgtgccaatgttgacgagttgtttttcgccaagtgaagaaatgctaaacgtaagcaaagttcttgttcgcctcgagggagatacgctagctgttgtataaagaaaaggagaggaagcccatggattcgggccggtttaggcaggttgcagatcatatgacagtgacagtgagttggaatatcattgacaggacgcggcgaatctgcgccttgctctgtgcgtggttaaattaaacatagcattgctgcagaggcagaagaagcgaagaacttttccttcatttattgttgtaaaaccaagcacttacgcaaagcttatgttagcatgtgaatatagtacgtgcagttgcagttgagccaaatagtactcccttcgtcccataatataagggattttgagtttttacttatactgtttgaccatttaactcatttaaaaaattttaaaattattatttattttttttgacttactttattatccaaagtattttaagcataacttttcgtttttcatatttacacaaattttttaaataagacaagtggttaaatattgtaagcaaaaacttaaaaactcttatattgtggtgacggagggagtaattggcaagctaactttggtccgtagctcaaatcaggtttggcaacttcatcactttgaggaaaggcgtccggcagaagcaggcaagcagcagcatcagcagcaagttggtcgagatagaggataccatgaaatgaaacagcatgtgccaagcccactttaccacaccgatggtccttactccttaaacttgtgccgatttgtggttggtctgccgacagacatcacctcgatcggccactggtttctctcgatttcaagaagtttctatgatgcccatgtactctcatcatgtgaggcccatacggtgaccaacgaataggactcctacggccccatcttttatgtatgcttatgtttaattattaaccaaaatttaaattttaatattaaatttaaagctgattttgagatttttttttcatcgaagtttatttttcagcctttacttttaggtcgttaagaacacgtaggtaaaagttttattcacaaattatttatcgttttgggtttgtttgtgggtcccgataggatgtgcttttggcataaaattacaatttgtcaattcaaaagcatacatattcagttaaaaattgtttcaagttgacttttatatttaaaatattcggtttaaattttggtccccaaaattgtttgcattaaaccatgccaatgaatgaaatgtctaccacgcatcttgtttttttttggcacagtttgcccctaaaacaatttcgccctaaaagtgtgcgtagggtagtttagacgccacaatagaaagttcatagaatatatttttttctttttgaaattgttttaaaattcttctaaaattcattagcaaagtgcatatatcaaataattttgggatggtttggttttaagcctaaatttggcttaccaatatttggcaatttcaatagtgtttagtgtctatttggtttaaagccaaattttggcatgcctaagaaaatatgccattttaatagttaacttaggctattttggcttcaatccaaatacaactttaccttctcaaaattagtcataccaaaacttaccaaaaattggtaaggccaatttaggccacaaaccaaaccagccctttatacataaagttttaatgtataaaatttatgcaaaaattagtagtgtacgtgttaggctagtataaacccactcaaattccatgggccaacgggcctcctaagggaaagggaaaacgggcaggaaacaaatgggccacgaaagtttatgcacgtgggctgtattggaaatttggaatgcatttgcgtaggcctcggacacggcctactaaatagaactggactgcaaaagcccatgtccccaaagcccaaaaatctgtgagcccaatagcctgcttccttgatgctctgaagtctgaattgacaggcatggcatgccttgcaagagaaagaaaattgctttcgatttgcctttttctttgcgtggatggatgcattgtttgaacgatggcggcagatgtggatgtttgtccagcaaagcgtgtgcttcgtgacaaccatttctccccgttctacgtcaatcctctccttttcccgtgttcattttccggtggttatcgtgtcattagtccacaataattgcattccagggacatctcctgccatgctgaagaataaggcatcgtcatctgcatgcaggaatggaaacacatagtattagttttttttattttttctggtcttggattcattaaacaaagctatcaaatgcaatgcttttcttcggtgtgatgggaaggaatcatgtttcatgtggacaaacatccctgctacgaaaatgcagagtcgattatttaggagatgtagtaattgtttagtgatttgtttccttctgatggccgtaatgtgacctgaatatgatgttaaagattttggggatagtcaaaaagagaaagaaggttacatgcgaagttctcagggattgcatcaccctacagtttaagggggtaggttaactagaagtgatccataagggcagcaaccacttaaaacaactgttctattcaagttcattagagaagtcagaggtagtgaaaggagaaggtgactttatgctactgagtagtgagtactagtataatcttgaagtaggcattgattgtttaatattaaggagtagtgcattgcttactgcagttctagaagaaacaaaaacaagggctctgttcttggcagaatgactttaaatggaagaaatagtatattttaaccaatgttcacgtttcttggaaaggagaaaaacaagttgaaaattggattggtttcattaattataacctgctggcctccaaggaattttatttccacaatgtgatatattaattaagaaagctcaatatagcttgatatgcacaaaagatatgatattgttgaaatgtattggagatagtctgtacacaaagttatatttttttatataggaataaaaatcattctgtcggtagtaatttttaactgagtcatcgatatagatatgaaaattccaatatgctgtcagatccgtcgattttgtagtcaatggattttaaggatctcacttgattggaaatgacgaagcggtacgaaatctattttttcttaaagcctaattggcaatgacagctcatgaaatgagttttcatttctcggatgattaacgagttgttacctaccgctgaacaattattattctacatttgatgcaagggaagatgcttaatcccaccagatacaagctgcatcaggccatcacacgagtcaagtggtcatctcaccgacactacaaaatcagctcaaatagctcattcggttatgatttccaattattcgaatccaatttttatatactatgttcagtatattttattatccttgctgcttttttttttgggggggggggggggttcacaagaaagaagtacacaattaatcacaacaatactctatgaaaattaaaagtgtacaatatttaatttgtcgccgggcattttctgtttaatctgcaacaaaagctgccagttacacatagggtgcagttgaaaaggtgactagaaatggaagctatcgtacctttttaatgtgattatactttaacatgaactctattcaagagatgtattcttttcttttctggaaatatcattatcgggaagcaaaaaaagctagctgatagcagtttgccacattttttcatggaaaaaggttctatgtttggttcctttaaggagaaaaaatgagtttggtcttagtactttgagtatcaagcaagttgggggaatccttgatagaaatggagcattggttgcgttgtcaaatttataaaccacacatgataccctaaggcctaagctgaattggattcttccgagaaatagccttgataatcaacttctatactatactcatcagtgtcttctgaagtttgcagtacatggtctgagctccagcaaagagtgattccctttcactgcagatagtacttcaaattggaatttctgtgctctgacctttgaggacacacccttacttctcagtacattgtgcaatcttctttgtcctgcatgcatctgtacttgcaaaatatgctaaaatatttttgtttgtctaatggatctaggtgccagacagtgaatagaaaaattacattagtcatcttacagttttgaacaagaacaattaaaaaatgccaaagcctgcaagttggttttgagaagtcagatttgcgagaaatacaacactgcacaattacaagttggactttacattaaaactagtatcttggccagacagtacacactccagggaaaaaaaagagtgcgaaaaatacacgtttgcgccatttgttcccatattacatacaccaagaaaaggcaaaacattacaaacatcaaatgtgaagaggaatttatcagtaaatgtgagataaatgctaccctatttctctcaaataaatcgaaacaaacagaatggaaattatcgtgtacacttatgtatcggtgatccgtacacgatatgcacgaggtacaaaaacttaaaactaattctacaagcacttaataatggtactaacactaaacaagcagtgcaatttactcaagaacagggagggaagaaagctaggacagaaagaaaagggcagctaatacctggccagctttcattatgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcaggtttgcagaatctgaattctcccctgcatttgcaatgcaatttggagttgttgttaccttttgcaaatttcatagtttcatctcattgagtcattgtggttaatagcttggggctacttattgttgaatgtacttttatgcttatggtatattttgatctttttcatatgtaattcttgaatgatcttgagaaattaagattttttttagcacatgagggtatctctttttctttaagtcgaagcgaagattgttgtgtatgcttggtgtagactcttgaatgttcagctttggtagttggtccttctctttttgtctttgtgctgtgctgagatctaaaagacataagtatcttttttgttgttgaagcaaccagtttatcatgtgtcctgattttggtaggtgacactatcagactactactataatgtgaccacctaaactagatctaatgatcgtgatgtcactaagcagttcagttcaaatacagatagatctcagccaaaaaacaaacaaacattttggtttttatgatcaagaaaattcatcttgcattgatcactgtacaatgtacattgcttaaatgatctcagggatcaggatcagaggagaagagaagatggagttcaaag

SEQ ID NO: 30411 - DNA, 7657 bp, Oryza sativa
gaaagagccattcttttggacatagtaggcaatgtttgtaggatcgaattggagtatttttttttacaacgtattacgatcataattcataattactcatctgctgatggatgaatgaatatgaaaaggggtttctcttacatttctactacatctcttctgctcctctgtttgacgatgacatttcactagttcattattcagaaaaacaactacgtactactataattgatttttcaagaaggaaaggaagatcactactactccctccgtctcctagtaatttatccaaattcgttatactagggagggatatcttcggttacttttttttttttagacgaagggagtactccgttgtgaccgacagtgtaggtctttgatgaatcagtcccttccatgtacgaaatgattcatttcaaatcactcccattgatgctcaccaccaccagccacgtgagccatgtcatggtaagatatgttcagtctactacagtacactgatgattgatgaggttgttccatcttggcataaacaacaagtgtgagatgaaccgtcattggcgagtggttgtgccgagttgaaagattcacagataggactataggaacacgtagtttatgttcgaaattttgaaggattcttcgcttgcctttggcgtgtcgatcgtccgtagaaatttagaggccaaccatgtgcgacgagcatatggtgtgctcgtctcctcacatgcggttagttttttttgcgtgtccagagattctgttccggtgagaaattaatgttctcactagttcagatcttcggttcgatccccatttgactcgtgaattattagtctaagtttttgaacatgtgttcgtttctctactggagtaagagtatgttagtagcagtcagtcagtgaaacactcgggaagtacgtttctcaagtcaactttactacagcaagcccttataactctaggtacttatcttttcgcttttcgcttatgattatacttatcagccaaaatttaaatttttaatcttaaatttaaagttgattctaaggtttttcatcgaaatttattgtttagccttttttttttggatcgctatgaatacgtaagtaattatttttcgtttacaaatataccgtttcatgaaacgatggctccatactaactttactacggaaatcaccaccaccagcagcagcaagcaagcaagcgaacaccggcgtcgactcttcggtcgtcggcgccgagccgtctctcgcgagtcgcgcctcgtgcatccactcgcacaccggcggtgtcgtgcgcgcggcgcggagacagtcgcggttacgaggccgtgggggccttttttccgcgaaagggacggagatgatggtgcgtggctgttacaggggctgtggcctgtggcgtccgcgaacggaggcccatgtgcaaactcccggaagtttatcactgccgcgcgcgggatcagaggcagcgacacgcgcgggccgtgggctggtcgggtgaaccatccgttgccggttgagggctcctttctttctttctttctttttttcaaaacgaatggaggagcgtcaatataaacaaactgtacagtaaggaaaaggagaaaaagtaacggaattgctagaaaacttccgtaagtttttctctcaaagcttgcagatttgtagtcatcggatcgcttcgagatttgtacatactgagaaaaaattgctagaaaaaattatcacacatgtcacgtgtaaaatcccgatgatagtcaatcaaatcatagttaaatacaagttttatataggttacagtataattacaatacagttatatttctattatactatagttacttctaaaagttcttcactaaaaaaatttgcggcggtattttagatactcccaaaagtaaaagctagatccttaaacccagctagtgactagtcaaccaagtagccaattttctgaggcccttgggcttctccctgatctttgtgactaggccggttgcccagagctacttgtgctgaaaggttcttgattcatttacttccaaatccctcgcgagactagcagtattaacgtgcggtgcggactgtttgatttggtgctcctttcgaacacatgagtagaaagtcacaaaaaaagaagaaaaacatattaattaaatgtcatggcatatgctattatatgaaaatttaaaacattgtaatttgtcaaatgagttgtttggatgctcaacatgaattttacaaggaaaatatccgcatggaagtatgactgtaaaacatctaaaggagtaaagtacaccgtactatctctgtttcatattataagtcattttatctatttttatccagtcaattttttttagatttaatcaagtttatagaaaaaatttagcaacatctataacactaagttagtttaattaaatgtaatattgaatatatttttaataatatcattgttttgtgtttaaaatattgctatatatttttaaacttgatgaaactttaaaaaataattagtagaaatggttgaaacgacgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggtatggaaattaaacgcactaatagccctctggactctggagcatgggcatctgcatacccgtttaatgccatcagcatcaaactaaggtgttgctaggcaaatcttcatataagttttaaaattttatttcagattgatttcagtggtttacttagtaattttcgttcattttcgttgcttgttaatctacctaaaattacttataaaaaatcatattcgaaaattcaaaatcaaattaggtcgtaatgcacgtcaaagtcaagtgcggtatgttaagggtctattgggttcaccgattgaaaaaacagaactgaataatatttcctccgtatcgaaataaataaaattaatattggatattacatactatagtactacaaattttagatataaagtaagtgcctacttcttctgtaaaaaaacaaacctagaattggatgtgacaaaacatagtataataagtatggacatacttgttataaaagtggctccaaaatcacatcggaaaccaaacacggaagaaaacgctataagatcaatgtgtgttttaattcttattctgtgataaacaattggcatgttttggagataatcaattttcaggtgatgatcggattcactgttattttatgtgaccggtccgaccgggtggaggttgccagtcagaccggtgctatgtgtgtggtcagaccggccaggcccgcggtctgaccggccgacgctgagtcggtttcggtttcgggttgtttctttggatatccgtgattgtttcatggttatggtttctagatggattctatacgtatgtaatactgttgtttgctactaatgagtcaagttgggaatagcttggtctcggaatatggtttctgtcacgcctggaaattcactaataatttccgaactaatttgtgcataaaatcctcatccaggaatcaactgatgtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatacttaacaagccacacagcaaatatgcaaatgcacaaggataccaaaggatggcacaatatagtctcatttgcgaaagcagcatttagcaaagagttaagagtagtaaaacagtagagtaattaattagaaattttaatcaacactgaacagcacacccatgctgcacaggcccaaccatcctgaacaaccatacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagcttgcgaaccggtccttaattgtcatgagcgcgactctcaaaaccatgtgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccggcgcactcgcgaaccttcgaaacgacggaaacgacaagctaacacgcaaaacgaagaaaaagactaataaaaaccaaataaacagtacataaaaaataaacaaacatgtagatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacgttaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccagagcacgggagacgacgacgatgacgtcagcggtgacgtcatcaccggcgacgactcgggcacgcatgcccgccggcgaacgacggcgcggtggcgcgaaaggagagcaccaaaacgatgcgggcgacgcggcgaactcaccggtgaccaaaacaacggcggaagatcaacggacggcaacggcgacgaggaagaagcggcgaagaccttcggcttgacgacggcgatggtgttccagcggtcgacagcgacggcagaggggcggacgagatcggcgacagcttggcgatcccgatggcggctttcccgagcgacgacgacgaccggagcgacggcggcgcacggctagacgaacggcggcgacggcggcgcaaaagctcacggggctagggcactacagacggcggcgggcgaaggcgagagtggctgcgggtagaggggagctcgggggtccttttataggggcaaggaggcagcggcgaaggcccacggcgaccggcgacgcgaaggaaagtttatggttcggagagagagacgaatctgattcgagatcgaatccacgagtttccaaactgaattaggcgatgattccaaaagagaaaaggtagaggagatcgagaagatcatttcccctctattgatttcaccggatcgggaaataggcgagcgaaaaaggaaaggcggcggcggcgcggctcggctagggttcggccgggcgacggctggaggaggaagacagccctgacaggtgggccccacctgtcagcgggcggatgcgcgcgcgggtggctgctgccggactgggccgactgggccgagggagagagaggttttgggccggctttctgcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggattttcaaacaagaaaagctcttaacaattataattagatcattaatgatcaaataattactgaactgttctttgtatcatttaggaattgagctccaaaaaatccgagaaaatttcagagagtatacttaatcatagagaatttaataaaaattaaatccatccatgctttaaatttaggaaattttatttcccacatttaacttcacttgtaaattaatgaacgtttaatataaattctaataataatttattaaataatttataaatcctgaaacaaaaatcaggatgtgacagtttctttgtttgtttcatgtgtaggtgactcgatgcctcgggagagtatttgcggaaatgatcttctcgatctcctctaccttttctcttttagaatcatcacctaattcggtttggaaactcgtggattcgatctcgaatcggattcgtctctctctctgaaccctaacctttccttcgcatcgccggttgccgtgggccttcgccgccgcctccttgcccctataaaaggacccccgagctcccctctacccgcagccactctcgccttagcccgccgccgtctgtagcgccctagccccgtgagcttttgcgccgccgtcgccgccgttcgtccagccgtgcgccgctgtcgctccggtcgtcgtcgtcgctcgggaaagccgccatcgggatcgccaagtgtagcgcccgttccgtcgtggcgcctagcgggaaaattatctcttaaaaaccctaattgtgaaatttgtttctttgcttgttgtctagtgtccgtgccatctcaagatctcaatccccgatctatcgtcgagtccaatcccgaatccaatccttcca

SEQ ID NO: 30412 - DNA, 4107 bp, Oryza sativa
  unsure (1)..(4107): unsure at all n locations
nnnnnnnnnnnnnnnnnnnnnnnnnnnnnnnnnnnnnnnnnnnnnnnnnnnnnnnnnnnnnnccgtttgttgttgcgcgtgtcgaaggagtcagcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcgtcgtgtgctcgccgccgtcgccgctcgagctccgtagcacccacacgtcgccagcctcgctaggcgtagctccgtccaatccgacgctagcatcgagttcccgaaaccgcgtagatgctctcaccgccgggaatcgatccctcgtggcctcgccgccgtttccctcttcccccccctccgccggttgtcgccgccgtcaagcttcctccggcaaatccgagccgttggctcgtctcccctcatcacgagcaaccgcccggtgtgctcgcttttgtccgtatcgccgtggttcgctccgccgctcgccgccgccgcccgccgtccattcgcggccgggtcatcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagccctgtccaccggctctctctctcctccctcccgcgcgcgcgcgtcttgggccgctctgggccgccttcttgggccggccggcccgttaagctcggccgagccgccctttctctcgggccgcgccctagccgcccgagggaagtctatattccctccctctccccttttcttttctttttcttttccaaaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcatgcttagaggtcattaatagggctttattttcgccgtttgttgagttgtcccgttttgcgtatagtttcggagcccgaagacccgcagagcgaggatttcgaggatcaagctccagatctcaagcaaggcaagccacctttggacatcttgagcctatattcgaaatctaattatattgcttgcaaaatattatgcattgataggattgcacttaatctgttgttccgtctgcaaggcagattggcagacctacctaacttgttgcatttgatccttccattgttaattgctataccatgtccccttgtaatcatccagttgcgcctcgatattcgtgcaccctgtgccagtatcgacggtcgccttcaaacttaaaatctgagtaacaacttgcgtaaaactggagttttacaaaagacttggaaaacccgacacctgggtcggtgcttgcgaactaaatgaatttccaaaaccgcggaccgggaaacgtaccgggtgtatggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcataaggtaaacctgtgtcggctttggaaatgccttgccatgaaagcttggaggtctcccgacgtggctgatccccacgggctgggtgatccgggttagtaatgtcgtgtgggtaaagtgtaccccctctgcagaggttaacaaactgttcgaacaggcatgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgtccgcccctccgccgtcgctgtcgaccgctggaacaccatcgccgtcgtcaagccgaaggtcgtcgccgcttcttcctcgtcgccgttgctgtccgttgatcttccgccgttgttttggtcaccggtgagttcgccgcgtcgcccgcatcgttttggtgctctcctttcgcgccgccgcgccgtcgtttgccggcgggcatgcgtgcccgagtcgtcgccggtgatgacgtcaccgctgacgtcatcgtcgtcgtctcccgtggtccggccgtggaccgatagatctcggccgttcgttttggttggatcgatctcggccgttcgtttccgtgagccgccgccatgcacccggtccaccatgaacccgacccgctgacgcaataatcctcttttccttttcaaaaataattcattattgcgtcataattcaattaaaacctatataaaggatttaatccgatttaatcttcggaaattcataactaaatcatcgtaactcggttttgagtggttcaagttgctaaattcatctaaaatcatgatctacatgtttctttactttatatgtactgtttatgcttgtttttgtactgtttatttggtttttattagtctttttcttcgttttgcgtgttagcttgttgtttccatcgttgcgaaggttcgtgagtgcgtcgggagtgttcagaagattaattgaagaccgattattgcaaggaaagtcacatagatcctaaacacaatcctttgagcatgttgatcctatatttaaattctctctttatttcaactgtgcatttattttcgaatgtcactaggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaataatagttcacgatagtcaatcgtgattggttaattaattacttgccactaaacttgataatggtgggttgtgagcatattgttttgagagtcgtgctcatgccaataaagacccgttc

SEQ ID NO: 30413 - DNA, 12274 bp, Oryza sativa
atagccgtgcccgcggttatgggctttttgagcaatgtttttcgtgattagtctcacacctctcacaataattatggatgttatacctggtaataatttgcttagctcctggtttggagttagatctgtatagccgggtatggttgttcaggatggttgggcctgtgcagcatgggtgtgctgttcagtgttgattaaaatttctaattaattactctactgttttactactcttaactctttgctaaatgctgctttcgcaaatgagactatattgtgccatcctttggtatccttgtgcatttgcatatttgctgtgtggcttgttaagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtagctcggctgattcctggatgagaattttacgcacaaataagttcaaaaattactagtgaatttccgggcgtgacacacacataaagtactattcatgttctatcgtttaataacaataaaaatactaatcttaaaaaaaaatcaaataagacgaacggtcaaacgttaaacatgaatagtgtaaagctgtatttatttgggatggaggaagtataaattataaggcctatattttttacacagtcttcaacgacatactttgaccattaatttatttcatattatatcatcaacaactataaagttaatattacatgaaagtattttaaaatgcaatcttattattaacatatgtaatacttgttgtagatattgattattagtcaaaagtcaccgattttgattttttttaaataaggacgctttataattcgaaacggatagagtagtaggatattttacatccaattattttattttacagtggggtattatttagttgagtatgtttcttttttctcatacaccttagagaaaacggaggaaaagggaaggctgggctgctccgtgaaaaggaaagatttggttgcttaccagattctctattgtatagctcggctcgttttctaattccagcctctcgtagagtgaggtcgatactcgtagagtaggcagctgcttcaattttatccaactcacatgtaactcttttagtaacttatgaatacaataagtaaattgtaataatgctcggcacaccaacttcacatcatattaaataacttaagcttcctttcacacatgtattccctcctttctaaattgatcatcatataatggaattcaaaatttctcaaattaattattatataaccgcatggacacatatttcatcagaatacaattaatgtagcatggaaaaatatacgcatgctaagttgtgattggcattgtgttttaatcgatgcatacattatgggagaatgtgtgcatgatgtcttaattgatatgatttaaataattattgggtcctgtttagaagattagcccagggctaatgtttagtcatgaattggtaggctaaacattagtctagggtagtatgtttggatccatgggctaattcaaggctaaaaggtggagacagagggagagagagaactgctttttatggtccccacataaaattagccccattagcaccccttggaggggctaatgttttaaggggggctaattcactttagcctcaaattagcccacctgtttggatcattgagggctaattcaggagtaaaaggtgggggctaataattagcccatagaaccaaacagggccttggtcttgtctcttggtgcataatatatagtataataatcaatttgggaaggagagagtagttcactccctctgcactcatcacttttctcgcaaagccaatgctcatcgtccgctctcactttgtctctcctttcctcttctctcctctctcatacagcttaccactgctcagggacggagctacattgaagagtggcggtgcccaggaacctgatcaataattttttttaattttttttaaaattatagttcatctatttttatcatatatgtaccccttcaatctaaactcagacgctcatatcagactaagctcagcctaaaatagagtaaagcaagtgagtgttatttcttcccatttcgttctagctccacccttactgtagctgaaatggtttctcctatggttagtctaggttgtactactgttgcactcgctagtagcagcgctgcagcagcagcaaattcgagttcctttctttgttttttatctttgttttcttccttccttggcataggccggtttagctgagtgcgtcgtgtattaaaactctattttttcaatttattgacatacaatctagcagcagcagcaggcatcgagatgggcgcagcggtgaatgccccctgaaacggaatggaagccgcggacaagacgacgacgaggcatcggagcaagagccgggccgatgttgtgggattcggtcccgccagcgtacgaccaaccccggccgctccgcgcccgcgcgacccgcacgtgagagcaccgcgcccgcgcgcgcaccaccacgcgctggaaatgctcgccgtccgtctctacgctaggcagcctcgcccacacgcacacagccaaagccaagacgcccatccatgtggtgtggcgcagcgagctgaactgctgaagtggtagtggtggtgtggtccatcgatcgatctgtgcagcagcagcataagctgcttggtggtgcgctcccctctgcgcggcggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaagagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttcaccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggttatagagcacttaaacttagttacaaagtacttcctccgtcctaaaatgtagacattttttaggttggcacgggtattaaaaaagtatgtgagaatgattggagaatgtgtatgattagttgaaaagaaaaggaatgtgaatgagaatggttgtgattggttgataggaggaggtaggtggaaaaatagcttcattttgggacaagacactgtgttagaaatagctatattttaggacggatgtagtacttacattgagctacaatgaatcaaaattagattttacaactgtttttgtttctagatttatgatttttgacatattcatcatattctctttttttaacgaatcggcgaaccgccaatttcatggaatacatgagtaaaattgtacaggcacaagacgcaagaataaaaaaaatgtgcaggctcaaggcctttggtcgaaatgcttcgcgcccgccaaggttcatgtttttttatcgcttcctccttaattttggctgttaggctagtcgtcaagagctctttttgctggaaaaccctgcggttccttttgttccaaatctcctaggcgaccagcagtattaatgttcgaaggagccttcggtgcttcgctagtccacgcagtagcctcccatcactcagagcaagtataatagtaggctataagccagctaaatgctaaggtggaggagaaaaaagaggagaaagaggagaagcgggctataaaattacagccggtttggacactctttttatccaccacggagatcagataaagaggcgtgtcggtgatatgggcccgggggtatcaggtttagagggaggaggccgcccctcgatgccacgtggccctcccccgaggggagtcaggcccgaggtggggtggcggccactccttccccaaagactagtcggaggaggctgccccccaatgccacgtggccctccccacaggggagtcaggcccgaggtagggcggtggccactccttcccagaaactggatggaggaggctgccctccaatgccacgtggccctcccgcgaggggggtcgggcccgaggtagggcggcggccactccctgaccgagactagagggagaaggccgccccaggtgccacgtggctcccctcccgaggggggatcgggcccgaggtcgggcggcggtcaccccctcccgtgactaggggtcgggctcccccgaccccctctctaggtcaccacgtatggtgggttaggtgtccgcctccaggggcccacctacccgcatttatggcgtcccgagcggtcgcgccacgccgcatgtaatacggtgtgcagtgcacccaaccggtctgtgaccagtcgaatgactgatgggacccaagatgtcaggcgcaccatcgcgtgtgtcaggcgacgtgtagcccgacatatcccatcaaataatgatggtgagaggttctcatcctcttatcccagccggagtcggtcctcccgctttggtcaaagcaaggctcctgtttcccggtgtaataggagcccagaagtcttcacccattaaatggtgactgacaggggcaccccccgtgtcaggcggcaagatttgacaggacccatcatcaagacgacgtgtgcttggcttcccaagtcaagagacaagacatgcatttaatgcaaagattataatacttatccaccggagctaggttaggttgttgggcccatatggtaaccccttgaggtataaaaggaggtccaggcctagtggtggaggggggacttccgagcgaactggcgtttgggtctcataaccccaagcactggtgttctacattcaatcaatcatgcacaggagtagggtattacgcctcatagcggcccgaacctgtataaacctcttttatctcatcgtcttggaggggcctaaccccctcaagatcacacagctccgctcaccaagccctcgaatctcacccgctgcccccggccgaactcacaaaggggggcctcacggttccctggtggaggagttcattctccgacatctggcgcgccaggtagggggcgcgttcgtgatttttgaggttttttcgagcgccggcgtggtgagtgtcacaccgccgctacgggggaaggcgcagcatcctctggagtgtcgcgccaccccaggcagggggcaaggccccccacatccccaccgggtaagcttggctaccaggtctttgtggcgagtcttcggaatgtccgagggcccccaaagctccagccctacctcaccgagaagtacgatgatggcgccgacccctccaagtccctccagatctgcatggcgatcatagaggcggcgaggggtggcgaccgggtcatggcgaacgtcttccccatggccctcaggggccaagtgcggggttggcccatgaacctgctgccgcctcggttcactcctaggaggactcttgcagttttgagctccgggtgccgtcgaagcccgggaccccctgtgctggctcttctttagcgactggctttggtcctgccggctggctacggtgtccggcctggctcaactgatcgtcctttcaagcttcaagtattttcaatttttcaattcattagcttgaaatcttatatttgtttccccccattctattctcatggccctgcgacgcccgcgtgttgcgcatttgtttgctccctcggtggtaagagcccaacctctctcccatctacatgaacgattcttcgctaagtgtgggggctaagttttctagccttcagttgagccccgagtgccgtcgatgcccgagaccccttgtgctggctcttccgtagcggctggctttggtcccgccggctagctacagtacccggcctggctcaactgtggatggggattgctggctctagagttttcggctctcacactcatgcgaaagtaatcgtccatgtagaaggaaaagagattggaagcaggccaccgaaaggaaagagcaaacagaatgtgtagcgtggggacacaggctcgtgggaacctgacctcgtttgctaagtggtcacaggcttcccaagatggttcggaacccatggtggggggtcctcttcgagctaaaggtttgtgtttgcttcattcatacaagcaattctttgctataagtgtgggggctacgattcctagctctatcctagccctgcgtcgagctctgggtaccgtcgatgcccggggccccctgtgctagctcttccgtagcggctggctttggccccgtcagctggttacgacgctcagcttcacttgatcacaggcgaagattgttggctatagaaagttcagtcctcacactcgcgcgaagataatcgtttgcatagaattattattgcttatatttatctctcgcctatctcttcctcacggtcccacggtacctatgtgtcacgcgccggcttgcctcccttggtaacaaaaagtttgtattcgcttcatccattcaaacgattctttgcttaaagtgcgggggctacgatttctagctctatcctagccctgcgtcgagctctgggtaccgtcgacgcacggggccccctgtgctagctcttccgtagcggctggctttggccccgtcggctggttacgacgctcagcttcacttgatcgcaggcgaagattgttggctatagaaagttcagtcctcacactcgcacgaagataatcgtttgcatagaattattattgcttatatttatctctcgcctatctcttcctcacggtcccgcggtacctatgtgtcgcgcgccggcttgcctcccttggtaacaaaaagtttgtattcgcttcatccattcaaacgattctttgcttaaagtgcgggggctacgattcctagctctatcctagccctgtgtcgagctctgggtaccgtcgacgcctggggccccctatgctagctcttccgtagcagctggctttggccctgccggctggctacggcgcccagcttagcttgatcgcgagtgaagattgctggttagggaaagttcagtcctcacactcgcgaaaataatcgtttgaatagatgaagtagaacatgaacagagattaacaaatggcaggagcaagcgaggtacgcggcgtaaagacacgggcccaagagaatctaacaacgtttgctgaatatatacagaaaataagttcacagcctaaggtacgggctagcgaatcgccctcaggctagggcgaaaaaggcgcatgggtcctagtgccagcaaagaaagaataagagatcgggcccacatgtcatttgactaacagagtggcgtcaaccctgaccacctaggaaaagttttggtcagggctaacgccgggggctactgtcggtgatatgggcccggggtatcaggtttagagggaggaggctgccccccgatgccacgtagccctcccccgaggggagtcaggcccgaggtggggtggcggccactccttccccaaagactagttggaggaggctgccctcctatgccacgtggccctcccccgaggggagtcaggcccgaggtagggcggcgaccactccttcccagagactggatggaggaggctgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatatgatatagtagaacaagtattgatccgaaggttaaagcacccatcggctagaggtccgatgtcatgaaatccacaagattagattaaacaatgaaacctttgttgccatcggctaaatccaacttatatgtatatgcaatccttatgagccgatgcaacgtccagataactcaccggctgaaaccccgatgaatcccttattggcaatcaataagcatgctagagattatggttctaagcacgacttagtagatcaaacttaactaatgcaacactaagtatgaaaagaaacacaatatctagacaatcaagtcgttgactgattttcagggtggtaaatgcctaggctaatctaatatagcaacgcgatttagccgataccggcagaaaccctaaagcgagagacagccgatagagctaaattgatatgctaagactagattaacagagacatgataaataggtaggcaaatatatcatccaaaccagagcaatccaagaggtcgaatatactgatgcagccttgaacgacgccgatgtagatgagacaattgcctggaccgacggaacattggacttatcccttcgccggagatcgaagacgatgcagccctgcgttgggtgccaagttctgccggaacgtaaaaaacaaaagtagaagtaaaaagggtggcgatgcgccgaattatattgatcgtagcgataaactacatagaccccgggtgtacatatttatacccatgggttgatacaagtccttgtcggataagaaagtacatagaccccgagtatacatatttatacccatgggttgatacaagtccttgtcggacaagaaagaaactttcctaaagataaaaggaaaagataaaatccttataggacactaaacacactttcctaaagataaaaggaaactaacaaactattcctaattaatagataacttgccatgccgcattctctttgaactcggtttcttatggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagggtcgggctcccccgaccccctctctaggtcaccacgtacggtgggttaggtgtctgcctccaggtgcccacctacccgcatttatggcatcccaagcggtcgcgccacgccgcatttaatgcggtatgcagtgcactcaaccggtctgtgaccgatcgaatgaatgatgggacccaagatgtcaggcgcaccatcgcgtgtgtcaggcgacgtgcagcccgacatatcccatcaaataatgatggtgagaggttctcatcctcttatcccagccggagtcggtcctcccgctctggtcaatgcaaggctcccgtttcccggtgtaataggagctcagaagtcttcacccattaaatggtgactgacaggggcacccccgtgtcaggcggcaagatttaacaggctccatcatcaagatgacgtgtgcttagcttcccaagtcaagagacaagacatgcatttaatgcaaatattataatacttctccaccggagctaggttaggttgttagacccatgtggtaaccccttgatgtataaaaggaggtccaggcctagtggtggagggggggacttccgagcgaactggcgcttgggtctcgcaaccccaagcactggtgttctacattcaatcaatcatgcacaggagtagggtattacgcttcatagcggcccgaacctgtataaatattttttgtctcatcgtcttggaggggcctaaccccatcaagatcacacagctccgctcaccaagccctcaaatctcacccgctgcctccagccgaactcacaaaggggacctcacggttcactggtggaggagttcattctctgacaaggcgtttttttttcccctcctcctcgccctctctctttattaacgtggccccatgtaaacccggctctttaatccccccgcagcgaaatcaaagcgtcggtacccagtacataatacctccacggtactcgtactcgtactccccaactcatgtggcaaacaaacgtaatcttctcatcccaccgacggatcgatcgatccatctctaccaaatgcgccccgcgcgtacgaacctatcgatcggtgtacgacgtacgcgcattccgcgaataatccacccctgcccctgcccctgccctgcccctgcctgtcacgctacgatatttaacgtggctgttggcctccgtttgacaaccacgcacgctgcgcacgcattcgttcgtgcgttcgttcgttcgttcgcacgcattgatgcgcggtccggatcccgacgccgctggcacgcgcgaggacatgcccccgtgcagctgctgctgacctcgatcgctcgcgcccggttttttctcccccctctttataacccactgaaagccgagtattattccaatgcagcagcagcagcaatcataaaatcgcagagaaaacgagagagagagagagagagaccattcttcttcttccacggcctcgctactctcatgagcaaggatgaggagggtgtggaggaggagcagcagcagcagcagcaacggcccaatgccatcgttgggatcgcaggagtcgccggcgacactgggatggccggccggtgagctgaatccaagataggatatagggaggatcgatatataggcgaagaaatatggaggggagttttggtgatggtgatggtggtggtgggttttcggtcgacggccggcgctgcaatgcggcatacaagggaaagccaggcattttctctgctgttccaagtactacctttcctttagctttcctctccatggaagaaaaaagaaacggttgcattattcatgtgttttctctgttgttaattaactcttgaggttgattaattacttcggtttttttagctaggcaagttaactagtagtagtttctgctacagatggtcaatgaagatcatgctaagacgacagtcacactgtatatctgcattgattccttccttctagattgttatgcattttcagatctctctctctctctctaaccaatacgtagctattggaagaattaatgtatgtccaattcatctcatcatctgtgtttgttgttgttgttgttgttgttcgaatccctgcttttgcacagtcactactactgtttcttttcggtgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctgtctttgctttcttttttgtcattggatttttgaggtgcctttagcgtgcagccttcgctcttgactattgcaccccggtaccacgtaccattgatgttcagttgggagaagttcatgatttggtggtagtgacgaatgctactacaattctcgagtgtaattatatatttggatcggactttctattattgcacccttttgatgcaattctttttctttccaagttcccacccaatgggacttggtgattttga

SEQ ID NO: 30414 - DNA, 5457 bp, Oryza sativa
tgaaatttgaaagggatgccctagctctagtgtcggtacggtgctttgtacatgcaggggtcattgccatccttcataaatcatatatttatggctcctttaaaacacaaaataagaaaaaaaacttcatccaataagactgttgttatagaaagtcagaatataaataaaaaggatgaaatggtattaagaggtctagtggacccacaactaaaaagacactctttgggacaaatctaaaacctataaacccctctttttaggacggagggagtataggattgcatgtataaatataaaacatagatgaaaaatgtaggaaaaatatactccctccgtactcgtaaaagaagttgttttggacagcgacacggtctccaaaatacaactttaacttcttgtttctataaaaatatttattgaaaagtgatatatgtatacttttatgaaagtatttttcaagacaaatctattcatataatttttatattttcaaactcaacaacttgagagttattcatgatttatattcctatggtttgatttaaacattgtcctaaatgacttcctttacgagtacggagggagtaagatagattgtttagaacaaatatgaacttagtaaaacacaagaatcataatgtcgttggtcaatttatcctcaaattatggttctttagagctttcattattttatttagcttggacttagctaataaatgaaaacaaaaaaatagggcttggtagatgttcgaattcatatggaatctctagcaaaggaaaatttccctctacctttcctatgcccaaatccttcattccaaacaagcgaatagtgccaaatacaatacaaattgaaatcatccatatttcctacaaaattcctacaatccgaaggagccctcaatgtggcccttaacatgagggttggatctcatgagaacttttctcaggtctatctctctcccaaaatcctatactttttctatggagcatccaacaacaagttacacacaatttctgcattctaaaactcctatggatcaactagctagtatgccacgtcttcctacatttttcctgtttctgtatttttgaattcatacgctccaaaggaaccctaaagaaaacctaatttccttccaaatgaagcatgcaaattcttaaatagtactaccaaattttatatttaggacatgcttttagagccatgtatacaattttaggtctcctttgaatttcagaaatttaatttggacgatttcaatccttgggatttttttctataaggtcattctttttttttcaattttcagatcgtccttttgcacgagagaatatgattgacaaaatcctaaaagtttattttatatacctccattccgtacggaatttttcatatcataaccccaatgcactctctcactctctctgctcttacgaatttttccttactattgaaaataaactaattctaaagaaaatcatgtgctccatatatatagctccaaatattatttatgcgtgttggagtcctatagatcaagttggaaatggcgttctactcgtacatttatccctttcttatgcgtttttaacatacttgtgtttgtttcaaagagcctctatagaccaataagaaacttcttttttactgtgaccgtgaagcttagagcaggtataatagcagactataaaccagctgcaaatatattttaagaagataaatgagatgagagaagagaagcgggctacagatttgtagctagttgtagcacggactccaagacgcagtgtgtatgacagatgggaccaggtattaatagtgtagtatgtaactattgtgtgaatgagctattagattggctatagatgaattggagctagtagttaactatactattaaacttgctcttatgtccaatacgggtgaggatcatctatcataacatcagcatcattacagtcattggtatgtgggtcactacctcctattatcacacatatcagtatatataatgatggtgtcattatgaagcaatataggctgtgtttagttcgtgtgtcaaaatttttttaagtatacagatacacacatgaagtattaaacgtatactaataacaaaacaaattacagattccgtctgtcaactgcgagacgaatttattaagcctaattaatccgtcattagtaaatatttactgtgcatcacattatcaaatcatgacgtaattaggcttaaaagatttataacacgatttatatgcaaactatacaattgttttttatctacatttaatgctccatgcatgtgtctaatgacaaaaatgttaaaagtttaaagaaaaaaattgaaatctaaacacggccataatccaatactcccatggccaatggctgcacgctttggcattggtaggaaaccttcaggcccaaccaaagaggcatttgaccaaaccgtccggaattcagtggcctcgggatccgttctttttcccgagcatgcgtgcggcacagcgaaattagctactcccagcaacaaagatggatcgttactccaacttgatatggtttagctaattagctagctttacacagcatcatactatcatactatactattactactataatcgtcaccattgatttctttaatcaagctatctaatcctatgtgccccctgtgttgttgagctgctggttttgactttgttggcaccgagatatatgtcatgagaattggtgtccgagacttgaatggttggtagctttgacgctagcttttaggatagatactcctatgatatcagtaaaaaaaacacatacacaaaatgaaatattaacagtgtttggatcgttcagatagctagctagcccttgaatacttcggttgtatgcatctcagctgcttcattatttcttaatccatcatgtattattctagtatctcgtggtgttctgtgtcagatgggcctcgttaattatagcttagcactgttgtttcaaaaatctgcggcttgcttcgcgcaacacattgactttctgcctgcatctgtaggcgtaagatctccttggtttgatgatccatgcgtggccatgttaatttgggactgatagggatccgtgcttttgtcagactgtcagtgtgcagcgttgatcatgagttagtacacctaatatgttcatcttcatcgatatctcaaacatcaattaagaataaactgaaatggccatacctctattaagagtctgtatcttatcatgccttgttaatcttgactgtctcataatcagccaaccaccttttatattagcgaccgacggcgaagaagaaaggtgatcaccctaacaactagctagctactcaccattttttgaaaaaaaaaacaaagaaaaaagaagaaagagaagaagatgtacgccattatttcgctccggtcaataacccgtaaaaaagcgtgacaatggaataaaagttaggttttatttttagacttgtacatgctgttgaggatttaaaggcaaagactaaagaagacaataaaaaacacatagaataatttaaatttaaacgttggctatggcttactttattaaaaaaaactaaacttagaagagaaatgtgatcccttctaatacaacaaatctcttcatctatttaaatttatggtagaggagtcacgcctctttaacattgatttttttttttggatagtgtgagtaatgcgctaggtacacgtacaccagtacagttagtacagcaacgtacagtgtgcgtctctggaggcgtatacgtatccggtttgatgagggcatggcccatgctagatcgccttggctttccatatcaaaggacacagggtttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtctgcaagtaaaatccgatcatccagagttccagactgcttgcaaatctggactagaaggagagggcatcattcacagggtgatatggacatatgggacaagggcatgcaggccgaagggaactctcacaatggcacaaggaatgtttcgaaccaactgtgtacaaacattcacaccaaataaaaataaatgagatcacatgaatcaaaatccaagaaaaagagcgtacgtggattgaaccacatacacttttgaatcagaatagtgcatcaacctgcctactcaaaataactccaggtacaggttttattttatattttttttaatcgaacaaaacaatcaggcagacaatgtacatcgcgagagcgggctggttacgatcgctttgctttgatcacaaagcgaggccttccttccgaaatgagattctgctacacctgtgcaccgcgccgcttttcacaggcccatcgaccgttttcacgggcttttcggcgtcaattatcgcggtggtattttgtttggagtcgattgccttttgttcctttctgctctccagaacagattcaagcccctaaaatgtgcacaacacagatatggattggcataaagaaaccgaaattacctgaatggaggacaaacatctgcatattaattgtgtattaccttcactgcctttctttcagactgagccaactctgtgagcttgagtttttcattagcttcctgtggaatggagagcatagaaggatcattacagcacaatgagcagtatgagccaaaagaaaagcgaactatccaagataaggcatccttagaccttgcatgcaatcctgaacctttataaatgatatctactcacctgaaaaaacttggcatttattccatcttttagacctccagctatttggcagaggtaccatacaccagcattagttgcatcctgtcggtaaacacaagaggttaggcaaaaggaaaaaatcagcacgttaaatattgatgggtatgtttagccacctgtttattatcaagcaactcgatcttcccttcctgataatgtcaaaggagaacataaaggtcaggataaccaaagaagtgttct

SEQ ID NO: 30415 - DNA, 2211 bp, Oryza sativa
tcctataatagccatgtcaagtgcttcctggctttatcgagggcacagtttttagcttgaaacaatattggcatgacaaagaaaatcctgatccaccttttcagatgcgactacacaaatcaaactaataagagttatgcacctcaggtagaaacacaatttaataataaagttatcagatgctaattagacttgatgtaatgaaaaaaatgaaacaataattattgctccagagaaaaaaaaaaaggaacttcaaaaatttccatgtgtaaaaagttgaagggctagcagcatcacaaatcaacaaacctcgtttctaataattttggagacctccacttgctcatccattttcccatctaaattttccaggcgctgacttagatgcctttttgttgcctgaaattaattgaatttagaaaacactagtcagcatatgcgaaggaaaactacttcaaatatgtaacgattcagcatgtaaagcatacagctaaagctgaagacacttgatccaattgcttcgacatactctcaacagctttggtcatgttgcgtttggtaacaaacatgacatccgataaggacaatccctgcaggaagatactataatgtaagaaaagtttaacacatacagttcatcattgtactagtaatttagtctacaaacaccattaggacaagacagatttgatggttttacttaaatactagggcctagggatcatgaaaagagtctctcaacccgaaactgtgattcttgatagaatatttggtcacagaatcagagaggtgttattacatgactaagaaagcaatttaatcccccgcccaaaaaaaaaagaatgtggtttattcatgatgtctcaaaatacatacaagggtgccaaatgccaattatatatcaaagttggatacttggatccacatagaaccactgggactgcatggaaatactttacagggagacttaggtagcatagttcttaagacatataactacaagaaacaaggtaaacaagcaaatggggaacatcatattactctcttcattcagttactaatttattgaaggctgtaagtataataaaaggaaaaggatagtaaggagtgtttgtggagaaagaaagcaaggaagaaaaatcagaatataaaagctgatagatcaaagtggcattgtatattcctgattttaccttccaccacatatagcagtaacccattgctccaactgcagctgcaggcagtatgtaggaggataaactgcctgcaaaagggatgcaaatgctagtgaataaacaacacggataagaaaaagatacatgtcacatggggacaagtagctagtgagatatgttcatgaatgttgtgagaaacagctgaatgtaccagcattcctatcccatttgtcattacattgctattattgaccaatcaacatgattcatactgtaatcgctgaagcatttcagcttcatgaattactcaatattgaattagagaatagagattgacactctttaacgagttttagcaaaaatatgactattgaccactttttcaccaaggggtggtagccttgtagaggagctgatacaagccaataattgtctatctaaaccttaagattgacaaataatctaagtaaaaagatgtaacaaaagctttatatggatagactctttgcatgactgctagaagagtgaaactgaaaacagaacgaggagaggatcaaacaagaacaaacctccagagtcggagttgccactcaatatggtaataggccttgatatagtcaaatctctaacttcttgtgctaaatttcgaatctgcagtcaagcgccagcacacaaataataaaaacaacaaactgcagtggtttttactgaaactggcaactttattgaaattgaagtctgcattgtaacttccattcaactgttgattctatgaaaaatatgaaacgatgcatacctgagattgaagaagggcgatgtcataggcactcgaaccttctccttggtttacacctttcataagctcctaaaaacagggaaaaaaccatctacttcaataaacatctgcgattttatgagttactacaaattatagatgaagaacgcatcatcatagccattgggtgattaacttaggcatgacattccaattggtgcatcgaaatgattcgacattgaaattaagcgacaaaaagtt

SEQ ID NO: 30416 - DNA, 29203 bp, Oryza sativa
cggagttgccactcaatatggtaataggccttgatatagtcaaatctctaacttcttgtgctaaatttcgaatctgcagtcaagcgccagcacacaaataataaaaacaacaaactgcagtggtttttactgaaactggcaactttattgaaattgaagtctgcattgtaacttccattcaactgttgattctatgaaaaatatgaaacgatgcatacctgagattgaagaagggcgatgtcataggcactcgaaccttctccttggtttacacctttcataagctcctaaaaacagggaaaaaaccatctacttcaataaacatctgcgattttatgagttactacaaattatagatgaagaacgcatcatcatagccattgggtgattaacttaggcatgacattccaattggtgcatcgaaatgattcgacattgaaattaagcgacaaaaagttatgcccatgtgcacgcccaacgtttgatcggtgaaatgtagctgtaatgcatttgataaattggagtcccacaaacagatatataaatcacaacatcgcttgaaacacacacgggcaacactgacgcgcctatattagcgtattggcaacttacgatcgataacgcgaagcaatcaacagaattagatgcccagaatccaactactctactcaagaaacatcaggcaatccaccgacctgaagctccgccaacacgtcagatagccggccattccgcagcacgatcgagctcgtcaaccctgcagctcgacgccggccaaaaaccaccgcatcaggatcagaacacagcggggcgatccgcatctcgaatcgatgctagaaaatatagtagagcgggaggaggaggaggaggaggaggagggggaggttgcggtgacgaaacctgcgccgacgaggatgaggaccttggaggtggcgaaccccgtctgcatcgccatcccctcccgccgctcctgcctccggggctccccccgtctcttcctcgcgtccggcggcggggtcggtggcgaggtcgtcggcgaccgcggggaggagagagagagagagagaggaggggagattggcgaagcttcgggaaggggaaagctgacggcgaaggcggaggaacgtggtgactgacatgtggaccccaccgctctcgggcccacctgtcagtgaccacgtcagaggggtgcgcggacaactgggcgagtggtggggttggacccggcttcgcttctgtcgatggtttggcgagcccgacccgagccggtttacacgtggacggaccggatttacccattggggtatttgaacggggatagcgcatgccacgctgtgctctagaatgccaagtcagtgcacgtaccacggcattactgcgtgaggcctgagcgtggatttttttgttatgtcttgaacctttttatttttaattaaaaaaacaattgaaaaaacttattttaaaaatttgaatcttttagctacgcatactgtcatgccggtctgcctaatgttccatcgttatttggtcacgccggcctaacggatgtgacaatgttatttggcctcgtcaccctgactaacgtgataagataaaactatcacgcccgttgtggtgacgtgtcgatgttatattgccacgttggatggaatggcgtggtcaaaagatccatattttgaagtaagctttggaatggttggatgaaaatttggatattcatgacatgcttttcaaactactaaacggtatgttttgtgtaaaaaaaattttatatgaaagttattctaaaatatcagataaatatattttttaaatttgtaatacttaattaaactcaattaattatacgttaatacaatctcgttttgtataaacacttaagcttcgtcttaatctgtatgagtttcaaaaatcaccttagcaatcaaatgtttgaacacatacacggagtattaaatataaacgaaaaagtttagatcctctagcaaaatttttcgccatgtcacatcaaatatttaaacacatgcacggagtattaaatataaacgaaaaaaactaattacacagattgcgtataaaattgcgagacgaatcttttaagcctaattgctccataatctgacaatgtggtgctacagtaaacatttgctaatgacggattaattaggcttaataaatttgtcttgcagtttacaggctaaatctgtaatttattttattattagtctatgtttaatctataactaatataaatattcgaatttttccggtcgtcacactggtttttcgtcccgcttcgtcgccccccctcccccaaaatcccaatccgaatccaatcaaaccccggaaaaaaataacaatcacaatcggagttcaatcacacaaatcatgatgcatgtacacatatatatccaaaccaaaaccaaaaattagatcaagggggtcaccaccgccgtcgccattgccgtcgcagagacggctggccgccggcggcttccctcctgctagatccggtggaggggagagcgccgccaccgccggtccctcccgttagatccgccggcggtggcggcggagggcgctctccggtggtaggggagagggccgccgccgtcgtcggtggtgggagaggactccgccgccgccgctgctcgcgggagaaggggcgccatcgccgccgctcgcggggcacctctcctcccgctagatccgccgccggtggtgggggagggtgccgccgacgccgctgtggggggtgggcgcgccgccgctgacgccgccactaccgccggatccatcgctgccggatctagggcgggagggaggcgagaggggaggagggagccgccgccaccgccgacggactcacccgccgacgccatcgacaccgccatcgccgctggatctggggcaggagggaggcgagaggggagaagggagccgcagccgccaccggatctgccgcgggagggaggctagagggggtggagggagccgccgcccccaccctcggatctgtcgcggccgccaccaacccgccaccgccgacccgagagggagaggaggaggggcgccgccgtggctttgactgagaggatcacctccccgggagccgccggtggtggggagaacgccaccgcgctgccggtggtgggggaggacgttgccgcgccgccagtggtgggggagacgccatcgccgctcgcggggggagggcgccgcctctgctcgggagggagggcgccgccgcggaccgccgccgctcacggggggaggggtgccgccaccgctcgggggcacggaggggagggcggcgaagtgaaatgggagggaggggagggaaatgggctagggttttggcggctgagagggagggggttttgtttccccgatatcgacgctcggccgtccgatcaaaaccctagaaatcggacggccggtgtcatccgggccgaaatcggcccaagagggatcgagagtgaggccacttttctggctcaagcccaggttgcggcttggggaggggaagtgagcccacgcgtgcgcaaaaggccgtgggccgaccggtaagggccgaaaataagtctattttaggtccctcgggccgaaaaaaagagagaataagttcatgtttagtgctcattttttcagaagcattacaattatagttatttctcacacttactttacttgtaaatttatttaattatacacatatacctacttaaaaatatcaaatatttcagcgaatttgtattttaattaattgcatatttttctgatatgtacgcttcccgttgcaacgcacgggcacttttgctaaaccaaacaacacttttggttaatatacacactccgtaatcacccggtgcaacgtacggacacttttgctagtactttaaatatgtgttcatatatccaatatgacacactaaaaatttacaccctgcatctaaacacagcctcaatcatgaaatattgaattcctatttttcaagaggatatacgcggcatgagcccatggacaggcatttaccgccgctgttccccgcctagccacgtctctgccacgtcaccacggccactccccggggaagacgaccgttcaaacccgccgcgactacccgacggcggcgcccatgccgccggcttctccctcacgccactcccactccggccaccgccttcaccttctccttcccaatccctagcctctctcgcctcgccggcgccggcgtcgccatggcgggagccgccggccctatccccaccctccccctcctcctcctcctcctcaccttcctctccgccgcctccgcgtcgccgcacatctccgccgtcatctcccagtcgggcctcgacttcgtcaaggacctcctcgtgtcccgcgccgcggaggccatcgtgcccctggaggtgcccgacatcgagaggtccgtgagcatcccggtcatcggcaccgtggacatggtcgcctccggcatcgtcctccacggcgtggcggtcgacgactccaccgtcgccgtcggggacgacgggatcgtggtggccgcgtcgctgtccagcgttaatcttactatggggtggagctactcctatagcgcctgggtcgtcacgatctctgacagcggtaatgcctcgattcaggtatgggtcgcggtattcatgcgttcaattgttgttgtttttttcacagttcgagagatgatgctagattggagggggacttccatgattgacaagttaatgttcaaaattagtggtttagtgtctgaatttgcgcttattggcatgtatggaatgaaacatgtatgtaaagtagaatccagcacgttatgaaattgagtagctttgaagacactttcaaatctagttctttagttggtacatgagtaatttacattgataggcacaatagctggttacttgttgcacggtgcatattggggtgacatgtgggctgcctattaggagcagctggcatttgtgcttaggatttacttcaagatgatcttaactttttctctagatcattttagctcaatggagtttacaattctaagcacctaaatagcagcattgcagcaggcaagcaacatttcaataacatagatatcctatatgctcctcagttaatttgttggaattataagctgcttcttttttaaaaagtaaaaacgtctcagttgtgtttttgaaagtttacaccgaaacaatgtcacctatggcacttacaccttatttacctgtattatttgagtactagacacccttgacatgtatatatacgaaggtacaagatgtattcatgattccttttcgctaaggttgatggaatggatgttgggatttccatggggatgaagaatcaaaatgggtctctcaagctgttcgttacagaatgtggctgtaatatgaagagcttggacatatcactgaacggaggagcatcttggttttatcaggggtacgtgcttcacaattttacatatgcaaaaacttgtcaaattaactgaggttgctctgtaaattgcttgtttggtcgttagatcagagggcgctcatcccttgctcagtccctgaaaatgagataacataggcttttgatatctgctctgtcaacaagccctggttcagtccctgcttcctccagcccttatcctgaaagaggatactttttcttccccactcatcttattaagcctttttctttgccggcttagcttccgtgcccagatagactttgactatactataaaagagagctagatgatctgttatcaagtgagaagaaaggctggtccagaaccaagcgaacaagggcttgtactgtcggaggttccaatggttccattcttgatctgatttctcgctatcttattcggtggcacaatacaaaacaaaatatgactcctataattgcccgatgtgggtagccatgcccattctaattctatttttctgtacatcagcaatatatataggaaacatggtttatatctgtggttagaatatcatgcaattttttttgtcaaaataattgccctatatattcctgaatgctgttgatatttatctgaccccacatggattgatattattcctcttaccttttctaggtttgtagatggtttcagtaatcatatcagatcatcagtagaaaatgcaattacgaagaaaataatggagggtgcatcaaagcttgactcattccttggaagccttccaaagaaaatcgatgttgatagcatcgctgctatgaatgtgacatttgttagtgatccactcttcaagagttcctctgtggagtttgatatcgatggactgttcattccatctgataaaactgcagtttcaagacacatgcattttagaggtgtaaaatatgtaccacctcttggtagctcttcaaaaatgctatggatttcattggatgaagatgttttcaactctgtttcagctctctatttcaaggtatatcagaattcataaaaaagtggttgttatcatggttaaaggattaaagccttactgcagatgtgtaaagttgaaggattatctgaacttgcttttgtcaaaagatatatatatatatatatatatatatatatatatatatatatatatatatatatatatatatatatatatatatatatatattacacaaaagaaagatatatattttgttgattgtgtccgtctagagtagctaacttgaacacgtgttcatgtttgaatggaaacaattattccctccgtcccagaatataagcatttttagagttggacatggttactaagaaagtaggtagaagtgaatggtggagggtggagggttgtgattggttaagtagtggtagtaggtgggaaaaatgaatggtggggagttgtgattggttgggaagagaatgttggtggagaagttgttatattttaggacaaatcttgagggctaaaagttgttatattttgggacggagggagtaacaaatatgctaatagctgtaaaaatatatattctaattgatatgatacttggattgttcaggctggttcactacaacgtatggtggataaaattcctgatcagctcttcctgaatactgctagttggaggtttttgattccaaggttatatcagaagtaccccaatgatgatatgctgctgaatatttcagctacttcacctccttccgtgaggattaatgtgggtaggattgatgccgcagttgacttagatgtcacagttaatgttttggattttgatgagatagttccagtggcgtgcatatcagtggtgagatttttctaataatttcctttcctgatttcatttgatttcattgctagttgcttgacttatggaaagtaaacatattgaaatgtaacagtattgcaccatctggcagcacttgtatactgtccgtgttgtctttgaccttcagcatttcatattttctcccactgagaattttagaaatgaaatctatggcacattgagttgtgttcatgttttctttttttgtttcatccgttgatttacaattggacttccattatacataaacatttctacacgaggaaacacgtgcaatttccacctctttgataccgttgtcgcatattgtttccacagtcagttactgtctctggagctgcagtggtttctgggaacaatcttgctggaagagtcgagttagattatttctcattcaccttgaagtggagcaaagttggcaaacttcataccttcatagttcaggtattttggcctgtattatacgatttaatgacattccacagtttgtaatttatgatggtgtaatagaaaagaggtgagcttgggaatctccatcctatatttatggatatgcctaatttccaagagggactctgaggggctaactaagacatgcgttatcctattggaaagaaaaaagtaatttcggttgaaaatgccttcttcataaagttcttttacctagtatagcggaaaggcctaatttctgaatgaagttgttaattgtggagctgcacatgtattttattatcattggtgaacatttgtttcttaacttctgaatgtctaattgattctaatttttgtattggcagagtgtgatgcagatcttgttgaaaaaattgtttgtgccctatgtgaattcatatctcaaaagaggcttcccattgcctatcatcaaggggttctccatcagcgatgcatacatcctcacttcccagtcaagaataattgttagctctgatgttgccttcatcggaggtcatactccctatttaagccaatgaaagcatctggcaagaagtaggcttgttgctcaatcagcaaagcatcagaaatcgccatgtcccatggaacgtgtagtgctacttcctcaacatgttagcattatttcgttctgctgtataatgttcttttgtaaataaccgtaggagttgtacatatgtaaatctaggaaccatagaactgtagaaataggctgctgctatactggagaaatggtgggttggttgtgatgtacccacaattcttccaaatgaactggcaatatacttgtacacgttctgtcaaaaaaaaaaatgtacactccactgtatagtgttcagttctgtaatctatgctgaatttgctgtatttaaccataatctggaaatgtatcatcgttccagtatcaattcctgacttcttgtattggtaagatataaattatcactgcaatctgcctcactgaacctgtaaacacaaactgatctctctttattttcagtgtagctgaatttgacattttacactatcaaaataaataaataaacaaatagaatttggcattttacaggaagctccttgaggccttgagtaatcaggggtcagtgactctcttcctcctcctcctcctccaattggaaaaacaattttaggataagacaggggctaccccgcaaaaatgactctccgttatcctcgagtcgagttccccccaaaacccagaaaaccccacgacgccgtcgccaccgttcgtctccgcctccgcctccgccgccggaaatggcggccacctccctcctctccctcccctcgctccgcctcacccaccgcctcctcgtccccgcgtcgtcgtccgccccagcctcccgctcccagttccaaacgctcgccgcgaagaaggcagccgtcgccacgggcaccggcgagggcggcggcggggggcgtggagcgggcggcgggctgctgtcggtgctcgaccgggcgatggcggacgaggaggagtaccgccgggcgcgcgcgcaggtgcaccgtaagggcgtggaggtggaggggtacgccatcgagggggtctccgtcggcgggcacgagacctgcgtcaccgtgccgtccctcaacgtcgccttcgacatcggccgcgggccgctcttcgccgtgagccaggactacctcttcatcacccacgcccacctcgaccacatcgtgagcgccccgagccctgtcctggtttgattcattcctgtgctgcttgtgcttcgtgaatttcgtgtagaggcaactgcgcctctagctaagcttgggtgcgccatcggtgaagtttcatagaaaagctgatgtaaggggattgattcagtaatttcaagggaattgtcaccggggaaatgcctgcttaatttactatttggactgtggcctttagtaaatgtctgcttagtttatttgttcaacaacatgctatcgtgaattcgtgatggataggatttttatcaccaattcttctgataagttggcctaagttagtctgcgtgtaattcttaaataataaatagtctcatcttgctctatacctgcttttactttggagcggtgtcaagaaaatcatgattgtgccaacatatttctcctttgcatagcaacgggagaattttccaatgtttttccctttaaactgacgaatatgcttcactgtcagtttttccatttgctgctctaacagaatcacaacataaatgcagccatatccacctcagttttgttattttgattgttcagggtggtctcccaatgtacatagcaactcgtggcctctataatttgaagccacccgttgtatttgtaccaccatgtatcaaggatgatgttgaggatctacttcaaatccatcgtagaatgagtcaagtcgaccttaaagtggaattggttgcgcttgatttgggtttgagctcgtttcacctcttctttctgtgtttctctctccttgtttatttctaatgtttctacgattgcattcaggggagacatttgaaatacgtaatgaccttgttgccagaccatttgagactcaccatgctatacccagccaggtataactccctaggtcaatttaagtatagttagcaagccaaaagttctagttctcacctttcttggacaatttagtgcttaataactatttcgccccttgtgcgggttgtgtacattcacagggttatgtcatctactctgttcggagaaagttgaaaaaacagtatgctcacttgaagggtaatcaaataatgaaaatgaagcaatcaggcgctgaggtcagctagcaatctgttctatataagaaatatattctgcactgttactcactgccttcttttctgtcagattacagatactatactatatccagaagttgcctttacaggtgacacaaagtctgattttattcttgacccacgaaatgcagatgccctgagagcaaaagtccttataactgaggtattggctttagattttagtttccttgattattgccctttctcccaagcctgtcaaaagtatttgttccagctgtatgtaatcagtcacatttagagatgtaatcattctcatgggacatgtcaaagtcagcaaaaagggtgtgaagtataatactccctccatcccataatataaggcgcgcacgaatttcaagattcaacctttaaaacatttgaccaacacttaatataatatgaaaatgaattttgtttgttaaagattacatcattagattgagatctaaatttactttcatgtggttataattttgttgctacaaatcttatagtatatgagaaattataagctaaagattagttttggagaccgtgccaacattgaccacaccttatattatgggattgggagagtagtataatacagctatagtcttgaaatatcagagaacagtaaaaggcagtctaagtaaaaccaccctattatattgatttgtcacatcttcagactgtaaaataacaaaagaacttcctttttatttgatcagagggtccatcaaatctgaaacatgacaaaataatttcaaatgtcctccctattgaatgctttggcaccaacattatttgaccttttcacaggcaaccttcctagatgaccaaattgatgttgatcatgctcgggagcatggccacatgcatctctctgaggtaaatgatgatgcacttgtcactttctccctgccatgctatgattctaatgagctttgggacaattctgatagttaaatgagatgtctgtataaagtattactgcattaatgcaaatctggtatgtcgtctacagataatggagcactcccaatggtttagaaacaaagccattgtactgacacatttctcaaatcgatatagtcttgaggtatgtaatcactaacctataaatcattgggaatccagtgtttcctaaaaataatagttgcggattctagactaatctgacccaaatgattattttgtaggatattagacaagctgtttccaaactacagtcaaagttatcttcaaaggttgttgcactgacggaaggcttcaaatctgactatagatagtgtatagaagtaggtcagctgtgcttctcacccttacttgctgagaataacttgagttacttacactaggaattggccattcatgaggaaaaagggacagaattaataggtttgtgctgtttggcttttgtatgtggcatttatatctcctatctttctatattagaaaataaagtttatatagcattataactaaatgattattgtgatggaaaaatctatattatacatgccaaaggtgattcagtaacatacataacattttcttgacactctccagcttccagaataagaaaaggttagctaaaatctctctctttctgctgtttttttattccccccgcccccccttgtactatctctctcatgtacatattatattttaatatatcacagtaggagcctattctgctgtttaaccgtctaaaaaaaagaataagaaaaggtgtaaaaagctgggtattacaatacgttggagaatctgaaggccaaataaactgaaatcatgaaacgcatacatctgcatgaaatccaataagttgtaaaatatcgtacagtttcatccttgaaagcaacaagcaggcatacacttctattactgtgtactgcgtaccatgagtacgttctcttgaaaaatagataagttacgagtttgttctgaagtgtcgtacagtataatccttgagaagcaacaagcacccaagcaggcacacactaatattactgcataacatgagtatcttctttggaatagatcaaccaatgagtttgttctttgaagcttcttttcttgtattcttttttgctaggtacatgagagcagtggcagtgctgctagtatctggttttagcataacggattttccttgcatcaatgtcttgttcacttacatgttcaacagattcgtcatcagtggagcaactttcaggatcttcgcgtgcgggaatgatgaatatgtcagattcatcaggtaatctgaagctaactctcctcatgctgttttggctcctaatagagattctatcgatggagaagctgtcccggatgttaggagaattattttcataagaacaatccgggttaattgggcaaacctttggagagtgcctccgaggtgatggggctccaattgcctccccctgaaagctctgaggagaatacaagatgtcttgaagagtgttttgccttatttctgccttgactgttctggtcttgttatgctgctgctcctcttgaaggcatctgggcttcattctgttgaatagtgctttaacatggcaacagctctgtgagcccatcttttccctctcttctttggtgatgaacgatagtgtcatggcaaatgcgcttatatatgtccatgctccgtattgtgttgggcaagtaaaataatctgttttgcatatactaggttgtgtcaaaccttgttcatgtcaaagtaggacgaattatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactacctcaatacttccattctaacattttctatatttatattaatgataataaatctaaatagatatatatgtctagattcattaatatcaatataaatatagtaaatgctagaatgacttacgttgtaaaacagaaagagtagtatactccagccaactactaactctaaatcatctatagtctatctaataactaatttatactagttaattacaaatatataatacaccatgataattggtcctacatatcatatatatatatatatatacacacatatatatacacatacattttaaagttcgtgctacagcgatgtatatctataacccgtttttcttctctcctctctcttatctccttcacgtatgtttatactgctcttattacctccggtcaccggcacgtacggacgtgacgacgtcgcacgcgcgcgcttataaatgcagccatacatagtgcgatcgtttcgtggccagagagagagagagggggagagagagagagagcagagcttgaactgaccggccggtgcagtacaaataaaaattatacgagcaatcatgtggttgctgccgctgatctgcttcgtcttggccttgctgctcgccgccggcgccagcggtggtggtggtgccgcggctggaggaggaaatggcggcggcggcgagcggcgtggggtatacgtggtgtacttgggcgccgtgccaccgcggacctcgcccaacatcctccagcagacccatctccgcctcatcggcgccgtgctcaaaaggtccatcgtaaaataaattaatttttaactctcttcctgttggtgctaatgtctctcaagttgcactagctagcagtagcatgcatgtcagtcaataagaaggtactcgctcagtttgccgatttgtagcatggcattaaatatattctctccgttttatattagaagatgttttaatttttcaaagttaaatttctttatatattagaagatgttttattttttaaagttaaatttctttacgtttggtcaagtttacggaaaaatgtaacaagttctacgatactgtgttagttccattcaatctaaatactgattttttaaaaaaaaatcacgatagacatacacacgccactacatacgcagcaccgcactcacaccctcacaaatggacccccccctaacatatgctctaagagatagaaaccaacggcacatccttgatctaacaaaaatcctgttaaaaagcacatgcagaccatcgacatatcccttatctcactaaaattctattaaaagtctacatgcatgtgcataatattcgtgggcaccagaatttgaaccctggttagtagaatcatacactcacgactccgctaccacaccactagtgtttttccaaatattgaatatagtacgattgtatagtataaaaactatttatatgtttttcttgatcaaacatatatgatttgacttaaaaaaacaaagcatcttataatgtgaaatagaggtagcagttttctaaaaaaaaactccatataaattaaaataagcagacattgttacgttaatttaaaaacccgtgtacacttctctcactttgctacagtgttgcacttcttgttaatttaacattgtctttctctttaactattttcaatggttgaagattattttaatcttactatcgttatatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcagcagtacaagtacgccttctccggcttcgccgcgcggctgtcagcggcggaggccgccgcgctccgccggaagcccggcgtcgtctccgtcttcgccgaccctgtctaccacctccacaccaccaggtcatgggacttcctccagcagcagacgacggccgccgtcgacgtcaagactggcggctccgcccaccgccgccgccgctcgccccgcgcccgcgccgccgcagcatcagcgtcgacgtcgtcgtccccgacggccgacaccatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttgtgtttaattaagtttataaaaaaatagcaacatttatgatacaaaattagtttcataatttgacgtatattttgatacaatgttggttttacattgaaaatttactacttctactccctctgttttaggttatgactttggtcaaaattaaactactctaattttgactaattttatagaaaaaatagtaatatttttaactcaagacagatatattatgtaaatttattcaattatagatttaacgaaattatactggtattgtaaatattatacttttttctataaagatagtcaaatttagagtagtttgattttgaccaaagtcaaaacattttctaatctgaaacggaagtagtataatttggtcacttaaaaaaattaactaagaaaaaagtcattacaaatgacttgtaatatgaaacggagagtatatatcctgatgtttcccgggcggcgcatgcaggaagctgataggagcaaggtactacgatgtcggcggcgaggcgaagcggcagtcagcacggagcagcgggagctcgccgcgggacgaggccgggcacgggacgcacacctcgtcgacggcggccgggaacgcggtcaccggtgcgtcgtactacggcctcgcggcggggacggccaagggcgggtcggcgtcgtcgagggtggccatgtaccgcgtctgctccggggaggggtgcgccgggtcggccatcctcgccgggttcgacgacgccgtcgccgacggcgtcgacgtcatctccgtctccctcggcgcgtcgccctacttccgcccggacttctccgacgaccccatcgccatcggctcgttccacgccgtggccaagggcatcatggtcgtctgctccgccggcaacgcagggccggacgccgccaccgtcgtgaacgcggcgccgtggatccttaccgtcgcggcgagcacgatcgaccgctacttccaatcggacgtcgtgctcggcggcaacaacaccgctgtcaaggtatatatcacaaaattaaatatatctggacatgttctttttcccagattcgttgtattagaaaaaatctcatctatttctaatatctcatccgtctaaaatccttgtgggagcactctcttgtgatcttaactaccccatttttatggaatctgtagggtggagctataaacttctccaacttgaacaaatcaccaaaatatccattgatcaccggtgaatcagccaagtccagctcagtttctgataccgagtcagcaaggtacgtactacaaggcaagcttagtaacgaaacaaaattaaattaacagaaagtttcagcagaatctgagtaagtagtttcatgcccaaaaatcaaatcataaccacaaaataatttgtagtcactgtgagccggggacgctggatgcgagcaagataaaagggaagatcgtgctgtgtcaccactcgcggaacagcgacacgcccaagacggagaaggtcggggagctcaagagcgccggcgcggttggcgccgtcctcgtcgacgaccttgagaaggccgtcgccaccgcctacatcgacttccctgtcacggagatcacctccaacgccgccgccgacattcacaagtatatctcctccaccaggtactatacgtagtccttcacactatagcgattatatactacctccgttttttaatatatggcatcgttaactttttaacaatcatttaatcattcacctttatttttttttcaaatagaaaaatatttaagttatatttataaaacatttggtaataaatcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacatcctcaagccggacgtggcggcgccgggggtgaacatcctggcgtcatggatcccgacgtcgacgctcccggccggcgaggagaagccgtcgcagttcaacctcgtgtcggggacgtccatggcctgcccgcacgtggccggggcggcggccgccgtcagggcgtggaacccggcgtggagccctgcggcgatccggtcggcgatcatgacgacggcggcccagctgaacaacgacggggcggccgtgacgaccgactcggggtcgccggcgacgccgtacgaccacggcgcgggccaggtgaacccggccgccgcgctggacgccgggctggtgtacgagctcggcgaggaggactacctccagttcctctgcgactacggctacgacgcgtcccagatcaagctggtcgccgcctccctccccggcggcttcagctgcggcgccggcggcaacgccagcgacagcaaggacctcatctccggcctcaactacccgtcgatcgccgtcacggggctcggcaaggccggcggcaccaggacggtgagccgcgtcgtcaccaacgtcggcgcgcagcaggaggcgacctacaccgtcgccgtcgcggcgccggccggcctggacgtgaaggtggtgcccggcaagctggagttcactaagagcgtgaagaagctgggtttccaggtgtccttctccggcaagaacgccgcggcggcggccaaaggggacctgtttgggtcaataacgtggtcggatggaaagcatacagttcgtagcccattcgttgtcaccatctgagagtgagatcacacacatcagtgtgcaagagagagcacttgtgtatttctaatgaaatatgggactgtctagatgacatatgacagaaaaacatctcacaaatcatacaaattctagaccgttggaccattttaagatttctgatttcgtgtgtaatatttctatccctaacccccttcccccctcatcattccagcaccgccgccacctctcgcgagctcgtgcgcgtgcgatgccttcgccgtcccgccccacactccgccagtacccagcctcgtcggctggcaggaaggggtcaacgatgcaggtgagccccccctccccccaccccgaccaacctccttcccctctacctctcttccccaaccgacggcctaagtgctcctgccccgccatctaaaacttgagaagtgaagccacgccacatatttcttttgtcggcaaccacagatttcacaaatggagacttccctattgtttgatcgttgaagtgtctaacgggtctagctgtgtttcagagcttatttggtggctccacaaactagatttttttataacgaaaataagagtaaattttagaaaattatagatactttggtcaaattaccttaaaactacagatttaataataaaattatcacaaaactatagattttcggtttaaatccttagcaccaatgttacgtttgggttataaatattcaagttttgcgatcaaattgacattaaacatgtagttttgtgataagtttgttactaaatttgtagttttgcaatattccaacttaaatatgtagttatgtgataaatttagggttaaatatgtagttttgtgatacatcatgttaaatttgtagttttctgataatttggctaaagtaattgtagttttatgagatttactctaaaaataatttacatatccgacttagtatagcataagttataagtttgtatagaacttaaaaatttcgactaacatggcgaggctgagtcagcgtgtgacatgtcacccccacatgtcaaggacctgtcttattggtttccccgctcttccccatctttccagggcggccacacgccgaggagaagggcagcggtcagtggttgggggccgacgaccgacgggaaaggagttgtgcacgcggcggcaccgagctcgagcggccgcctcatctcctctcttcgcttacgactgtgaccacgccctaccccaataactcccctacactgctcaaatagccaccttgtgaggacgccaagaggctcaagataaagattgagacgacgacaatagcaatgcgcacgcatgagagagaagagatggaggagctagaggagaggaggcaactggttctccgttgctctcctagactatcagttgtgcattaggagagattgaaaagaagatgatggagaagacgggacaaagagaatgttttccatcctcggtctatgttggcaatacgatgaaagtggcaaaacatggtaatataactctaaacgtgatatatagagattaaccactttggcaaatagctatataaacatttgataattttggggtaaaaaaaactttcaaatataactatagtgtaaatgagatgtaattatattttttaactatttataatgtaacttatacgtaactcgcatataactaattaaaaccaaccatatttccagatggctagagatggaactttgcaacttgctggtcgagggtttgattcccttttgttttctcctggaacgaatgtcgccggtcataaaattgaaagttttggaagataaaaactgatttgtttttttcctttttgttttggaagataaatccgacggaaacaaaattaaaagttttgaaagataaaggttgtcattggttggccaattgcaaatgatacgccaaacaacattttaacgataaaaaataatttatgattaaaacttttaccaatgtattcttaatgactttaacaccaacgttagaaaaaaaagtaagataacaacatcaaaattaacttgaaaaataatttttagttatgacattagcatatacaactttgtctaaaaaataaatcctaactacgaatctgaataaatgcgtgtcaaggttcgtagttaggattgagttttttatgagacggaaggctagaaggggtacgttttagggggaaaagacgtggcccaaacactttggaggtttttttagcaactacagaggaagcctatgcagatgtgtgggcaatttatttattgttcataaaaagaatactaaaagaaatcatatcttgctatattcattataagagccctagattaatatataatgtttaaagaaaaaaatatttaaatagatcaaagatatgcactaaatgaaaatggctatcatattctaacagaaatcactttgtcttagttatatgtaaacacataagtgtttttttattaggtagatttaaacccagtcacattttgttaagaaagcagctgggttaccaggcgttcatgataggccagatcgttgctatgatggttcatacatgttcatgaacttaatgtttttctcgcttattgaatgtagttttgtgtgctgacttttttctcacaaatgagttgtttgttcataagtataattttcaacgtttgcatgttctctgtaaaattatatgtttaacactcatactaaatccttatattgtttgttgcgcgcatccacttaattgtagggcttgttcattttgctaccattttcaaccttaccttttgttttttgcaaaattacccaaaaagtggctacatttagttgttgtcaaattttagtaagtacatatgaaattttgccaaaatttggcaaccttgccaaaattttgataaccttatctaaatttagcaatgctaaaacttggtaaagttaaaaatgatagcaaagtgaataagccttagtacaaactcttagtacaaactaagagtgaaaggtcaaaaggtataggtttcttcactgtcccaacatcattggtgtttactcatcttggtgtattattgttagatgcatgccttttaaattgtggggtagtgaaatgcttgaaagttgaaacgtgaaagcgtcactcatacgcatgcatactgctattctggcgatttaccagttactagaatatcctgcatagttaatcaataaaaaccattgttttatgtggaatcctatatgcttatatagttcatccccactaagtgtaattaatgttatttctctcttctatcattaagtcacgtcactccaattatttttagccattggatgatagatctatggttcaaattgtcttctttcttctctcttttcgggaatacgcaaggagcgcatttttttcattaagagaaataaaagttatttacaatgataaaaggaaaacaagcaggggaccaatacaggatactatgaaaaactataggaatatctcgcgctaaatttggctaccacgacctcgtaaaggccaaacagcggggatcccgtgattagccgacttccaaagcatggcctcctctgccattgctttcgccacttcggtccaagacctttgttgttgattgaagattcggttgttctgttccttccaaattatccaagtcaccagtgtcacgacttcacgatagtgtcacgaccagtgtctcttctttcttctctcataacaccaagtaatctcaattatttttaggcctcaaaattcataagtaccattttgttttatttttaatattcatatttcatcttatttgtacatattgtgcaacttaatttcccgcaacaacgtgacagagtatttatctagttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgtaattagtgtatgtttaatactccaaattagtgtccaaatatccgatgtgacatggacttggaacaagtcgctggaaatagcaaaactgaacatcttctgtatcaacctgaaattacgcagtatttgtacttcagtactgctagaggcaagatcaacaaagaaagccatgggagttgtggaagcggcagcggcagaggcagcaacattgatgctacagagctgcttgtagttgtagggttgtattacatcacgaggtcatgactcatgtcaaatgaataattgggatcaggataaagatccaatgcagtcataacagagactgcaactttgccagtagaaactcttttccatccttggatcaagacaataacgactgaaaccgacgctacagtgtagttttaaacattatctgctacagttctagctacagcctacaggagaaaccttggtactgtcttttgtgaacagtattcaggaagatttcttttttttttttttttgagttgattcaggaaggtttcggatatcactttctatagccactgcaggtgatcccaattcatctaacacatctcacctcatcttcaaatcaaacacatgctaaacaactttaagtggtaaagttgtatgtagtttgtacacatgtagtaagatcaccgtgggaagctcgacgatagcaaaaaatcccgctccatgttgtatagcttgctagtagtgtcggtattgctcagttgaggtggtagacagtgcagctcagctgaaagcccttgcaaaatgtcaccgcctaacagcctttccagccttatctccacttgcctcattgttggcctctcttcccccttcaatcttaggcatgccgatgctagcgccgcgacttctttcacattttccatgccctccgaaattacctgagggtctaatatctcgtagatgttgtcctgtaccattagcaaattaaaaagtgcaattaggctgacattatctgatgattcaaaaacagtaggcttcttccttgtgagcatctccacgagtatgacaccaaaactgtacacatcactcttatcggtcaatctacttgtttgatagtattcaggatcaagatatccaaatgtgccttggatcactgttgtcacaccaccttgatcaaccggaatgcctcgagaggctccaaagtccgaaacttttgctgttaagcgaccatcaagcaatatgttagcagacttaacatccctatgaattattgatactgaagcggatgaatgtaagtaggctaaagcgcttgcagcttcaagagcaatcctcaatctatttttccatgacaacaatgtagggccttcaacatggagatggtcggaaagagtgccgttcgatatgaactcgtagaccagtagtggaacctgtgtttcaaggcaacatccgaataaccgcacaacattccgatggttgatctgcgaaagaatgacaacttcgtttatgaaatcatcgatctccttacgaaccgtaatattcgatttcttgatggcaacgacacgtctgtctggcaaggtgcctttgtagacagtgccatggccgccgctgccgagctttctcatctcgtcgaatcgatttgttgccttttcgagctcttccaaggtaaacaccatcctttcagcaatcaccttatcaacaagttgcagcagcagtaaaccccggttctgcttgaagaatacggctctcagtttcttggccctccgtgccttgatcatgttcgtcattgccatgcctatcacgaacacggatggaattcctatgccgatggttcctcctatcgccacaaggagagctgccagcagaagatacggtcaaatttctgaaccctgtttgtgcaaggatttgcagagaagattgcaaggataaatttaagttatgaaatgaagagaaatttctatgtactcgttggttcacatcctccttcgttcatagcatcaccgtgcgtcccacccggacacatgcacgaaaacgatcctggcttgtttgtgcattcaccgtagcagggatattcttctggcagagcgcactcgtcgatatctgaaagggagaatttagaaaaattttgtaccattctgttctaaattccactaatcatttgaactatggttggtaagccatagaaaaatatactaaacgaacaaaaataatttataaataaaactattaatagcggtttaaaattttaacggcaaaagattgactataataagaaaactaaaatcaactttaaaattaggttttaaattttagccgcggctcataatctagcaagcaaacgatgagaggctatacttatgcaacttcaagtgtaaatgactaatccgttaaacacacttataagctaaaatattaggaaatgatttaatatcaaactaaatagaagggtgaggcatcgaacccagaacagctagcccaccaccttgtgaagctaatcagaagaccctcagttgtttctccacttacatggttacacccttatactccctccatccctaaatgtttgacgccgttgactttttgaaatatgtttgatcgttcgtcttattcaaaaaaattaagcaattattaattttttcctaccatttgactcattgttaaatatacttttatgtatatatatagttttacatatttcacaaaagtttttaaataagatgaacggttaaacatgttttaaaaagtcaacggcatcaaacatttagggaagtagggagtaacaaattaccttgacatccatttgcaacgtacggattgccttggtacccgttgtcgcactggcacgagtagccgccaagcgaggtgctggtagagttgcggcagtagctgttgctgctgctacaggccgtgtcgtcgggcccatgcggcggacaccccgacttcccgatcgcccagtcgagcacggccagcgccaccggcatgccgccgccgcccggtcgcatcgtcgctgctgctgatccgagcttactcgcgttcccgccgaaccactcgttgtccgcgacgaacacgagagccgaatccgattggttagacgacgaggcggaggaggtcggcggcggcggcggcggcccggtgcttgtgccgaacggcgacagccgaacgccgtacgacgtgaggcctaggtagatggaagcctggcagcagccaacgcccgcgcacgagtaatccgcgagctcgccgtcggccgctgctggccaggtggcgccggcgccgccgcagatggtggtgcacgcggcggcgatgtcgtcgccgtccaggaggacggcctgcaggttgcaccccacgacgacgagccggttccgccgctccctgaggcggaacgcgccggcgaggccgcggccccacgcgccctcgcctttggcggcgtcgtaccggacggcgctgctgacgatcaccgtggagtttaggagggatatctcgagcacctcagcggcgtcggcgtcgcgcaggaagagcttcggtgggtggtaggagcggttgcaggtgacggcgaagccggcgaggtggcagccggcgccgacgccgaacgggtaggggatgaccatgctgccgcacgagctcgggcagcccggcagcgatacggttagcgcggttgttgccgccattgttgcagcttggagaaacagtgcagccataacaaggataacaggagagggcgccatggagctgatcgattcagtggctcgatcagcagaagaaatactgaagaatggctcacccaagacgaagagtatatacgtccacgggttttgcttgacctgactgaaggagtgaagccacgccacagattttcttttgttcggcaaccacagatttttcatagatggagatattgatatccgatcagtcactcagtcatcgtgctagatcagtacacgccgcgttttctgaccgtgctgtttaatttgtgactttactagtaacagtatatggggactggattctaatagtacatggggagtgtctagatagttactcccttcatttcaaattgatcatcatataatgtttgtgcaccaagactaaggattatttaaactacattagtcaacacaccatacaaaatatacacacattctcccatgatgcatatagtatcgactaaaacacaagcatacaccacattatacgatgttatattaattgtattatgatgaaatccatatgtccacatggttatataatgatcattttgaaaaaaaaatgattttccttatgtgatgttcaatttgggaaggatcaaagggagtataatgttgtgatgatgatgatgatgatattggagtagtagactactacccccgtttcataatgtaagactttctagtattgcccacatacatatagatgttaatgaatctaaacacatacatatgtctagattcattaacatataaatgaatgtagacaatgctagaaagtcttatattatgaaatggaggaagtatttactgttacatgctagtttgttctagctcatccttgttctttgaaaaacaaatcacgaagttgtgcaagaaaaaaaactcaaaggcttaatcagtgctaaaatctgcgtgaattgttatgattttttgaagagatcctggcttcgtcactagtaagtagttacagatcagataaagatgatgatttagcccaaaaggtgttactgatcacactacttgtactttccgcaagtcatgcactcgatcaaatcggcaaaacttaacaactatatcaaattatcaaccagaagctacgggaccacctatatatttgtcgacaaattttcttctaaaaatttaacatatataattatagtacaatcgtagtgtaattacactgtaacttatatgtaattacactgtaacttgcatgtaactacagtgtaatttgtatataagtttcatgtaattttgaatcattaaatctattacaagatttgttttggtgaggaagaaaaaaaatcacagcatacagtataattacactacgattatactgtaattatatctgttaaatttttgggagaaaatttgtcgataaatatataacaaaatcgttttggaaggcccgtctcttccttcccgccgattccattccattccacccgcgaattctaggcaccgggccagtgcccagtgggcccctcgattccaggcccaatctgacccgtcggatccacagtcgaacgcatctggaccgcccgtctccgcggtgggcccagcccacaacgggagggaggagaggagagaggaggcgactcgctcgcccgcatccgcatgacgcgcacgggaagcggccgaggcgagcgaacgcgagacgatcgagtcggaggcgaagaggaagaggagcgatcgatcgatcaagcgcgagggggagtgggagcggcggcgggggaaatggtcgcggcggaggcggcggcggcgccggctccaccgcatgacgccgtcgcggcggtggcggtggggatggtgggg

SEQ ID NO: 30417 - DNA, 2814 bp, Oryza sativa
  unsure (1)..(2814): unsure at all n locations
ggggtggggatcctgctgcagatatcgatgctggtggtctccttcgtgctcggccacgtcctccgccgccgcaaggtctactacatccccgaggccagcgcctccctcctcatcggtatgtgttcccacccagttacagcattttgggcttgtggaaactgaagaatgccgatcgtcgctgagggtcctatcgattcatgtgtctgacttcgcgatcgttgtgtatttgcgacgccgtgcgatgctttgagctagcgcatttgatgcgggggtgatcgtgtttggtgttgtttactgacgccgaatgaactgtttattcacacgatgtttagtggcgagcagtaacggtgtgagtgtgtgattaggaggaacggcttcgactgtgcgtttatgcacaaatcagacgaacaaattttgcattcacgacgcgcgctgtagtctagttcgagctgtgcttttccaaaatttactgtcgatggttgaggattggttgtaacaggtgagggctttggaggataaaatgaacctttaaaaagttggcatgtagcgcaaacagatgtcttttccttcagataagcgtatttccgttacatttcagtagcttagcttttactgatttctgattatctaagataagtgatgtgacatttgggtttattctagctacgttttatttggatcatccggtggattatcatatactatttgccttggaaataaaacaccctagctaagatggatcttaccattttatttaatagtttgtagagcctagaggtacattgaaaatgttagaatcgtatgacaccatattattacgaaattatttaatagcttttcttgtcagggatgattgttggcggccttgctaagatatcaaacactcaaagaagtattaggtgataatatttcttattactcactgtatacaatttttccctgcaaaatatgacatcgctgttaagtctgaacattttgtggtgttcatttgctttattaattcaggagatggttcaattttcgggaggacttcttccttcttttcttacttcctccaattatattatatccttttttgtatcttgattttgttttttaattacttgtacggaaatttaccatgttttacttgactgaatcttactcagtctggattcagcttagcaccagtaagtgtggaattcttggatcctcttagttagttaaattctactcttcgttggttaaattctatcattctcagctaattatatcatattttttcctgatagaaaccattcttttcaaattttggtgccattataacatttgcaatcttgggaaccttcattgcttctattgtcactggtcttttagtgtaagagtatcttctatattgcctccattcctattcgctgatatttatttcatctataaaaatgtaatttatatttttccatttgtcacagatacgttggtgggttaatatacattgtctataagttgcctctggttgagtgcatgatgtttggtgctctggtgtcagcaactgatcctgttactgtactgtccatatttcaggttccttccatatccctatacagactatatttacaaattttgagataaaaggatcacataatgtccatcaaatcgcaggaacttggcactgatgtgaacctctatgcgctggtttttggagaatcagttctcaatgatgctgtatgcataaccctattattatttaatactagctgtttttttttatttctactgaaatgtgcatatttcttcgtgtctaactacggtttggaaattaaggtggctatatccttgtataggtgagaatgtattgcctgagctccttctgcctatatggctccttctcagaatcctgtcattaacaccttgaacttttcaggagtatggcttcactgagaacaagttcttctggacagaactattttctagctatccttaagtttcttgagaattttgttggttcaatgtcatcaggtactgtaccttaaatatttacaaatgcctttagcagaagaaatttcgagtcgcctatgtattttgctttttccattggatttcttgacttcgcttgcacttatgattatatatgagtatctatttgtactttaacatttgatatttcaattccatttttttatgtgcaggtgttggggttggattcatttctgccctcatatcctttattttgacattttctatcagtagagacctaatgtatattttttatttacacaaagtaaaactgataaacttgttacatgtatgtgatggtatcacctagttttttataacatatattaaattagtttaatatctgtaaagaaatgtatacctgtttgcaccctcctgaaaatttatttttgttccaaaacactgtaggggaagcccccacagttaaagatttattaaattgaaaaggaggaaacaattacaaaagttcaagcaaagagttaaatgctactctctcagaggggtttagtctatgtaatcatcctgaattcccactttttgctatcaaaacttagaatactcctgctggatcctcttagaaaccaatatgttattgttgcatgccttgagcattacctttccagggttgacaagaaaattcaatatgtttaacgtgtaatcatctttttggtctatttacaaacgttttccatttactctggagaacaaaaaaggcaacccccaccatgcaacaatatttaggctatgtacatggccagatcaacaannnnnnnnnnnnnnnnnnnnnnnnnnnnnnnnnnnnnnnnnnnnnnnnnnnnnnnn

SEQ ID NO: 30418 - DNA, 1012 bp, Oryza sativa
cttattacatattatagataagcaactttgcaggatgatattataaacatgcttacaagaagtgaatttttatttcaggttatgaagagatacaccttctataacttatcagaagattctcagcgttttacagctcgttttttccatctactttcatcactagcagaggctttcgtgtaagcaagaccttcaagtgcaataatttaacaagtccaaatactgaaactgtaatgcatttacacaggttcatatacatgggatttgatattgcgatggagcgtcaaagctggtcacatattggattcatttttttctcagttgtatccttcgcattgattacacaccaactcttacccatgcttgttacgaatacaataatttcttcttgtttccttaatttttttcccttttgcttatgcatccagatctttatattacttgcaaggtattttcttctccaacggaactgtctatcttttggtctgatgttggactagttgctgagtttttggagatgctttctgtgtatttatacaagcttaagccccatagctatataattgtgccgattttctgatattatcttattttaaagggccgcaaatgtcttctcttgtgcatatatattaaatttggcacgaccggtgcactgccaaatacctaggcagtatcagctggcactctggtatagtggtatgtaattatgtatgcccaaaaatgtcataaaataagtttcatgtttgtactgctaatattgttggttttttctttttcaggtcttaggggggcaatggcttttgcccttgcacttcagtctattcatgatcttcctgaaggacatggcgagacaattttcaccgctaccacatctattgttgttctaactgtaggttaccggttgtaattcttgtgatgttacataatagccacgactatttttatgcaaaggattttgtatgtatcagttcatgctattctatgaatcattctaaatgtctttttatgcaaacat

SEQ ID NO: 30419 - DNA, 1864 bp, Oryza sativa
cgtcgggttttccaaagcttttgcaaaccaagttttacccaagaagttactcagattttaagtttgaaggcaaccgtcgatactcgcacagagtgcacgaatatcgaggcgcaactagatggttacaagggaacatgatataacaattaacaatggaaggatcagatgcaacaagttgggtagacccaccggtctgcctttcagacggggcaaacaaattaagtgtaatcctatcaatgcataatattttgcaagcaatataattaagttcaaatataggctcaatatgttcaagggtggcttgccttgctcagggtcttcacgaagcttcatgaatcttcaagatatccacgatcgacgaaaatccggtaaccgcaactatgcgcaaacagacaaaaacctaaacaagagaccaagaaaaagaccctatttagactaaataatagtgccattaaatagatctcgattttacggaaatactggaagtagaacggggtcaatcggacgattggaccgagagatacgaattttggaagtttaattagaatttctggcgaaggaagatatttgtggaacaaggggagattgattcatgaaatttatagaaataatattctcaagaatattattgaccgtctctgacgtgcgggaccaaaggaaatgatttataaggaaaatgattcatgaaattttggaatagagaattgatttatgggatcaagggaaaaagatttattaacccacggaataagataaaatgatttactgaatttatagaagagagaaatatttgtggaatattggaaagacattctcaagattatctttgactcattgacgagtggggccaataagaaggtgagagagagagagaggagcaattggagggagcaattgcggacttttagctcttcggtgtgtgagcaccggactcggaagagggagtaaaagtaaacttcctttgttttgttaggccgaggaggaaggctggccaatgggccaagcccacgagccaggggagagagggggagggggacggctgaccggctgactgggcaggggcgggcccggtcaacgccacgtgggcagccacgtcggatggggagagaaaagggaggggcgggaatggcatcggacggctcacggcgcgcggcggaatccggcgaacttcggcgagccgaagcgagtgacgaacaccggtggctagaggaggtcaaggcgaaccgattccacggctcggattggggagacgacgcgtgacgacggccggcggcggcggcgaagctcgccgggatgccgacgtggatgcgcgatgggaagggatgcggctcgcgcgctcgggctcagtggacgcggtatggggttgcggcgcacacgcggtgacgcgggacccgatggtcgccgggctgtggctcgcggcggcgccttgcggcggcgggaggggcggcacggcgcgggagcgaggaggaaggtcggcggccagggggaggggttggggaggtcgaggggggcccgaggaaggtggcggcgccgggaatcaaggagaggagggaggccgacggcaggggaggcacagcggaagtggccgagcgcggcagcggcggatcgggcgacgcgacgcgagggcgagaggggaggccggcggctgaaacagcggcttggggaggtagagagggaactcaagaacggcggtggctagaggagtcgccgagagggaggccaacggcggctctcgattgcgcacggcagcggaaacagagcacgcgcgacgcgagctacgcgagtgctgggacagcggaaaaagggaggtggggagctcaccgacgggaggtaatggcgtcggcggcgagttgaggatgggaag

SEQ ID NO: 30420 - DNA, 539 bp, Oryza sativa
tccgtcccttggcggcttgcgcgcggagtggcgggggccgggcggtgacgacggcgatgacggcgggcgatttggagcggcgcgacgacacgggcgacagacgcgcacagaggctgacggcggcggcgaccgggcggtcggccactcggcacgcgcgcgcggcttgcaacgggcggcatccgcgcgggcgtgcgcacgcgaacacggcgcgcgggaagtggcagcgagggagcggagagggaggacttggctcgtctcgggcggcttacgcaggcgcggcagagcgaggagaggggaagggggcgctcggcgcggtggctcacgcgcacgcgcgcgggcggagcggaggaggaggagcactcggcgcggctcttcgcgcacgcgcgcgcggcgcgcgggcgaggcggagcggaactgagcggggggggggggggagcggaacgcgccggggaggggagagggccagagagagagagagagagagagagagcgcccgggaaagggggagagggagccccccgggagggaaagggcggggg

SEQ ID NO: 30421 - DNA, 618 bp, Oryza sativa
catccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgtccgccccttcgccgtcgctgtcgaccgctggaacaccatcggcgtcgtcaagccgaaagtcgtcgccgcttctttctcgtcgccgt

SEQ ID NO: 30422 - DNA, 1488 bp, Oryza sativa
aactctctccttggttccttcaaaccgattctcaaattcgaattcaacctcttaggttttgattcatctatctttctctctgtattggttcatcaatctaccctgttttctttctcgaacttctgacccaagtctgaatatgcaaatcgagatcacttccacccttgaactctaaatcccaagattcaatccccttcgccttgagttctccccaaaatgatttccgttccgaaataatcttgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatcaaccccgaaattcgaatctagactccaactctaaaacctcccaattaaatctctctgtgaaagtctatttaacctccctcataggttggattccttctttctttttccgatccacctcttccttctcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccatttttgaaatcctctgaaataatccttcgtgccgccaaatataaatccatcccaaaaataccaaaattcccgcttttgaagccctttcttgacccctcccttggatccaccttgaaccctcgtgtacaaatacacaaattgaattcaaattcaatctccacatcaaacttctctccaaatcaaaccttccagtaaaagtctattttgcctccctccaactcgctcgggccgaaaccatcctcggcccatcctcttctttcgccagcctctccatcgcacgtgtgccgcacgtgactccctcagagagcgccctctctctctctctctctcggcgtcgcttcccgccgacaccgcccaaaattccggccgcctccttcgattcccgcgcgcccgtgcgagtggccgaccgcctgggtgccgccatcgccaccctcggtcgtcgcctgccccgacgaccaccgtgtccgcgcttgccttcaaaccgtccccgtccttttgcagtcatcgccggcgtcatcctctcgggcccggcgccccatgccgcatgcatccaaaaccgtgaggcgcggctcgttctcatccctttcctcccaaaccggaaggagcaaagctccctttcctcctcctcctttcgctttttcccctcccgggtagcgagctccctgtcacaccccgaagttctcctcccaagccaaatttaatttgtaaacaaccccaagaaaatgca

SEQ ID NO: 30423 - DNA, 1197 bp, Oryza sativa
ccccattgatgacgtcagccctggaatatattgcgcaataaatgatttaaggtttttcttgtatagtaataaacatagtgaatcttctaaaattcataactaattcatccgagctccgtttaagcccattcaagtctcaataaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgctgaggtttctccagcagcagagcaaggcaagtcatgcttgtcacttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctgggcttgtagtatagctttcctctagtcgacgcatccaggcaagggtgggcgtgatggagcggggcgggccctgcgacggcctctgtcgcttccggattcacctaggcacgagagggggctgcccgttgcccgctggggacgggggtgaaacctgaggtgtggtgtgcttggctagagggggttatgcgaagggtcctgtcacggcctctttctgatatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttaaaattggatagtttaggtggatggttgggcctgtcgcaacgtgggttagcgttggacagtggatagttgatattg

SEQ ID NO: 30424 - DNA, 8799 bp, Oryza sativa
cgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttaaaattggatagtttaggtggatggttgggcctgtcgcaacgtgggttagcgttggacagtggatagttgatattgtttaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctatttttcccaaccccagagtttgagtatgtgtcagatggaggtgtctctgaggagtaggcttcgtccgtgccgtcgaggatgcctgtggagtggtgttcccactgcagttctagtcaaggcttagctcctgttgtctttcgtttttctgctgcatttatgtaagacttttatgatgtttgtaagacgtggatctgaatgtcaacattgtcgtttgtgtaccccggctggtcctggacgggattttaatgcacattctgcttgaaattctattcgggaatttctgggcgtgacaagttggtatcagagccaggttgaccgtaggacaagccaaatggaaaaacctaagagccctctgaatccttttcattgcatatgttctttgcaattggattttattccgggaaaattgggatctgttcttgtggttcaaggaaaaaaatcttggtcgctcgtttaagtgagattttttttcaaaacaagtcagtccagggttttagtaaaactgttgagatttattcgtcagtcagttgggatctgatgggtgaaatgcattaggtcatagctcaggaacatgggttgcaaggtatttatgctttatttgttattattagtatgtatctaatttctcattattttatcgttatgtgagtccgtcttatttattcgctctcatgtaaaatgatctatgcataaaaatttcgctcttattcgattcccttatttgagtcttttattgctttatttaaatttggattgagcatgcattgatcctactcctttgtcttccctagatggccggccacccacccaaccaccgcggagaaggcatgatcgactttgtggcagagttggcatgtatgacgctggtggtaggctaccccaacgcgccagagtacacgacgattccaccgctcagtggcgagcttcctcaccgtgttcgtctggaggtccacggctacgtgggtacctgcctagctaacatggtggtggaggcatctggaggcacagcagatcacgcctgtcaggaggcagcatacctgatgatggccagactacgggagcgccacaactacatcttccacgacacggcgtactggtttcaccctcgtcgagccagcagtgatgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaagagggagaacgctcagttaaagggtcttcccgcgccaggaggagtccggatccgcaccacgccccgcaagacgacgactgcacccgtgcgcatccagcttgcgcccaggaacccacctccatcagcagctcccgcagcacctccagttccgcccgcagttcctgcaactccagctccagctcccgcgtccgctctctccttcgctccagcatcagccgccaggggcccagccagaggcaacggaggttggttgtctgctactcccagtggcagccgcgatctcagcagcagcagctccagtggctcagagtcgggcagcggcgagacttatctgccagggtccggaagtcgctcagagggacctggtgacgagcaggaggacgccttcgattccaccgaccgcaggagccgttccgagcattaggctcgttttccattagtttaccgactgtctagcttctgcttgttagtttgtgtgtttaggttgcttgtttggggttagtcgacggtcgatatcatgtgcctatgatatggctgtcttaataaggatttttgcttgctctttaagtgttttaattcagatcagaacaattgcagtttaaattcctatgtaataaagcttagttcctgagcatctgtttttcttcttttcccccgtctgcttttccctccagatggtctacaccaggaatggtagccgcgcaacaggcgagggcagcaacagcgaagagcgcactgagggtgtgcatcccaacagcaactccggcaatggtccgccaccacttcccgagaatccgacgctagcccaagtgatggcacatcagacacagatgatggcagccatgatgcagcagatgcagcagcagcaccagcagatgcaccagaggatgctgcagcacgccgaacagcagcaccagcagtttggtccccctccccctcagtccaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgctagacggggtcgtggcacaaaagaagagggaatttcgggcacttcatcagggcaacaggactgtgacggagtacctccatgagttcaatcgcctcgcgcgatatgcaccagaggatgtccgtaccgacgccgagaagcaggaaaagttcatggcaggtctggatgacgagctaaccaaccagttgatatctggagattacgccgatttcgagaggctggttgacaaggcaatccgtcaggaggatcaacgcaacaagatggacaggaagaggaaggccgctcagttcagggtacctcagggaagtcaccagaggccgcgcttcgctcctgggcagcagggtggacctaccaccatgatcgtccgtcagtaccgcccgttcaaccctagcaactttccccagggcgccggtggcagtcagacccaccatagaggtcagtcaaaccgcggtgcagctccacgcccaccaatggcaccggcacagtcaggcccgcccgcgcaagccaagaaggagactggagcaaaaccagggtcctgcttcaactgtggcgagcttggccacttcgctgacaaatgcccgaagcctaggcgtgccgagccaaggtttatccaggctcgtgtcaaccacgcatctgcggaggaggcacaagcagcaccagaggtcgtactgggtatgttccctgttaactcaatccctgcaacagtactttttgattctggtgcaacgcattctttcatttcaaagaaatttgtcgggatgcatgggttaataagagaggaacttagcacaccaatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaagaggtctctttgaatcagattgaagcggaaatcccagtggacaccgtggagaagagtttgaggaaattggaagatatacccatagtctgcgagtatccggaagtgttccccgaagacctcactaccatgccacccaagcgagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaaccaagaacaaatatcctttgccgcgaatcgatgatttgtttgatcaactgaaaggagctaaagtgttttctaagatagacctgcgatcaggctaccaccagttgagaattcgggaagaggatattccgaagacggccttcaccactcggtacgggctatatgagtgcacggttatgtcgttcggacttaccaacgcacccgcattcttcatgaatctgatgaacaaagtgttcatggaatttttggacaagtttgttgtggtgttcatcgacgacattcttatctattcaaagtccgaagaagaacatgaacaacatctccgtctagtactcgagaagttgaaggagcaccagctatacgccaagttcagcaagtgtgacttctggtcgacggaagtcaaatttctgggccatgtcattacagctcagggtgtggcagttgatccatcgaacgtggagtcggttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacagctgagtgcgataagagttttgaggagctcaaaaagaaattagtatccgcaccagttttgattctacccgaccagatgaaagacttccaagtctattgtgatgcatcccgtcacggacttggatgtgtcctaatgcaagagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaacctccgacaacgaagatggttggaactaatcaaagactatgacatgggtattcactaccacccgggtaaagccaatgtggtggcagacgctttaagccggaaaagttactgcactgccctgtgcatcgagggtatgtgtgaggaattgcggcaggagtttgagcatctcaacgtgggaattgttgaacacgggtttgtggccgctctgaaggcatggcctacgcttgtggatcaagtcaaagcagctcaagtaaacgattctgaaatagcagagttgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctaggatcagacaggcgagcgtcaattgttcgggacagaggtattagcgaaagcggaagagaaagtcagaatcatcagggaaaggttgaggattgcccagtctcgacagaagagctacgcggataaccgttgaagggagctcacttttgaggcaggggattacgtgtatcttcgtgtcactccgctccgggggagtacaccgctttcagacgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttctcctcccaagccaaatttaatttgtaaacaaccccaagaaaatgcaggtgcaaatcaagagaaaaccctaagaaagtaatgcaaataataatcggattgggcatgtggaatttttcttgagttctacatgtcgaaattcattaacaggatttttagtggaattttcagagctctagaaataactttaacgaattaaaattgagcaagcaatattttaattccagggaaaatcctttttcctttttctttttctttttcctctctttttcctctttttttttcaaatgggccgtcggcccattttttttcccttccttccccccctccctgctgggccggctgcaggccgaggcccagccaggccgcccgccgccctcctctcccggggtcgccgacaggtggggcccacctgtcgggtccttcccccacctccggccgacgccgcgccagcaaccgccgcgcccgaaaccgccgtcgcgtccacgcctccgcctcctccgggccacgtcgaccacgcccgcgcgtgcgccgcgtttcccgcgcccactcccctctctctcccgctcgcgcccgcgcccgagatggccgggattcgattttcgaatcccgcctctctcgcctcccccactcccccacgtcggccggcgattcccgcctctcccggccacgtccggccctctctctccctatttaagctcccccgtcgctccgtctcgctttttccccatttcgcctccctctcccgagctccccatcgctcccgcgctgtgcgcccatccgccgccgccgtttccgctactccggtcgcctctagccgccgctacactcgccgccgcaccgtgccgtcgccgccgttgggttcgcgcggccgaggtccacctcgtccacccctcctccgtagagattcgccgccggagcccaattgatgacgtcagccctggaatatattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgatgctccggtgtacttctgtttataaatgctcgctttatgcaaatgaaccacttcagctcttctttgatgattccctgcatcatacccctattccggtatgacttgctgagtacagtgggtagtactcagtcttgctctatttttcccaaccccagagttcgagtatgtgtcagatggaggtgtctctgaggagtaggcttcgtccgtgccgtcgaggatgcctgtggagtggtgttcccactgcagttctagtcaaggcttagctcctgttgtctttcgtttttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacactccctgcctccactccttggcttcttgttcaaaaggcagagccgctgacgccgctgcagcgcctcgccgcccccaccttgaccgcacccgctcgccccgcgccaatcctcccgtgctcgcggttcgatttccaccacacgatccaccgcctccaccaccctttgcatcctcgccgtagctcgttctcgcggcgcccatgaacaccagccgagcgccgagaaaaccgcggccaacctcgaaccgaccttgccgctcccactccgtctctataaacc

SEQ ID NO: 30425 - DNA, 2041 bp, Oryza sativa
ctccctccaattgctcctctctctctctctcaccttcttattggccccactcgtcaatgagtcaaagataatcttgagaatgtctttccaatattccacaaatatttctctcttctataaattcagtaaatcattttatcttattccgtgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcggtccaatcgtccgattgaccccgttctacttccagtatttccgtaaaatcgagatctatttaatggcactattatttagtctaaatagggtctttttcttggtctcttgtttaggtttttgtctgtttgcgcatagttgcggttaccggattttcgtcgatcgtggatatcttgaagattcatgaagcttcgtgaagaccctgagcaaggcaagccacccttgaacatattgagcctatatttgaacttaattatattgcttgcaaaatattatgcattgataggattacacttaatttgtttgccccgtctgaaaggcagaccggtgggtctacccaacttgttgcatctgatccttccattgttaattgttatatcatgttcccttgtaaccatctagttgcgcctcgatattcgtgcactctgtgcgagtatcgacggttgccttcaaacttaaaatctgagtaacttcttgggtaaaacttggtttgcaaaagctttggaaaacccgacgcctgggtcggtgccttgtgaaagaaaatgagttttaaaaataaaactcgcgacacagggccattcctgggcggaatacttgtgcggtcgcatctaaggaccgatttcttttgaattacatccgagcatacaatagtgcgatcacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcccttaggtcaccagacgtggccgttctacacgggctgggtgattcgggttagtaatgtcgtgtgggtaaagtgtaccccctctgcagaggttaacaaactgttcgaatagccgtgcccacggtcatgggcggatgtgaggtgattccttagcatagtttttgttttaccctgttttatgaaaaggtgttaaggtttgggaaacctaatgcttgggaagcatttagctgtccgggggacagtgggaccgggtgtccctggaagtgattggtcgtttggggaccactattatcgggaagtttggaaaattggtttggtttgggaaaaaccagatttgaagccaactctgggagttgtgcaaatcttgataaataaatttgttacttctcacctcccgaccaagctgagacttgtctcgctctggttgtggaaagcacacacttagattgttgaaaacttgaaaacaaaattgtttgcaaataacagccttcccttgaagcctgcattaaccacctaagtttccctggcttgctgagtacgaaagtactcacccttgctctatataaatatatatatatagttcctccgtcttgaagaaaagatgaagtgaagcgaagattagggtttcgtcctggttcccagccgtcgcctgtggtgttgggtgttagttcgttggttctgctactgctgctgctgctgttggtgtttcctcgtccgcgtcgtcggttgtattctcaggctgttctgagctacaacctaagttaaggtaaataagtcctctatttattttaagg

SEQ ID NO: 30426 - DNA, 2128 bp, Oryza sativa
tggcttgctgagtacgaaagtactcacccttgctctatataaatatatatatatagttcctccgtcttgaagaaaagatgaagtgaagcgaagattagggtttcgtcctggttcccaaccgtcgcctgtggtgttgggtgttagttcgttggttctgctactgctgctgctgctgttggtgtttcctcgtccgcgtcgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagccttccagtggttcgtaggcgccgctccaagccccgccaccgctcgccatggccttgccgccgtcggcgcccgctcccggaggccgcctctcgtcgccggacctccacggcgcctccccaccccatccgaacccagaaacgaaacccttgagccccggagatgctcccatccctttgaatcgaaccctcgtcgtctcgtcgtcgtttccccctttgctcgccgccggttgccgccaccgcgattcgccgtcgccggctaccctccggcaaatctgagccgttggctcactctctcttgtcctccttgtcgttccaatgtgctccccgttgccctcgccgtcgcatggtgtcccggtgaaactgccgccgtccgccgtccatctcggcctccccttcttcctcctcccgccggcccgcgtggctgccacgtaggcgccacgtcggcgccacctcggctttgaccgaaccgagccagtcagccgcctcctccctcccccaccctcgcgcgcgcggtccacagtgcgccaaccggctgcgcgtgggcccgccgcatctctggtccatccggtgcacgcgcgtgaaccgcgctcacccgaaaccctagtgccaccctcatgcgccgctcccacggtgagccgcgccactgacaagcgggccccactcgggaccccgcaaggtggactcagcccaccggccctctctctcccccactctccccgcgcctccttgggccgcctctccgggccggccggcccattagttcggccgagccgtgcctctcctctcgggccgcacccaagccgcccgaggaagtctaaatcatatccctccaatttctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgaagcttcgtgaagaccttgagcaaggcaagtcaccctttgaccaattgctcctataattggaaaatcattattattttgtttgcaacttgcattattagaatcacacacttaatttgcttggcctcggtttgcgtgccaaaccgatggacctacccagtagtcgcactaactcctgtaggttgtactaccctgattccttgtcgctccacccttgtggtacttcggtatccgtgctctctgagcgcgtgtaccaaatatcccacatacaccgttgattgtcgaaaacttaggaaatgggtttgtgaagccttcaaaacccgacatgtggtgtcggtgtgtttgaaaataaaatgaattgtgaaaactcgcgatgcgggagccgtgcctacgtggcgctgtcccgtattcgcatataaggaccgattcctatgggaaactcatcgagcataatcaaagtgcaatcacaaggtggaatgggacaccctggctaagtaactagtcggttcagggaaacctcgcatgccaatagttgggaacgccggggcggggtcggacaaaccgggttcttggtaaggcaaggacaagaagct

SEQ ID NO: 30427 - DNA, 3314 bp, Oryza sativa
  unsure (1)..(3314): unsure at all n locations
nnnnnnnnnnnnnnnnnnnnnnnnnnnnnnnnnnnnnnnnnnnnntcttgctgtttgttgtttaataaacaactgcaatttttgcttgcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatgatggaccattgtttgcccgcagtatgctggaacttcttccatctgttattgtatggctagatagtggatggtaagcttagtatgcctggttgctgcaaattgatggaatgatggaccatttttagcctgcagtattcttgaacttcaatttgttagtacaaggctatttagtttgaatgagtgatggaatgtttgttcactgttgatgcctgcaagatagaatgcctcgaatgtcttcttgctttgatcaattaaccatctgcagggaatttcgttgtttcaatcatctttggtcgacctcgagagctttctgtttccgtttcaatcatcttttcgttgtttcaatcatctttggtcgacctcgagtactacttagtagtagtggaccagtaatttctgcccctccgctctagcacaaacccaactgacgaactgatccgccggttgagagatggagcacatatgcgtttttgcgttgtgaggacatcgtgaggtacgtgtcggctgatctgctggctgagctcacgtgcatctgtatcggatcggaggcagaggttagaggtacgtgtcgattgcccgtcgtgagtacttcctctgcttgacacctggtgcactgccatggcgaggtggccatgaaacccgaatccctagctctatccacacacataaaactagtcttggattctactagtagtaggccaaaagcaacatccattataaacagtgttggatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatagacggtgtaagtgggtagactatgggtgttggtcggtgagccgcgaacccacttattttaatttataagtggatttgcggtttattttagcctacaagtggatttcacgccacttacactcgtaccataaaccaccgtaacatcttttcggttt

SEQ ID NO: 30428 - DNA, 1718 bp, Oryza sativa
tgtggtagtatagtgttcactgttcagtgtccagagagtgataaaaaaataattaaataaagcctgaaatgtgctactatcaggcacactgtaatactgttactagcccgaactggtttgcatcaaaaatatttttaacggttttcaacttcttccatgtcactatcgatgatgcttatttattgcagttttttttcactattttttccccatatatatgtcactgtaacaaaacaaaatgatcgattgattcatcatctcggattgtaatcagctgcatcccttggcgccgaagccgatcctctggttggcaacgtcgtacgcgacggcgaacgtcttctgctgcgtgttcccgaggatggcgatggacgagtcgtcggcgttgggcgcgaacgccaggcacgcctgcgacaccttggagacgtagagcacgccggtgaagtcgaggctgacggtggcgccgccggcgaacgccagctccaccgtgggtatctgcgccgtccggtggccggtgaagtcgtagcacgtgtcgaggatggacagcgcgggcgccttcttgtactgcgccatggagcgcgcgaacgccgcgcggagcggcgcgtacgcgcgcggcgggaggcgggtgatcaccgtgccggagtcgatcaccgtgccgccggccgccgcgaacgccgtcgccgggatcctgatcgcgcggccgccgaccttgatgccgacgaggtcgatgtagtagaacgacggcgtcgcgccgtcggccagcgccgtgaactgcgcgttcgccggcggggcgccgccgagggacaggtagcccctgccgctcgacgacgacggtaggcagtaggtgaatccggggccgtagctcggcgcgccctgcgacggcagcgacaccttctccctgccgaggccgaacagcccgtcgacctggccgaacagcccggcgttctggtcgccgcacccgaagacgaagcccgggagcgtgtccgacgccgagagcgtcagcgtgtcgcgcacgaggttgccgtcggtctgcgactggtcgccgtactggacctcgtaccggcacctgctgtccgacgagcagcccgacgcgtcgagctcctggcactccggcgcgccgcacgccacggcggcgtacgtcgacgacagcgacgggtcgaacagcgggtcctgctgctcgtagcagtcggcgcagggcttgcactgcacccacgacaggtcgctgccggtgtcgaagatcacggcgtactgcttcgccggcgtcccgagcccgacggacacgacgtagttgccggtgccgagggagatgcccctctgcgccggcagcgacacgccctgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgagaaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggca

SEQ ID NO: 30429 - DNA, 3560 bp, Oryza sativa
ggtatggttaaaaatggctttaatctgaaccgccccaaagctttttactgcactgaaaattttgtgtagtgatcagtcatcagcatgccaaaagtttactcgcatcaatcagcaacagattacctgatgtaattctgatcaatactactgtaaaacatattatgtttcccttagaatatcttataaattcgatatatgctgcatatgctatcacggtagctgagtttcagtggtactaaaatttcagaataatgcagatgctacttcagtcacaatacttgtttgcaggatacagactaaccatactccaaattggcctaacagatttcttattgggtttttcaattcctcagtttgatcaaatggacgagatttatataaagcaagttcgatcgagatggttaatggccgaccaggttacattatttttccgcagtaactgcttcagtttcagatacagttgcgaaaggagacaggctgcaaaactgacactacctttcgatgcagtgcaggccgagctcggcagcagcgagctgacgctgaagacgtgccagttggggtcgttcgtcctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtcaaagtcgtcctcctcgtcgtcggcggctcgtcgccgtcagccggccgcccgtgcgaaggaaaaagattaggttgttcgccacacacgctgctggctagctactagccggcgtccgatcaaggagcaccatggcattacacacacggcgacgactagcgatcgagctagtgacgaactgtcaactccaactcccaactcgatccaacttgattgcacgagcacgaacacgcgcactacggaggccctgtttagatttcaacttttttttcaaacttctaatttttttatcacatcgaactttcctacgtacgcaaattttcaacttttccatcacatcattcctatttttttaaacttctaattttagtgtggaactaaacacagactgagcgtaaattgccgtttagatcagtcgtacgtcaagtcggagccacttaaattaagtggatccccagcatcgctctaaatgtaaatgttcctatgatgtttagcaaagataaaggataagaaaaaagaattccggtcaaatttcgaattgtctggattcaccgtataagcacctgattgattagaatgcttgaattcttgcccattggaacctgaatgcgaaatgcttatattttaaaacagaaggattacgttgccatatatatatatatatatatatatatatatatatatataatttatttcaaatctagatcaatttggctacgatcgaaatgggcataggaaaatgacacctcttcccgttccgaaaggcaggcagagagaccgacctgtgtcacaaattgtgtaatatattgggtggtgaatgctgatatgttggaggttgctttcctgcctccaccacgccagaaagcaggaaatgcgtatgcatgcagtgctcgatttgctgatgcactgacaaagtgatcacaaacacagctggtgcgttgcaagcgtgtgtcattgctgcgtgagatgaaacgaaacgcgcattgctaattaagcgctgttcttgttgttcagtaatactccgtaattgtttagttggttcagtttagccctggttaggagttagttaaactatgtagttgtagtagtagtacataaacattgattcttgagaagttacagcgttgatacattgagaacatgacagaggatgagacattggcacacaaagggcaccaataagttacacacactcatatgattgatgcattccaatatgctccttagacagcatcagatttgattaattaactttgattagactcatgaacaacacatagcattttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcattgcatctggtcagtcagccgcgtgcagaaatgggcgaagaaactgtacaaagtgcatggctagctaacatttactgtcacttcatcgatcgcactgagtacgaaagacgagtagacgacgaccatcattagtgacgtccacgctaattaccctctcgagtcaaacacaggtgcaggacattagtgcggttaatatcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaa

SEQ ID NO: 30430 - DNA, 1387 bp, Oryza sativa
atgctttctgtgtatttatacaagcttaagccccatagctatataattgtgccgattttctgatattatcttattttaaagggccgcaaatgtcttctcttgtgcatatatattaaatttggcacgaccggtgcactgccaaatacctaggcagtatcagctggcactctggtatagtggtatgtaattatgtatgcccaaaaatgtcataaaataagtttcatgtttgtactgctaatattgttggttttttctttttcaggtcttaggggggcaatggcttttgcccttgcacttcagtctattcatgatcttcctgaaggacatggcgagacaattttcaccgctaccacatctattgttgttctaactgtaggttaccggttgtaattcttgtgatgttacataatagccacgactatttttatgcaaaggattttgtatgtatcagttcatgctattctatgaatcattctaaatgtctttttatgcaaacattgcaggtgcttctaattggaggctcaactggaacaatgcttgaatccctgcaagtagttggggatagtaatcgctatcgccatccatatgaggcaagtacttacaccgcgtatcataagtacatgcaaaaaacattatatttctctttgtttgccattaggttagttaaacaacgcaatcttatttatttgctggacattctcagcctaaatatcaaatgacattgcagttctatggaggatgcaattccattgcattccatgcactctccccatagggcttatttggatagataggtattacacacaatctttggatggtcacgattttttttctgttttcttgttcataatgaattagatctattcctttttttaaaaaaaaaactaattggttctctcttgaggtgcaacctgcttgttctacgtacaaaaaaccagataatagttatgcttaaatgatcatcatgggttattatttattcaataagagcacttactaacggaccgttggtgttgctgaatgccatatgcaccctaactatgtagctactatccgtccttgtttatctttcttacagctcatggattaacaccatagcattccggtggtttgccagttattgatgctgtacttacaatatgcagcataactttgatgggaacaatgctggctaccctgggcaacgttacggggaagaaacatcaacatcaagcaatttcacaatgaaactcaaagagctccagagaaggtacagcagttcacatttgatattgaagtgtatctactcattgctcttctttaagttgatttctaaaatgatgaacttttcattaaaaaatttcattggtgttaaagaccaacccagtgtagcccttaattgcagagt

SEQ ID NO: 30431 - DNA, 3914 bp, Oryza sativa
tgcaaacattgcaggtgcttctaattggaggctcaactggaacaatgcttgaatccctgcaagtagttggggatagtaatcgctatcgccatccatatgaggcaagtacttacaccgcgtatcataagtacatgcaaaaaacattatatttctctttgtttgccattagggtagttaaacaacgcaatcttatttatttgctggacattctcagcctaaatatcaaatgacattgcagttctatggaggatgcaattccattgcatcccatgcactctccccatagggctaattggatagataggtatacacacaatctttggatggtcacgattttttttctgttttcttgttcataatgaattagatctattcctttttttaaaaaaaaaactaattggttctctcttgaggtgcaacctgcttgttctacgtacaaaaaaccagataatagttatgcttaaatgatcatcatgggttattatttattcaataagagcacttactaacggaccgttggtgttgctgaatgccatatgcaccctaactatgtagctactatccgtccttgtttatctttcttacagctcatggattaacaccatagcattccggtggtttgccagttattgatgctgtacttacaatatgcagcataactttgatgggaacaatgctggctaccctgggcaacgttacggggaagaaacatcaacatcaagcaatttcacaatgaaactcaaagagctccagagaaggtacagcagttcacatttgatattgaagttgtatctactcattgctcttctttagtttgatttctaaaatgatgaacttttcattaaaaaatttcattgtgttaaagtaccaaccagtagtagcctttagttgcagagtggtacttttctataatttattatgtagtattgctgaggagcaggtgatctcctaatcgcttaaatatattttcctgccattacagcacctcttctttcgctttactggacaagcattaccttactcccatttttacctctcaaaacgaggacgataacagtgacggcgatgaggatattatcagtaagaccaaacctgcattccatctttctcttaactttatagtcaagcaatatcaaagatgctttccctcatcagaggcaaagcagtattggcttacttttttctccatccttttccgttcagcatttattcctggtaaataactatatgttctggtaaaacaagcagatgaatcattgaggaatgaggatatgtagaggtcctgcagatttggaggatcatgaactcatgattattgaatgcaaacatgacgcacgaaaatttttcaagagctgcgcattccaatcaagagcaaatgtttgagccatcagccatgtatacgtcacacactaggatagttcgacatgtatgtaagtaaagaggatcataggtgggaatgtaagattcgctaggttatctgctttctttaacgatgaagtttgatgaaggcacttttgctctaatcctatttttgatctgttgccatgcatcttcatggagttcagtgatgaaacttgacagtattgcttttcgtctagttatgtagaatcagcctatgagaatactaggatgtagcttcaaggcatgttttggttgattttctggggaattttaccctaattaattcctgcaaaaatttctattccaaacgtgcacttggcttccggtcacaataaccccacttatgtttttttccccctaatatatcttaaccaagagttcctgtcacgtcaaaatattttacaatatagtctaaaataaattaaaaatatttttttctataaaatgtgttacacatccttttttctttttgccttaatttgatgattttatatgttttcatatttgatttgattgtttttaatattaagaaatctataagaagtacaaatgtttcttttatatggcctagcaccgaatattcccaaatttccaatttccatcagcttccatagcggattggaataagttcgtttgttgttcctcatctttacatcgagtttatttggcatccctaaattgcaatactatactcttcactcttttatctttgcaagaccgttcaagtcaagttctaagataatatagatgtctgttttggctgatgtggcctcacatgtaagttgactcctcacctcttccctctcttccccatctctcttcctctcccctctcttccctcgcagcttgccggcggagagagggctggcagccgacgagcccatctgcatgaggtaccagtggaccacctcccacgaaccaccagtgcccgctcttctcctccgccatcacctgcatgtccagcatgcttaggtcgttcagcgtcgccacggtgtcgatcttgccatcttgggcaggcatgacatgctttgtgagtgcgccatggcggtggaggcctcccatcaccgccctgctcgtgtgccccatccttcatggtcgagggcttgccacgccgaggtaccaatcttcgtcgccgatagaggcatggggtttgttcagattgatgtcatttcaaaccatacaatttttttttgatagagttgttagatatgtgcatccatttagtttcttgtcaaactttggtaaatacacaagaaaacctacaaaaaatttgacaatattgccaaattaccaaaaattgataaggtttattttggctacaatctaaacaaccccatcgagccaaaggcaccggggcacgttgcgtggtgggtgatcgtccagaacttgagcggtcactcctccaacctcatgatgtagaacctgcaaagtagaggagagaggagatcaaaggaagtaggaatatttcgccaaatcaagtactagaattagagatgcagagggcatatactactcccttgacgttgttgatttttaatcaacgttgatcattcgtcttattcaatatttttaagaaaatataaaaatatttaagtcatccttaaagaatattcaatgataaatcaactcacaataaaataagtaataattacattttctttaataagacgaatggtcaaatgtatctcaaaaggtcaatggtatcatacataacctatgaaaaccttagaatcattttttttctgactacgatgcctcctgctgccttatgatctggtttgaatggttttgcaaaaatcatttattgtactgcagtttaggaatgccaactgaaaatcgacgtaaagctgagggacagcaagtggacttattcctagcggatcacagattattgaaggcccgtgacttccccgagaaaaggcccagcagcaacttagtcaagggccactacggcctcgccggcttctaggttcgtgtagatgcttctagaaccacaggatcccttaaatactctccctcctcttccatctcgcgtcctcttggaaacccctccaaaccctagccgcctctcgtttcttctcgtcctctccacgcccccgagatctcaggagcacaggaggaggaagccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcat

SEQ ID NO: 30432 - DNA, 3138 bp, Oryza sativa
  unsure (1)..(3138): unsure at all n locations
atattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcataaacttgttacaaatcagcgagggttgtgtgtttacccgtgcgtgtaatctgtatagtgtggtagtgtgctgatgcttttacagatctgtgtgtttgggtgatgaattcgatgtgacatgggtgtgtgtggtttctgcaggcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcaggtataagattcagcacatttctcttgtgaattcctattacttgtgtgatatatgttgctgtccatgtgatgttttttttgtcagaactttagatgttctgtacatatgacaattggatgagttcgggcctgtatggttgagttggcatgctaccagtgtacatgatctttcttgactgttagcatgttctgaagaaatattcttgctactttaataagaggttgtcttgatgacatggtgctcattttgtagtacaataaatgaactgtatagattaggggtgtacagcagtttttggaatagtggtatcttgttctcttggttacatttactgaaaatcaacattgctgataaaccgtaattctgaactagtgatatgggtttctttggtagtaatcacttaattaaacaatagtattagttgtaacaatatatatttggtgtagtatacatcttactgttttccgttaacatgaaatgaattttgagatttactgctttcagcttgtctttctgttcttttgtgctgtagttgtgacttccttgtatgctacaataaatgaactgtatagattaggggtgtacagcagtttttggaatagtggtatcttgctctcttggttatattgactaaaaattaacaatgccgctaaactgtaattctgaactagtgatctgggtttcctcggtagtaatcacttaatgaagcaatagtattagttgtaacaatgcatatttgctgttgtatacatcttactgttttccattaatatgaaatgaattttgagatttagttgtatacatcttactgttttccattaacatgaaatgaattttgagatttactgcttttcagcttgtctctgttcttttgtgctgtagttatgacttccttgtatgctaacattgttacatagttatggtctgtctttgttgttgtattctgctaatcaatttatatactcccttcgttttgaaatgtttgacaccgttgacttttttagcacatgtttgaccgttcgtcttattcaaaaacttttgtgannnnnnnnnnnnnnnnnnnnnnnnnnnnnnn

SEQ ID NO: 30433 - DNA, 376 bp, Oryza sativa
  unsure (1)..(376): unsure at all n locations
gctaaaaagtcaacggcgtcaaacatttcgaaacggagggagtatatcgtttgtcccaatgttcttatcagaatgcatagcagcataacaccttgttgaaataaatacttgtattgtttgttttgtttcttgtctcttgtgttctcttgctgtttgttgtttaataaacaactgcaatttttgcttgcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctnnnnnnnnnnnnnnnnnnnnnnnnnnnnnnnnnnnnnnnnnn

SEQ ID NO: 30434 - DNA, 770 bp, Oryza sativa
ttccatgaaattggcggttcgccgattcgttaaaaaaagagaatatgatgaatatgtcaaaaatcataaatctagaaacaaaaacagttgtaaaatctaattttgattcattgtagctcaatgtaagtactacatccgtcctaaaatatagctatttctaacacagtgtcttgtcccaaaatgaagctatttttccacctacctcctcctatcaaccaatcacaaccattctcattcacattccttttcttttcaactaatcatacacattctccaatcattctcacatacttttttaatacccgtgccaacctaaaaaatgtctacattttaggacggaggaagtactttgtaactaagtttaagtgctctataaccaagtatataaaagtgctctgtataggaacacgaatcttgatgtaaaggtgaaaaattgaaaggcaaaaacctaaaaaatatatcgtactaggtaaaatagcaaaaacgaaaacaaaaagatgaaaaatggagacggttcgttcttacatgtagacatgtagtactagtgtgtagtgtaggcttgtggtgaactggtgtggtgacctttcgtccctgctcatcaaaatctttgtcctggaaaagcgtggaaaagcacgcgtggggtgatgccgtacaccaatccttaataccctcccaatgcaagtggagtactgcatgcaaagttgcaaaaaccactactgcaccagacaccagtacccgaccatcgatcgccaggataaatctctttacct

SEQ ID NO: 30435 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnncagataatccttcaactttacacatctgcagtaaggctttaatcctttaaccatgataacaaccactttcttatgaattctgatataccttgaaatagagagctgaaacagagttgaaaacatcttcatccaatgaaatccatagcatttttgaagagctaccaagaggtggtacatattttacacctctaaaatgcatgtgtcttgaaactgcagttttatcagatggaatgaacagtccatcgatatcaaactccacagaggaactcttgaagagtggatcactaacaaatgtcacattcatagcagcgatgctatcaacatcgattttctttggaaggcttccaaggaatgagtcaagctttgatgcaccctccattattttcttcgtaattgcattttctactgatgatctgatatgattactgaaaccatctacaaacctagaaaaggtaagaggaataatatcaatccatgtgggggcagataaatatcaacagcattcaagaatatatagggcaattattttgacaaaaaaaattgcatgatattctaaccacagatataaaccatggtttctatatataatggtgatgtacaggaaaatagaattaggatgggcatggctaaccacatcgggcaattataggagtcatattttg

SEQ ID NO: 30436 - DNA, 615 bp, Oryza sativa
atcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacattctcaagccggacgtggcggcgccgggggtgaacattctggcggcatggatcccgacgtcgacgcttccggc

SEQ ID NO: 30437 - DNA, 660 bp, Oryza sativa
  unsure (1)..(660): unsure at all n locations
tttacataatatatctgtcttgagttaaaaatattactattttttctataaaattagtcaaaattagagtagtttaattttgaccaaagtcataacctaaaacagagggagtagaagtagtaaattttcaatgtaaaaccaacattgtatcaaaatatacgtcaaattatgaaactaattttgtatcataaatgttgctatttttttataaacttaattaaacacaaaagttttaactaagaaaaagaaaatcaaatttctctggcataggcgtcggcgactcaccggttgcagctggaggagttgaagtcatcgccggccatgcagacgcccttccacctggcggggacagggccaaagccggcgtcgtcgaagctcggggactcgggccagacgccggagtcgaggaggccgatgatggtgtcggccgtcggggacgacgacgtcgacgctgatgctgcggcggcgcgggcgcggggcgagcggcggcggcggtgggcggagcccccagtcttgacgtcgacggcggccgtcgtctgctgctggaggaagtcccatgacctgtggtgtggaggtggtagacagggtcngcgaagacggagacgacgccggctttccngcggagcgcggcgccttccgccgctgacagccgcgcggcga

SEQ ID NO: 30438 - DNA, 684 bp, Oryza sativa
  unsure (1)..(684): unsure at all n locations
nnnnnnnnnnnnnnnnnnnnnnnnnnnnnnnnnnnntctctctaaccaatacgtagctattggaagaattaatgtatgtccaattcatctcatcatctgtgtttgttgttgttgttgttgttgttcgaatccctgcttttgcacagtcactactactgtttcttttcggtgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctggctttgctttcttttttgtcattggatttttgaggtgcctttagcgtgcagccttcgctcttgactattgcaccccggtaccacgtaccattgatgttcagttgggagaagttcatgatttggtggtagttgacgaatgctactacaattctcgagtgtaattatatatttgtatcgaactttctattattgcacccttttgatgcaattctttttctttccaagtccaacctaatgggacttggtgattttgatatatattcattctagtgcatgagtatctagg

SEQ ID NO: 30439 - DNA, 608 bp, Oryza sativa
atgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagcctgtacagatgccgtattgcggttaggaaaaagaaagaacaaaagcgaaaaacgggagtcgaga

SEQ ID NO: 30440 - DNA, 656 bp, Oryza sativa
gaaggaaatataatccagttctgttttttcaatcggtgaacccaatagacccttaccataccgcacttgtctttgacgtgcattacgacctaatttgattttgatttttcgaatatgattttttataagtaattttaggtagattaacaagcaacgaaaatgaacgaaaattactaagtaaaccactgaaatcaatctgaaataaaattttaaaacttatatgaagatttgcctagcaacaccttagtttgatgctgatggcattaaacgggtatgcagatgcccatgctccagagtccagagggctattagtgcgtttaatttccatacctctctgttcgtgcgaatatgatagttgtggtgtagatatttttaaataatgaaataggcgtcatgtgtagtgtagagatatggcatatgtgaaaaatgtgtcaagccgtgctcttggaagtataatcctaatcaataaaaacagaaacttgcacgactgtacgatctccagttctcctttgggagtaactagttggtttgagttttgttttttaatgggtttgatttgattcattgattgtgatgccctttaatcattgtagtcttataatgtcgtcgtactcacccgtgtttcatattagacgggtaccgagctcgaattcgcc

SEQ ID NO: 30441 - DNA, 621 bp, Oryza sativa
ccctgccatgctacaaatcggcaaactgagcgagtaccttcttattgactgacatgcatgctactgctagctagtgcaacttgagagacattagcaccaacaggaagagagttaaaaattaatttattttacgatggaccttttgagcacggcgccgatgaggcggagatgggtctgctggaggatgttgggcgaggtccgcggtggcacggcgcccaagtacaccacgtataccccacgccgctcgccgccgccgccattttctcctccagccgcggcaccaccaccaccgctggcgccggcggcgagcagcaaggccaagacgaagcagatcagcggcagcaaccacatgattgctcgtataatttttatttgtactgcaccggccggtcagttcaagctctgctctctctctctctccccctctctctctctctggccacgaaacgatcgcactatgtatggctgcatttataagcgcgcgcgtgcgacgtcgtcacgtccgtacgtgccggtgaccggaggtaataagagcagtataaacatacgtgaaggagataagagagaggagagaagaaaaacggggtatagatatacatcgctgtagcacgaactttaaaa

SEQ ID NO: 30442 - DNA, 695 bp, Oryza sativa
aacagaatgggaaaatgagaaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggcaataaactaaacgtatatattttttgacaacttaaaaaaaatggtatggttaaaaatggctttaatctgaaccgccccaaagctttttactgcactgaaaattttgtgtagtgatcagtcatcagcatgccaaaagtttactcgcatcaatcagcaacagattacctgatgtaattctgatcaatactactgtaaaacatattatgtttcccttagaatatcttataaattcgatatatgctgcatatgctatcacggtagctgagtttcagtggtactaaaatttcagaataatgcagatgctacttcagtcacaatacttgtttgcaggatacagactaaccatactccaaattggcttaacagatttcttattgggtttttcaattcctcagtttgatcaaatggacgagatttatataaagcaagttcgatcgagatggttaatggccgaccaggttacattatttttccgcagtaactgattcagtttcagatacagttgcgaaaggagacaggctgcaaa

SEQ ID NO: 30443 - DNA, 24171 bp, Oryza sativa
  unsure (1)..(24171): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttatggacaaggggatctcatctctcacctgcttttattgacaacaagatgcatctatacatcactgtttggaattccaagcttttaatatcgtccaggccaagaacagctagctccttcgaccacaaggtttactatatatcacccgaaatccacctaactcttaatactcaaacagtgtcgtttcttgatgcagctagacattgccaatgaaagagagtttaattttgaggtgttttaggcttgtagcaatattaacaataggggagccactacaagtatgcatagttacatatgcaatacaattaatacatacagttcgtgtcgaccttttacggatctctgttctaactttgcagatctaattaaccatgaattattgtttggtccttgcagaaactaggtccttggaacaaattaggtttgtttggtctgaattttctttcttttttttaatctcatgtagtaatttgaaaaaattatgcatttcagtattacacatgaaagagcaatatacataggtgaactaaggatgaaaacgttcaaaacgttatcatttctagctagaggaatggttttggtacggtcaaaaaaatttcatattggccaaattaactatttgattaaatttcacaaaactatagatactttgattaaattatcaaaaaactatatatttaagatgatgcatgtatcacaaaattataggtttaacatgaaattcattccggactacagatttaaggtggagtatcataaaactacagatttaataacaaagttaccaaaaaaaacaacaagtttagtatcaatttaatcacaaaatttggatgtttataattcaaacataatattagtgctaaggatttaaacccaaaatctatagttttgtgataattagccttaaacatgtagttttatgatatattacctgaaatctttagttctgtcaaatttactcttaacaatttagtgacaacttcaatacaatgctgatggaattaattaattaattaaattttatatatagctagaatcggaaaaacggcgtcacttttagttttacgaaaacggtcttggtactgtcagaaatttccaccgccattttttaacccccctataggtgataaaacaaacaacctagtaaacttttaattctgttggaatttctttaaaatttcttcgtaccaaaagagcttcgtagttgaactgcatcgtgtatagtaataacatggtcagtactagtggagcagtgtgcttcattcaatcactcaccctctccacataccatcaaaaatatataattaatgttctcaacaaccaaaagataagattatacctagtattacatacatccactttgagtcattaggaataacctatctactggataatactaaacaaagcagcaagagttggtcacacaacaaacatcagagtgattgccactgccaaaaccagctagccagccaatctctctccctctaattaatcctccataattaacaacagttcccccatgaccaaccaaattaaaaatgcttaattgcaggttggctaaccactgtttggtcggctgaacgtgtgattaggcttaattaatcctcattacccctgatggccacaagggtttgttaaccaaatcagaggatggaggttgggttattagctggagtattgcattgcatgcatgcgcgtgtcattattattttggaatgaaacgtttggtacacaaaaagcataggggagcagcatgattatgatgtgatggttagctagctactagtactatattactactactagctgattaataatcatcatcatgtgtgattagtttaggtggtaattattaaccaaattttggtgataattatagtattaaccacgccggataaggccactactcgccggcgattgcggtggctatgtgtcacggggtcctattgactggagctttggattgcatcaaggcttggcacttgtggtattttagccctgtttgtttaagatggatatgtttagttaatcacctaggttactagttttagatgtcatgtgaggtaactaactttcacatgaagaaatcaattgaactctggacaacaacatgcagctataacacgtaaatatctccccgcaaaaaaaaacacgtaaatatctatctatgcaaaaaaagcccttaatttctagctgttaaagtttatcttaatgttttttaccctcttatttctacaaaccgaggtgttgtatctcaataatcttacattttttcacctgacattgacaatactactttcttattagcgaaagttactttatttgttttctttcattactaaatgttctcaaagaaattaaggttatttttattggatagttgagtagtaaagacggcggcggcaatctttaacacactatatagttgatctatttttatattttagtggtatggagtttaattaggatgaacttccgtgataccagcgtaagtgcattgacgaggcatatgattagagtgaaggaggtccaattagcagatggattagtaggcaagaaaggaagagcttttgccgcttaaaacgaaggaaaagtatggatggagagacgagaggagaggaaattatgccgttgcccccaaaagctgcaacggcatcctttgcttcccgcttttcctgtagctttatttattagcgtagggtgccacccaacacaaatttgctctgctcacccccaccatcttctccactattggttagtatttgtgtatcatcattatatgagttctaattttgtttagagaagggttttttttacccggcctttacatccaaccggatatatgcagccattttatattaggaacttagcctattaaacaaggaacttagctctcaaataacccaatctgaaattagatttgaacttaagaccttagagtgctactcaggtcactacaacaactaggttattgccatttcactaaagctgagttcgttgcttaaggttaccaacttcgcgcgcacactttttaaattactaaatattgttcttttaaaaaaattctatagaaaaattgttttttttaaaaaatcatattaatctatttttttaaaaaataactaatacttaataattcataggctaacgggtcgctctattttgcgtgcatgagagatagtttccaactccagcaaacgaacttagcctaaaattcgtttgaatttctcgtaaggtccgctatccgtatcttatctttgtttcattcatattttgcagtatactagaaaaaaaatacacatgtgttgaaattggtgaaggctatcttaatgttattattgttatacagtttagctaaagtgaaattcattgtaggaatttgcttggatattgtttttacaagatcatgagctacaagtaggattagcatgcgagttttttttaagatttcttatacgactcctatgttttcgaaagcaaacggacttaaaaagtctactcaaatacaaatctataattccaaaagcaaatgaacttaaaaaccgactcaaacacggatgacatactaaaataccggtaaaaatatctttaatttttataatagtagagatatagttgtatatccatgtgcatgtagaccatacaacaatcacatgcaatatgttgcactgttgatccttgtttagagaagttgcactattgatattcttatagaacaagcatttgagttggttacatcaaaatattggttttcataaaagatgctataataaaatggtgggcacatgatgcatttatctatgcctcttgggtcatatctagagttaaaattgattaatgacaatactactactagttatgtgataggcaatttacagcggactgtactatatccggtgatatctaggttgctaattaagccggccttaagagtgacagtataggcaaaaatgaaagggctatgtgtgtgtgtatatatatatatcttgaagcatatgccactgaaaatgaaacttatgcatccaagttagctttttaaaaagggcactttttagatgagtaattgagaatttttcatggcaattatctactaaaataatgtcatatttacatcatggtatacctcttcttagaatttaccgatggagaatgtacaaaacatgagattcagtcaacatagatcttgtactcttaagacttaattagtatattcacttactttgatggtaactatgccaatccttaaaaatatcacttcatatacaacacttgatagtatccatctaacaaggaagacagacattaacagcatataaatttgcctaattaatttaactaacttacactgttacacataagaaagttactttgttcgagatcaacaagtacaaacaacgcataaatacttgtcatttagaatgagatttggtcaaaatttgcaactttaataatcaataacttatccattttcatattttttatataaaaaaagagagaatggtttgcatatatgtcttgaaaaatattgggcctgttcactttggtgtcattttcaaccttaccaaattttggtaaagttacaaaaaaaaagtggctacatttagtttgctgccaaattttagtaactatataagaaatcctgccaaaattttagcaagttaccaaaattttggcatagctgctaaaattttggcaatgccaaaatttggtaaggttttttttgcaacaaagtgaacaggcccattgtcatactatcacagatttatcagattttacaaacttatcattacataaaatcaatggtcaaagtttgactaaattttatcctcggcatcaaatatttacaacctgatgggaaaactgagctacttcctctgtcctagaataagtttatttttagcccctcccatttgccctaaaataaatttatttttaagtaattattgtatcaaagttttttaaaatagaggataaatgaattgagagtatataaagagaagaatattttttgtgggatttgataaagtgagggttttcttgtctttttattttctatattgatacgtgtaggataaatgaaaaataaacttattttgcgatagatggagtagctatcctttttaacacatattttgacacttcacgtagctaaattgcacctacataggtaaaaacaaaagaaaatgattcctaactataaacacaattgtgaaatggcatgtagcctagtggttagaagcaccccgaggtcttaacttcaaatcttcataggaatgaaattcagtttgggttatttgatggctaagttccctattggtaggctaaatttctaatttaaaaaggttgcatatatctggttggatgtagaggatgggtaaaaaaatacccttctctaggaaaaaaaccctataaacacaattcaaaatccataactttggagtacaaaattcggtgtgcatttggcggtgcaacatagcaaaaaaaaaaaatccccacacaaaccacccatgcaaacaacaactacatgacacatgttcttcattcccttccctccctccctttcgcactctcctcccacacgccaactcgcaaatgccgacgcccggctcgtcgccggtggcgacggcggcggcgcaccgccaccgccgtagccgacgccgccaccctcagggccccccgccgcgccagccctggtgctgctccttcgccctcgacccgctctccgccgtccaccgcagccccgccgggacgacgacggctgctcctcctcctcatcaccggcggcgaagcaagcacgccgccaccacggcgccgccgctgtcacgccgcatgcgctcgcccggccgcgtctcccccgtcgacgacgcgactgcctatggcggcgccgccgcgtcggcgtcggcgtgttcctccgcgcgtctgtcgtccgtctccgagtgcccgccgccgcctccgcctccgctgccgcgtccacgacctccgcctccggcggtggaggcgctgcggatcaggctggtgtccaagggcgtgatcctggaggtggcggaggtggaaagggtgcggagggagtgcagggtggtcgggaggattcttgaaggcgccggaggaaaggtggcggtggaagggaaggtggaggtgaaggcgatcagggagccggtggagatgatgctggaggacgccgacgaggccgccgcgatgaggcgcctctcccgcgccggcgtcgcccgcgccattgccgtgctcgaggtaattaacctctctcatactgctctgcttctccaaatcatgaaattgcaatttgagaatgaggatgaatggtgatttcttttttgtagttgatttgttcgcaaattctgcatcattttgtcgattgtacatgtgttctggtcaagaattgatcaggaaagatttgcatttattttacttactttggtcaataatagttaacactgttcctgaggtagacaggtagttgaggagttgaggtttggttgttggtggtcaaattgggaggatttcctgtttcttggatgttcatcagaattccgtagtggtttacttctgttccactcaatatctgatgctaattaatttggttgtcgagctatatatgtggttcagtaaattttaccacccaccaagatttgtttctcagttttccttattggcttttatttttcttcttacatagttcgatgagttttccaaatctctactggttttcttgattcgtttgggttaattggttaaatatcccagcatcacaagccatgtagcagatggtaacaaaaatatgagaagggaacagaacatgaaaataaaacaggacaaaaaattggtacattgtacactgtaaagaataaatcagaaaatcgttggacttcatattttgttctagtttttggagttgagtaaacttttttctgtcagcatcttcaattttatataaattgaagctttcatttttatgcccttcatttcctgttctttttttttgcagtttatatctaaatatcttctgcataaatctgtttcctctgtttcagttgtctcttcattttatttctgcttttgtttgatatattcccttacatgtgttaggttcatattttttgttaatgaaatccataatactcttgcatgttcggcacttactggcacacttcttgttgtgttacttttataaataattaccaaccttaagatagtactagtattaatcgttctaatttctagttgaacatgcctatgttatatgaattcattaaaaatcatcagattaggatttttgcttttgctgatcacaataggaaatacttgactcttatattagtgttgatctaaatttcttagacgaaatttagttgcttgctatgctctaaagaacatagaaccaggcaatgcaataagttgctgttttgcaatgattgcaatagctgcacgccaaggcagccgtttgatcatacaatcagctgtatatcaccttgtcttgaattatttatgagaaatcggcatttattttattcaatcacagtgcaatgagttggttcacttgtttggatttggactcgttatgatgaatgtaacatctgttacagtattttgagaatagccccactacctttttaagcttggtggttgcacgtaaagacatgatcatagcaaatactgttttgcaatcatggtattattgctctattagaagctactgctactgttaaaaagtggaagattccatgcttatgtgaaaattaaaggatcttgtctacttcatgctggggatctacattacgtgcgatacttcataggattgttaatttattaagaaggcttttgcactgtaaagattgagctcctgtgcattacagaaattagaataaagtctacagtctacactgcaaaaatctgcagagacaagttcatttcattattttaactccctttatatgtactgtaatatatatctcaaaatgtaaattggatttaagccggttcttaacatttttcacttaatgcctaatcgaatttctcaggtatccttctcccttatgtttgacagaggagtcaccaactgtctaaaatatctcgaggctgtcccatggagtgagcccgaggaggagaggatcaagagtttgctgtcccagtatccttgcaataaaacggtttctcaagatttgcttgcaaggttacagcctcaagaacccagttcatcagctgaactggttgttgaactcatggattccatcacaaaggggaccaacaataatgcccgtaaagatttgcggactcttgtcgacggtatattatccaggacctctatctacataaagagtgataaagagctggacatgatgaacatttactcaatctgccatacttgcctgaactgtctggtggaattatttggggaagcctctgacctgggcccttctggccaaacaaccatttcagttggaaaagggccacacgagagaatatgcaagcaagttgagaacctcacctggttgctgcagattctgatagacaggcagatgggtgaggaatttgtggacctatgggccagccagaacacactcagtaccatgcatgaacgtttttcgcctatggtacgttacgagctcagccggatttcagccacaattttcattgccatggggagtgggaagctccactgcaccagcacgtcgcggcttggcatcttcgaagcatggttcaggccattgctggtggattttgggtggctcaggaggtgcccaaagggcctcaacatggcaaccctggaggatggaattgggcaagctttgctgacactcaccttgaagcatcagcaggtgctgttcatggagtggtttgagacattcagtgggcaaggcagggaatgcccaaatctgatgagggctttccaggtctggtggagacgatcattcgtaagatccctaggtagcagcagctgagactgttcatcttcttgcaaattcctcacctgagtcaattgtgtgtaagcttacatgtaccatgtatgtttgatattgtcatatatatatagcttgtttgtcagattccctgacgaagcctgtatctgcaattctttagcactgctgagatgtaacaaaaggaaagaacaattctttagctgttgttccattggcctgagctgaatgcatttgcttttggtggttgataagttgatccatgattatgctccattgaatgtgagctgttagtagtagtacaggttcatttataatcggaattcctttataatccagtagagatccaaagctgcgtggtccagtgatgcatgggttgcaatttgcagaagaaaggacaacttggagtattgtagtagtacgtatgcaggtgaaactggagcttccggtgtttggtctcttggttatcatgggcaaatgatttctgtaatgagcttgctttgttagcgccaggaagaaattaattccactgaaatgttgctctatctcactatctaaatgaaaaacaagtttgtcaaaaaaaaaagagtaaaaggtagtttacaaaccaaactgggatcagattgtgacattctgttggagatatttattaaaaataggatgaatcaggtaaattccacagcctgccctttttatggcttctttttttcatacatgtcatcttctttacccaattacccatataaatggaacaggacgacaatggacaacacacatttcataaacactaaacaaagatttgttttaaggttagcctggtacaaatggacacaacagcttgttcagttccagtaggtgagattctgtgaagtctgtgagtatatgtgtctgatagaatgtcatagtcccaaggaaagaaaccaaggtactcaaccattcctgacttaggtctcttggtggcttcctttgatgcctttgtggtcaccaggccccttgcttttggaagctgagatcagaaatcagaatttgctccgatgaaatatacttggagtggaaattctgatgatggtgctgatggatattcctacctaggagtatttgtcactgaattattagcaaactaattaaatttcaatctttttccgtagctgtgcttgcatcatggcaggtattcagtctaatcatacagccaaatggccaactgtacgtacgtctcatagtcacaggcatttatgttcatttctcctttgtttttttgtttttttgaagactatgcccatctctccttgagcttcctcttctttttttattgagctgattctcaatctgtctttgatccacgcatgagaccatatgggattatatgtttatattaatttcgcctagaaaaccatgtctgttgtggtgatgtaccagtatgtgtgtcttttatgtaatccaaaaaaatatttattatgcctgatgacacataggccattggtgactaagtatcaagagatcaacaataccactttggtgtaagtataaagacatggttggtgctcaataacaaagctatttgcaataccaagggtggtccctacaaggaaaaaaaagaagctaggatagtcccttgcattttctagcaaataatcctaagctagctcaaaaggctgtccatgctgatcttagccaagcttgctgagggacatcctacccctgcttggaagaaaaatgatggtgattggctgctgcttttgtacttatcccaaggttgtgcagcagtgtttacagtaatattataggttgaatattttttatttcacaaatacaaatttacaatgcatgcatctaaccagccaacttaatggtgtcctacttcccttgaatccaaatataagagctttcgttttgaactagtgtagtaatgtttgctaagggcatttactctgttctatggatattatggggtctgattatgataaccagttcacctgaaatcttaaccaaatgatgaataaggtctctgttctcatcatttgtatcgcctttactagctagaacatccaatgttgggtccctgctcagccggtcgtcgtttgggaatgggggtgctggccctagtccagggacaatgcagggtagtccctgctctgtattgttggtgatttggttggctcaggaggatcagattcccttgcatttcctttgtcctcccaaggcagtataggcaatcatcttagtactaatatcatgcagaattaatagctagatgcatcacaagattcacatcaacaactgacaatgtcctacaatcaacagcatatgttaccgcaaactccccagcagccccagcaaccacagcataccatggagcagcatatgggacaacctgatcagagtggcccagggcagatgttgcatgcttctaatgttgtgaagctcgaaccacaacaactacaagcattaaggagcttgggtgcagtaaagatggagcaccaaagctcagacagtcagacccatacatgttcttgcagtagcaacaataacatttgctgcagttagcagagcagaattaatcctcacacaccatcatgtgcacagttaagacttgcatgcgtgtgatcctacaatctccgcgagcagtgcacgaaattatgcttgtggattggttgttatactctatccatcccaaaatgataatcatatatgtttatatatgtttatgcactaagagtaaggataatttaaaacgcgtcaatcaagacaccatacacatattctcccacaatgcatgtattaattgtattatgatgaaattcatgttcatgcgattatatgatgatcaatttgagaaattttagatttcattatatgatgattaatttgggaaggaggaagtactacctctgatttctttttttttaactagaaaaaatgcccgtgcgttgcaacgggtaaatgttattttaattttattattgttatacgattcagctagggtaaaattcaatgtgggaatttgattggatattttttttcagaaaatcatgagctgcaattaggagtctgtatttcatctgaagttagcatgctgggttttttttacaaaagatttttatacgactccttttatatttccaaaaggaaacaataaaatccaactcaaacatgattttgaatttccaaaagcgaacgaacttaaaaactgactcaaatacggatgacgtatcgaaattctaacaaaaacatcttcaatttttatctctcctattataaaaaatgaagatgttttttaccggtattttggtacgtcatcttgtttgaatcggtttctaagatcgttcgcttttggaaatagaatatgtgtttgagttagattttaagcttctttgcttttgaaaatacaaaaggagtcgtataagaaatctattttaaaaaactctgcatgttaacttgaaatgaaagtcggactcctaattacagctcatgtttttcttaaaaaaaatctaagcgaattcccacggtgcattttgagtcaatccattctataccatcgacaaattaagcgcgggttctataatatgccattaacaaagctcggttctacaatacaccttcgaacaactcatttacttccttatatgccatcggtgttagtcaaccgttagtcatacgccgttaagggaaaataaatgacaattttacccttaggataaaattgagattttgcagaatgccatgtctcattaaataatcttggatgctaaaaaagacatgtgatttctatttttctcatcaatgagaagaaatagtggatcgtgaccaatgaaatctatgcatacgcatgataccctaggggtaaaatggacattttcttcctcctaacagaatttgactaactgttgactagtggtgatggcatgtaaggaagaaaactggttgttcgatggtatattatagaactgagatttgtcagtggtatattgtagaatccatgctttgtcaatggcatagaatggattatctcgtgaattttaccctagctaaaccatacaacaacgataaaattaaaatagcattcacccgttgcaacacacggacatttttttctagtaatagtagagatttgaagtttaagacatacttcgggcctgtttggtggagcttaaaattctgagaagcaactactgagaagctagctggtgagaatctggagaacctaggaaacctagcttctgacttttagttcatttttcagattctacaactatagattctcagaatttaggtaaaaagctaaactgtttggagagcttctggtaacttaagattttaggagaagctgcagctgctagtagctcccaaaatacccttcatccggttcaaaatacacatacaacgatgaaaggtaagaaaattaaggaatgtgcgaaatgactatcctgcccttcatttcttcccgatctgtcccgtcccgtcccgtcccgtcccgaacctgcggcccgccgcgagagcgctccacgccgcgcgccgtcgctgcctgcacagacgtccgtagatgccagcggggcggcccgccggatgtggagcaaggcggcgcaagcggccatggcggcggccacacatgctcgtcggccccgccgtcccctccaccacctcacataatttccgtccacacctttcgaggctgtgcattgggtcggcgacagtagcgagagctggcggccatggatgagatgagagtgggacgagcagccgtggccgcggctgcggagtcgcttttggaggctacgtcggcgagccgtgctctcgactctgtcaaagacccccgcatctccccgaggttcatcttctccacactcctagcactagtacttccgtcagaactcggaattacaaaattcaggcttcaattcaatccttcctcacttgggaatgagaagaagtactcctagcactagttatgtagtaggaattcagaaatcttggagtaacttgatcttggaatacccctagcactagttcattcagaatttagaaatcctagcactacctactactccttcaacccggattcagaactcagattgcgttgtactccaaggatttagagtgaattaacatgtgattgctttaggcggtatgatgcgttagatggtaaggcagagagttgattaggctacattgttaccaatttgaattctttttttgatggttattcaggaaaacaagtcgtaagcatttcatttatgacatgttcatactcctgaatttcagagtatgattgtagcatgaaacaagttcagagtattcttgttactcctgaatttcttttagagaacaatgcaggagtagaagttctttttttttattattcttgttagagaacaatgcgatacaatttgggcatttggttttgtccaattggtgtgttattctgaaatggccattaggttcagagtacttgggttttgtctgttattctgaacttgctgaagaactaatcctagagatggtggtctgtgtgaattttctgagaaatcggagtaagatgttttctcgagtagatatcagtataatccgatttacagcatgcatagatttttttttttgataacaggtaatttgattacccggcttttgggagaaagccaaacaaaacaaggtctgaatacaaaaaaaaacttaaaggaaaaacagagtaaaactggggctgccagtacccatcacgcgctagaaaactaaaccccaaaaggcttacaaaccccgccaagaagtatccaaacgactaggaaatctcaaacccctaagagcaacatcactggcttaagcactaatattgtccggtagcacattcacaggacgtagagactccagcttagccttcagcttctcaagcagcgcgttcaaagcttcgcgatctctttcttttgacagcagcaccttccatctctgcatcaaggaaattgccttgtacactacctacaaaggtgatctcactaatttattctcaaaaacaaagtcatttcttaccaaccacaaaccccagcacagactagcacaaagaaaaaggcctaaattcacccccaatttattatccttaacagctcttataccatcccaaaaattggttgaaattaacccccccccccaattacctccattacagagcaccaagcaaagcaagcaataggacaagtaaaaagagcatggttagtagattcagttctcaggcataatttacaaaatttagtacccccttccaatttctctgaactaagagttcagcacaaggtattctccctctcccagccaaaaacaagaaatgcttgacttttaaaggaactttgcacccccaaatctctgttatctctttgtccacaacacccccaaactttaacaacctatacatagatttagtagtgaacttcttattcttctcatgaggccaaattaagctatcaggcaaatcatctagcctcacatgctgcagcaaacttttcaaaacgtctaattgagccttgtcagactggtccagatttcttctaaaggacaaatcccaattaggggcacccataacctccctaaccgaaagatgttgttgattattcaccatatataaggaaggaaacaaaattcttaggggaacatctcccaaccaaacatcctcccagaactattttttttctctattaccaatcttcttaactacaaaatagtttaaccagactttgcactcatgaaggcctttccaaaattgggaacccccactagcagaactcttaaaaaaactgcccctccttaagtacttattcctaaaaacaacacagctcatgttctgagagttgccttccaacttcatgatccatttactcaacaggcaaatattcatggtcctagtgtccaagaaacccaagccaccaaagtctttaggtctacacaaaccttgccacttaataaggtgatatttcttcttctttccattcccctgtcaataaaatctcccccttacagtgtctaaatttttgtaaaactcctcaggaggctttaaaaaacccatagcatacattgggacactggacagacaggtattgatcctgatctccctccccccataggagagatgaccactgtgccaagattgcaatcttttctctattttttgcatgattggaagcaagtccttttccctaccttaccaacccccataggcaaacccaagtaagtaaaaggaagagaacccactttacaattaagcatgtcatcatacgattcctcctcatcctttggaacccccaacacataaacctcactcttctgataattgattttcattccagacatctcttcgaaacagaacaacaagaatttcaaggctaacacattttccttagtagctttagtaaagagaatagtgtcatcagcatactggagatgagtaagaccccctggaaccagattaggaaccaacccctccaaaaccccattactgttagcaccatccagaataactgacaaagcatcccctattagattaaataagataggagacagaggatccccctgcctcagacccctaaaagtcttgaaaaaaggtccatgttccccattaatatttatactgactctaccccccttcagtgatcttcttaatccattcaataaaaatgctgttaaaattcttcttctgcatcacctcatagagaaaccaccactgcaccctatcataagccttttcaaaatctatcttaaagataacacctgattctttctttttatggagctcatgcaatacctcatagagaattacacacccatccaaaatataccttccaggaatgaacgcagtctgtgtccagttaataatccccccaatcacactagttatcctcatggttaaagctttagttagaattttcagaatcacattttgaagacaaatgggtctatattgctttattgtattagcatccttaatttttggcagtagagaaatcaccccataatttattctatcactgtctaaaattcctttctaaagatcatcagagcatttctttgatcaaacccctaaattcaggcaaaagtttctttataaaaaccccactgaaaaaccatcaggtcaggggcagtattgttttcatgttnnnnnnntcncccaatatgacctgatcaatttctgacaattcaaaaggtttcatcaagctttcattatccctctcattcaaacttaacctgttagcccaaaccccctgctccaaatgaatgtttctcagttcttccctcccaaacaactgtttgtaataatcataaatatgagtctgtatttgttggaaatctgaaataacctcctccccttgctgtatagagaaaatgtgacttttcctattcctaccattagcaatcctatggaaaaaagaggtattgctgtccccccttaacaaccattgttcaccccctctcctttgccaccacagttcttcttgtagatagatctgctctacttccttttccagctcatatctgacctcccattcttgaggaaacaaatccctctccttagcaatgttatcaatttcagtcagcttttgttctatctctttccttctctttttctgtttgctcaccatattagcactccacccccttaaccatctcctcagataaggcataaggagatgccagtaatccattattttgctctgtattctggcaggccacttctcaagcaattctttcttaaaaccctccagctcaaaccaacccatctcgaacctaaaattgtttcccctaactctctccccctccctagtgtctaacagcaaagggcaatggtctgagccaaccctcaaaagagaactaactatggccaaagggtataaatgatcccaactagaggtcaccaggattctatctagaacacatctgatgggattgatttgcttattcgtccaggtgaatttcccccctaacttaaacagttcttgcaactcataatgattaataaaattattgaaagcctcagttcttctcacatccaccccaccaccaccagatttctcatctagatatcgatacagattgaaatcaccccccagaatcataggataaactccttgctgtactttgttgccaatttcagctaggaactcccccctatgtgcctgttgagcaggaccataaacgttaattagctcccaattctgtccatccttcttatttttaatcaccattcttaaagaaaaggccccttgatcccaatcaacaatatcaaacaacaactctttaaccccagtcataataccaccagagtgacccacagctgccacatatctccaagtaaagttatctcccaccagattcctcaattccctatcaggaaaactttgcttgattgtctcctgaaggcaaattatatccactttttgttcaaaaaccatctccctcaactgtctttgtctacctgcagcccccaaacccctaacattccagaacaccactctcatgatttagacttctttctaggacgccccctctttttcggcccagaccccttttgcacagattgtttccctttctttttcttctgtcttagaccctcatggtcatgcaagtcaaaatcccccaggttatcaaaactctctttatctgcatcatccaactcatccctatcttcctccttcagaccctccatatactgatcattctccatttctatcacaggaacccccagaatcgcattattctcattggggtacagcatgcatagatatcagcattctcgtaagatgtttttgaaatttagatttccatactccctaattgtacatgtaaaatgtatttgaaaatacacactaataaaatgtctgcttggattagttctcatgttgctttcacagaaaactagagtatcaatggcttgagtttctgatatctgaatatttactgtaactgtctattgtctgctcaatatgtcttctgcagagtgcgtaagaaccatctttatctttaattcgatcaatttcatctcattcagagttcttgcttggaatgtgctattcttgggtcaattgcattcagtcacattaagttgagcacaagcacatgccatggaaaaaaaagaaagaaacttgaatggctcaagttgtcacagagtggaactccaataagtactccaagatagaatttcaggaatatcatcctcatgtggttttcaacccaagcacaaattgaaagaacattgaaaccttaagatattatcactgaattattgccaaattagacaaagagtacactattttgaaggtgctaacttcagatggagtacacactattttgtcaaacaagctttgttcttggcacaagcacaagcttctagtgctgttgaattgaagtgactggagcatcaatcggcttctactatggtagagttcctaagctgcttcaaaacttatcttaaaaacttgtatggacttcacttctgcctaggcacctgaactgccgcttgattcaatggatagctgttactgttagacaacacttgcatctaacatttgtatctgacatttgcattggtagtacacactctctctctctctctcctttttacgttggtatctgacatttccattttctgtcatattttcagctgttctgaagaatacaagtctgaagagctactttcaggtcagtgaaaccacactgacaaccattttagaaacagaattgaattgccctgattaccgcttgatgccttgaagcatatacaatcaaagttcaaacagatgtggccatcatatatgtatatgtagcacagtttgattcctctttgctagtcaaaagatggtatcatcaatcaataatagttacagtattgattccatggagtagtaggattacaacaattaaggacgatgaagagaaaggggtggctggcgatacacatagagaggcaaagcagggggtagcttagttacaacttacaaacgaagctctgatcgatcaagtctgatttgattgatgcagctgaagaagaagaggaagaagacgacgatgatgatgcaatcagctgctgacgtacttgtcgatgatggtggcgagggtggtcttggggacggcgccgatgacgctctccttcttctcgccgttcttgaacatgaggacggtggggatgctccggatgccgtagttggtggcgatgtttggtgagtcgtccgtgttcaccttgcagcacttgatcttgccgacgtactccttggccagctcgtcgatcaccggcgcgatcatcctgcacggtccgcaccacggtgcccagaactccaccagcaccggcgcctcgctccccagcaccatgctgtcccagttcttctcgtccgccaccaccactgccacgaccccacacgcacacatacgatggttttcgttttgttttgcaccagaatatgacgaatggtcaaacatgtgttttaccttcgtcgacgacgttgctgcactggcaggcgaagcgggaggcaggtcggagcggtgacggcgaggcgacggacaaccttggcttggactggctgctgccggcgccggagaggaggagtctgtccctactgccgccggaggacggtggctgtggggcgtgcagagtcgcccaggctctgaagcacgtctccaacgccattattttctcactctaagctacgctcctcacacgcagtgacacagagagaagagaaagaggaggagaaaattttttgtgtagaagagaaagaggatagggtttgttctccctgtggcattggataatcgggagctttggcgttggtgtggcatcgtgaggtgctcaggggttgtgcttcctgcttgtggatgaggtggttttgcccccctaaacttttggcccggtgtcgcctgatcttttcgttgcctccttcgtgtgcctgactcgaggatatacgcgcctataaaaatgaatatcttggattcttcaagttctctgcaagtttacaacacataaatttctagaatactaggaaaattgggcaactttatgtgaaaacactataaaatatttgttgtacattaaaaatatgtaagatgtgttttctagaggaaatccggtttgtttatttctttattattaaacaattggtatttctttattttttttcagttctctgcaagtttttcagcccactttttcttccaagatgatacgaaaatcgaaccattttatgtaaaaatatgttttcctaaaaaaattggaagtcctgcataattcatgcattccaaagcctaagaggtgctctagaggaaaagtcggttcattccttcgtttgtttaacaatgcatatatgatagtttattagtgtattcagtaatataattgcatatatgatactagtttattagtgtattcagtaatataattttgcattagttttcaaataattaaacatgatgtttggagtactcaaatttggggaaatcagtgaaataaatgtgtggcccatctccaaatacgtccaccggcctcaactacaccgcaaccgaattcaataaccacaaactttttattctcatttggacattcgaattgtgtcgataaaattatttggtctacttatacctctctatatatatagccatacatgaaaaattcaccaactattccatcataattgttgaccataaaaaccactttactttgtcctaagactggaacacttgcactccataacgctaattttgaaatatattttgtcaagatgatattccaatacaagtgtgcctgtagtagagtatcttgccatttataagagaaagtccattttacaccctcgaactcttatgtctgtccaaaatacacccccgaactataaaatcgggtataatacaccctcaaacccttatgcttgtccaaaatacacccctaaactacaaccgggtataatacaccctcgaacaataccagacacttaacccccgccctatttttaccgtggtttttgacacatcggatccacgtcagcccacaaaataatatgagccaagcccatattctctctctccttgccctgttgtgcttctctccctcatgaccgtcggcggagtggagctgcgagggcagcggctgctgcggccgcgtggcgcggctgcgagggttgcggctgcggcggcggcgtggagctgctgcgagggcggctgcactgccagggttgcggaggcggtcgtcggcgaaagcctttgcacgcagtcgccgacgaggagagcagcaacggcggtggagcttgctaccccgcgcggaagagacggacctcgccggagccacacgcgtccccaatcactgtcgcctccgccgaactctacatccccaagcagctctagctctaccggcgagctcgatcgatttcatggagaagatagagctcctggaggcggcaggagaggcagaccttgagctcgggctcgccggcggtctgcgtggaagggaaggctggggatgtgcttgagcttcgtcgccgcaacgagtcccctgctccaccgccaccgatctcttgctctacgagctcaagaatgccaccgccgcttctctcctgctctgagaggaagaaggatagagagagaaagtgaagaggagatgagggaagaagaagaggtggctccgtggttatagactgacatatggtcctaatttttatttttatttgctaactggacttccacatcaatgccacgtagataaaaaccagctgaaaaaccactcgagggtgtaaagtgaacggtattgaaagttgaagggtgtgaaatatcctgttttagagattttggtgtattttatacaaaataaaaagttagagggtgtaaatggacttatccctatttgtaacttgggacagcatacataagagtgcaggaggaggaagctaagggtgttacccaagttaatcagtatcgagatatgaggatcttctgttttgcagtatgataggatcgggatactactatattttgggatactactatattttagaaagtacatatttttatataaaatataatatgttgtataaattaaagcatataaattggttttgataaatttaattggttttaatgtaaacttaaacatatttattcatattattttcaatccaccttattttaaataatattttgtaaaatcgtagaatcgaaatactatctaagataggatcgtatgtaaatgaatagtaagatcaggatactacgtgggattagtatcgcggcttggtaggattgtagtattgtaagatactagaatacaaatcgggatatcagtgttaccaccttcgacaaagaataacatctagtaataacaagtagtgtggcctatcaatgacacgtcgccaaaccacctttaaaattggttaggggtgatattgagtatctagaaaatcaggttaactcaagtgtttgggtgaatactttacggcgtagggtggacattttcttcacactctgtttatatagatgtgttatattttaaacaccattagcatatatagtttgccttgcaagtgactgcacaactaggatagaaagtattcaacaaggtttatataaaatcatgtattattaaagacttaaagcggccaatatttgcgagtaaacgcggttgtgaaaaataagagatttgaacgatactcaatctgttaaaaaaaatgtaacaccctagcatccaaatttgtattagtctgctctacgcgttgagtgggcccataattatgtaacacctcacttatatctttatttttgtttcgtgtaaaagagttaatccagagaaaatatgtttggagggagatatatatatatatatatatatatatatatatatatatatatatatatatagtgaatgggcttgggcctccatatatatatatatatatatatatatatatatatatatatatatat

SEQ ID NO: 30444 - DNA, 2333 bp, Oryza sativa
atatatatatatatatatatatatatatattaggtgataccccgcgtgttgctgtggaagtgtggatatagttgagaaattttaagcaggcgacagtaccataggcatttgagcagaaaggataagattgatttctagttaaaaagagcacattccaattagcatagctgaccaagaatgtgcatgcagtgccattcagctaaccttttcttttgtttttgtttgcttgagggtcattcagctagccttttctttttctttttttgtttgagggtcattcagctaacctttgctcaaggaagatggaacaacctgactgctcgtatagtggtgttggagggggttccacatggtatgatgcgtgttaattaggggattgctagtggagaaggtcgaagggcaccgcttcctggctttcatgcgatgaggagatttttaacgggccaagtcaattaaaagggccagagcaagcagttgtaagtgtgaggacagataccgttgatctagagacatgctcaagaatccaacggctgacaataatcgatgacgtggcgcaatgtggtgcaagctttatagcaataattattacagtgggtacgataagctgacccaattctatctagactctgtttaacgggcctaaactgaattcaagtgctggaactaaggcagaataagtccaccttgactctcttaaaagtgacccgaatctaatttatgaccctaaaccgtaaaaccggatatctcgacccccgaactattgaaaccggtgtaatttgactcccttgatggttttagagggcggtttcgctgacgtggcgctgacgtggcatgattgacctagtgttgacggaaaacatgaggcctgggagatatgcttaactccagtgcaggtccaaaactcgccttcgggtatgctagcgtgccagttgatttatcctgcaatcaacaagaaatagcgacaaagaacccgcggttaaacctataaatgatagccgatcggctaagtgccgatgacatatcatttatccttgagccgatgtcatatatgtatcgatcggcggtcataataaataagaaggaactagatctactcgatcggctgtagatattaacaatatatattccttatatcgatatatacttaaatcaagcgattgggatagattggtcgccatgccgagacaatataaatcacttagatcgaaatataaattaatgatagaattatatatgttcatagcatagccgatcaaatggatctagcatgtaccggctaatactccgacaccactctatactaagatattaaaacaagtagaatatatcagacaaaaaggtctgatatacttaaatgcggcaagatcttaacataaagggcagatttaacatatccatgaagcatatagagcaaatgtagttaaatcagataagatcggctgaaaccccaatactaccctaatcggcaactagaaggcaggctagagattgatattctaagcacgacttaatagatcaaactcaattgatgcagcattaagtatgaaaagaagaacaatatctagacaatcaagacgctggaagtttcatagagtggtgaatatcttatataatctaagtcaacatcgatatttaacctaatcggctgctttctcctgacagatgttagccgataacaggttaaatagcgatattgccagagattatgtaaggtatatgataactcgatgaattacataaataagattagagtatcataaagatggaagcactaatcccgagaacgcaagccatcataacaagttttacctcttgttgaagatcgaaaccgatgcagctcaacccgaaagtaagaactcgtcgaaataaaactaaaacaaaagggtggcgatgcgccgaaattgtattgaatgtgtgtgttaattgattacatggggttcggggtctatttatacccaaaaattacaaaccatgtccatatcggacacgactcttatctctaacaaactctaagataccataagtctttacggcagacttttgcccaaacatatctctaaggaagttacataaaatatcctaactaatagatataattgccttctcaggactctattcatgcgtggcaattatcttgaagcatatcaactcaacccgatatcgtacaccaagttgtcttgtcggaatcgactgtaccacccaaccaagtctaactcgaattcagctgatccaatcgtagccgatccggactccagccgattcttactctgttctcgtgataatccttatctccgattccgcttcgatctaatccttctttccgatgttgatgt

SEQ ID NO: 30445 - DNA, 43655 bp, Oryza sativa
accccaacccccaccgtccctagcttcgtggcccaccaaccgccgcgctgggaggcgccccagccctaggtagccaatgccgttgtcatcgagagagtaagtccccgtggccaaacacatccacgaccaccacatccgagtcacaagtgttcgccggcgaccacaacacgcagagctccaaccacatcgccgctaatctccagctctcgccgccgccaccgcttcagctcctgttggccgccgccgctctagcccccgcccgccgccgctccagcccatgcggcggcggccgaccgaaggggagagaaggagagagagagaagggaggaagaggggaggaaaaagaagagagagatgatgacaggtggggcccacatgtcagtggaccccacaattttttatttgtgtgaatgacaaacgggtcccacatatactttttaattcaaatgccagctaagcgctacgtcaaccctacagactaggtcaaccatgccacatcattgccacgtcagcgaaaccgccctccaaaaccactaagggagtcaaattgtaccggtttcaatatttcgggggtcgagatatccggttttgcggtttagggtcatgaattagatttgggtcacttttaaggaagtcgaagtggacttattccaactaaggctgattcagcaggccatacagatgcttgggctggcccaccatgtaaatggcccagcggcctgcagccttctgcatctgtctcccccccccccccctccgcatttcctttcccgtatcccgcagagcagaagcacacacacgctcgtcgattcccctccgccggcgaccaaccccgccgcctcccaccgccacgcccccgttctctgctgctacatctcgtcgcctcgccggcgccatccgctatctcccccggcggcggcagaggcttcctcttctctgctactcgtcgccggcagcggccgccgtctcgagtgcgacccacggcgggtggccgcggccgtcgtctcgacgacgaacggcgagttcgtcgccgccgtcgggcagtgctcgggcctcgtcgcgtgccgggcccgcttcgggaaggagcacgatgggcccgtgccagcccggcccgacccggcccaagtccagcctctactccccttaacatggtctatttacataaaagcccctttcatcaccgcggtaatacaaatatttctcctagtacaacgctttcacgaagttgggtgaggcctccacaaatccgaggtcttccctgcataatcctccctcctccgcggcaaagccctagaagcgccgccgacgcccacatggcggcgccctccggctccggcgaagccgcccccgccttctccacgtactacgacgtctacggacccgacgtatgttctctctcccaatctttctgttcttcttttaatcggttccccttttgatttcgggatttcggggtcttaagagtgataaaaacaggggggaggaattggcaatcgattatttgtggtaaatgttgcggttttattattttcgggtggtttttgctggtgggaacatatcgcattttgtgatttccgtggcgtcgaaagtgggaagcaactgtgctcttctatgttgttaacgcgttattatgattagatttttttttcttgtaaagctaaattcttgctaggattaaaacggagggcatccctgtttgtgtaatgatggtctctgcgattcttattgttaatggcaaaatctgagtgttactactgatagcgctgcgcttttgctggatactttgttcagaggggtgaagcgcggatatactactgtaacatacaaagatcctagttttgaagaacacactctcatggaagcatacatgcagttcattccttgattcattttattttaacagaggaagcattcgctactaaacaagtgacccgtcctgatttttgcactccaaattcctaatgtgaatatccctgctaaagataagacagaccagatcaatagaataatatactgctgctgtccttgttcatatcatcatttgtgcaaaatcaaaatactcccaaagtatcggtggactattaagtgaagcagcaaccaatttatctagatagatagttggctatttgttctgctgaatttactgatctatatttcctccttggctctaatgaaccaaaattctcataccaccgattctttcatcatgtccaggctaaacctgatgttgtttttaaggaggccacttcaaattctacgttaaatttgcaggttcttttcatcactgagcttatgaaattgaggtctgagaacttcccttgtaatgtgacattttgtttgttctttttagtgcaggatgttcaggggctagtaacttgggtcattggtgatggcatgctgccttcttgggtgtttgttaaagtacatattctcttccctatttcctcctaagtttcaatgtttagcacgtggtttacttttccttatctttgtccttctcaatgaaaattgttagtcttttttggggtccatatcttactgcatacttcctctgattctaaatataagtcattttagacttgtgaacaacaattaagaaaatagtttaaataactttttttgccctttatttattcatattggaaatatgattcattcatttgtgtgagaatttagttgccaaggataaaaagaaagaaaatatgaaaaagtgcccagaaattccaatatgatttatatgtatgaaagagttaaaaggctagagtattgccgaatatgttgttcttaaccactcagtttgatgttagaacatgcatagtatacctgacagcaagtgctttttcctgcaactgaaagaaaggtctgtactttgtttctaattttatggggtgtggcaattaactctgtctgctctacaacctggactacccaccatgaattttaaaacttgtaaaatactttatgtatttcatatctagagagatgttgattcacagtgagcactgatttttgtttgacgcatgtttgtcttatgttccaattttagattatttaattaatgcttcaagaaagatccccttatcactaaatttgttattcttttctgcgcagaacaagcctcttataccaaaagtcgtccttctatatgttcctggccttgatgcagctttatatatgtcgcaatcccgtcacctttcttctttgaaagaattttgtggcaatccaaaacctgttctagcttcaaggttggtgcactaaactggggagatggatgtttttgcccagaaccttgtggattattttgtgtgggcaatttaatgcctccttcgtataaatacactgtaccatgtattgctaatgatagcttttcttgcagctgtataccagatgaaaggcataccatcgatgcactcctaacatgcagagtaaagcgaaagcgtgcgttgaaaacaacggaccaatctcatgaatctgatggccaaggtacaagattgctgagggttatgtttcttttatttttaagaaaaaatgttgaattattcttcttatttgagttcttgctatgaagttgtttatattatgatgatagaatcactgaaaggacatatgattaccatttctacttttgggagatcatgttaattatcaccattctgccttgtgccatttatttgcaaagagatttttattcttgaatttacagcagacattatttttcattcttatcatttttttccttgtacctactacctagttgttctttctcagccttatttctgtaaaaattaactgttacatagcatctgcattgagatgcaatgatcataacagaagcaccagctcactgtattgccatacagcttttatgctggcctataagtgcacctacagtctctagatttacttaatcaatcttttccatgagaaaatggtacttatgtttttatacctaagatattgtattatgtgcaattttttaactgttttacatattccagaaaagttatcaagtttggacgatctaaaggatataccgtttcctattaaatattacacgctttctgaaaaagacttggaggacaatggatacaacttcagtttagaaggttatccttttgtttttctcctctcccgcttgccctttcatgctctcagctgaactcatatattattgccacataggttttgtccctactgtttcagctcctccaggctcttcgccatatgcaattcttgcacttgactgtgagatggtaatgtgatgttctgtacaatatgaggcccccttttgtgttttctgaaaataccaagtacactgactttcaactactatatgttaccaacagttttgcactgtgacatcacttgtacattatttgtgtctgagtttccttaagatctatgttttgaaagtttgcgaccttttcagtgtgttactgcagctggatttgaacttacaagagtaacattagttgatattaaaggagaggtacctactttgcgctcaatcctttattgtctcactattctccctgctgagtattgattttgttataatctatttcaggtggtgctagataaactagttaagcctgccaatccaatcactgattacaatacaaggtacatgccatgatgcctctaatctcctttgatgtagggctgttacacatctatgcttattctttcctttacatagataatagggtttggtgcctttctttcaatcatatgtttgatattcctttaggaagataaattggatctgatacctatctttgaatcatgtgtattgtattatggatatgaatgaagtgctcacgcatcatatgaatttcattgtcctaatttggccctttatgttcttcccttgtgatattctaaatgatatctccagtgggctctaacctctaaatgattaatcggaatatccaacagaagatgtaattattcttgaattgtgcaggttcagtggaatcactgctgaaatgttagctgatgttaccacaaccctccaggagattcaggtaattgttgtgtttttgtggccttgaatcttaattggtcttgatactgtgccaactctttataccattgtatatttgttttcaggaggagtttgttggacttgtgcacaaagaaactgttcttgttggacattctttggaaaatgatcttatggcattgcggatatcccacgatttgatcattgatactgcagttttgtacaaacataatcgtggccatcgctttaagatcgctttacgtgtcctggcaaaaaagtttcttaaccgggagatccagaacactgggtctgggcatgacagtgtggaggatgctaaagctgctctagaactcgctttattgaaaatcaaatatggtaaatatgcactttttaatgacttcaactgtcatctcagtaatatcttttagttatttttctgttaaaatgtaaatttggataactggttcaccaggtcctgattttggctccccaccatcaacttcacgacgaaagttggcttccatactgcatgaaagtggtaaaaaatgctccctcattgatgacgcctccgttcttgagcggtattcagatgcttcttgtaattcaatagcagttttctcagatgatgatgcactatctagatcaatgaaagaggttagtactacacattttaagtggcccttgtctcttccctgagagcttgaaggctttcattagtatgcttcttgaaatcttactgcaggtaaaaaatgacaaagttagttttgtctggactcaattctcgaaattgatctcgtatcttcgtacaagggcccaagatcccgataaggtgaaatcgtgtgttgcagaggctattgcattgcagacctgcgacagaaaaactgctcagaaaagaaaaaagcatcaaacttgtcctgaactaaaggaaattctgattgggttggacaagaaaattagaaaattatacagcatcttacctgataatgcaatgcttattatatgtagtggtcatggtgatacacctttggtgcaaaggtaaagttacctggagccatacaattatattcctcctcctagtttgtccatacagttcacgttctaaaatcgttgtgccaacttttcctaactgtacttcatgcagattacggaaaatgcttaagcaagaagaagaaacagtagaaagccgcgaaagcattgttaaagcattggaagatatacaagcccaggcagaagttgctctatgcttctgttgtgtcaaacattagctgtaagaagccttcttaccaatctcttttccctcatgctttgcaggctgaataattaaggctgaatttctttgttggcaggcattattcagacgatatacttgcggactctgtttattgtaggaaggatggagccccatgcatcccactaacattagaacttctggctaacatgaacttctggattcaattttgaaagctgacttgccagttttagaaggcttcacatatgctcatgctgctcttttgctaggctatgatgggtggcatgtttctatcatatcaatgcatcatttgtaacaagatgtatcagtagcaaagctaccagggatatattagcagatgaaaaaagatattctttttctctcaaatgtatggtgatgaaaacagctttggtaacaaaagaagctcctagaattgttctgaaaagacagatttgactcattgctgattcttggatgtttggatgatcattttaacattggtgcatctgggaaaacgtctagtgacatcatttacactattttgagtttcgtgtgcagacgattccacccgaaggtttgtgctgacaacgaaaggatgacaatatatatacctaaacgtgtatggttccgtcattttgagccatacatatattggttaaattgtcgaaatggtttgtacgtagcttttcatagatgccagacagtcgagcagataacgctgacgctaaaagatggttgcatttggttttctacttcgtcaatgatgtcatcacgaactgataaatatgaaattctttctatttttcagaggaaaaaaacaaggttttgcttgttccgtacttctactgtatattccgacaatagttaaacacttcccgggctgtaaacagtgtgttttatataagttctctatctaagttttctatatagtttctactcccttcgtccctaaatataagggattttagttgaatgtggtgtattctaatacaacgaatctggatatgaagcctgcatatatattagtttcttcaaataaataaataaatgaattaattttcaagttatagactgataagctcgcacgaagagcagagctgattcgaacgcagcttaagcatttgcaaaagtgaagctaatatcaattctgtatcttaaaaatgcagatggatgtgcacttagcagggtggtaggggacaagggtcaaatgaccaatggtaaacaagaactaaaagacgaattataagagctgcctatcaaacgattttgagccaaacttgcaatgacaagctagtctatggtccagacatatctgaaagcaattgaaatataccgtgcaatttaataagcacatgcgctctaccaacagacaaccaccggttggcagaacaaatccatcagtcctttacctataatgattactgactcattaaggacatttccacgttaattgaaataaataataaataaataaatctagccaagtgactgaattatagcaattccaaataaaactgctttccatatatatcagatccagtttgttaattatagcaaatttcacagttataataataagggctaaaaaaactaaatggagactctaagacgaagtacaactttctacttattaataatgaattatgaaaaagctgtatctaagactctaataagcttttgtacttactactagtagctataattttagaatcaattaattgctgaaaaactaaaaaagactccataataaagtacacaattgtatatttactaatatttaaattcgagattatgaaatgaagtaaaacatatagtactagaaaaaatgtattttgttggattttagacgttcatactaattgtgaaagggattgctagaattatggagttgcatttttcgcttaatttcagttacttctttttatgtgcttgttctctcttctatatgtaattatgattttatctctccaatcttctcatttaagtagataataaattacttttcttaattctcttatacgtttgtattaaacaaaatacaatgtaaatattgaaacttacagagttggttttaaaagttacatatttatggtgtaaaaatgatttgataactttttgttgaaaaatatggcaccataaatataggtactcccaattttgaatgtagaagctattattaaaattgaattttgttttgcactacttgaaaagaagctagatttgtttttaaaaaagggttaggttacataaatcaggatcctccacattattgaagaagaaaatgcagaggagctactatgctgttcctagcgacagtagtactgcatgtctgcatcattgtggcactagacacaaacgtttgtttgcacagtgaccctctgcattaaaatggatgatctataacttctaataaagtttaggtatagagcatatataatacaatagttcgtacgaatatatttaagtacataacgatcaactgggctttgtctaatccaaatcattcgttactctgtaattatcgcatcatctgtttcttttctcataggagttgtactttaattctctatattcaataaaatggacacatccttatgcgaattcatttaaaaaaagaaattcactaaaattggcagcaaatgagattttgcccaaatgacaaattgtactatgcaccatggcttggcctaggtaggtggcagaagcaatactaacttattatgcctaaaccaaaatgcatggctcttttgttgctttcatccaatctaaagttggtttcttgtccaatatgtagcaaagttctctggttatatatgtctgtggatagtacacatatggttgtgttgcacgagcgattaattaagtgttctctggctttgttatttaataattagttgaggatggttgtatctcctcctttatttggctagctttgtttcaaggaagtatcattttcttttagatggaaagattaattagttgaggccggatggttgtactctaaaacgtactacttaatttagctagctttgtttcaaatgaggtatcatttttttagatggaaggaaatacaaattgttatctatattctaattcagatgcaaagtcagaaatatctatattttgagatatagatagtaatgaggaagtaatgattcttagtgaaaacacatccacacatctactctaggttgtactaataaataataataaacatcataattccataaacattttgttttgtaatgaggtcacacagcccttacactagggactgccaattaataacatatccacaagggcaaccaaacatgaggaggcaacccttgattataatagtgacatgtacatttgttattgggttatcttgttagatagattttgcaattgcacgtgtattaacctcctgtgtgtgagaaaattgtatatctaccatagcataatattggatttgctggaataccaccctgaattaggcttcttcgtcaaaatgccatcctggatgaaaatgcccctagctcttcttctttctccctccaatgcctaaagggcttgccaacggccaaccccgcgccacctgtgctgcctcgccagcgactagggatgaaaacggtacggaaactatctttatcattttcgttttcatttcttttcagaatcggaaaccccggatacgaaaccagaatagaatattatcgaaaccgaaaacggagtgaaaacgaaccggcgcgaatacggtagcgaaaatttatcggaatacaaaacccctcaaactgataaatccaattctcaagtctcaacggtcaacaattcatcataaaacacaatcatataagtctaatttttaagtctcaataatacatcacaaaacacaatctatgaaataaattatctacgtttaagagagtaatgctgttgataaatcctaatgctgaaaaaaatattcttatgtaacttcaaatttacataacaaatatttttttttaaaaaaataaaagccaaacaccacggtattcactattcagtacttaaaaaaagaatccagggtatttcagtcaaaaaatttccgtaaattccgagaaaatttctagaaaagttttcgaccgattccaagttccgatggaaactgcccttatcattttcgattccgtttccgagaatatttccgaattcatttccgtttccgaaaaattccgaaaaaattccgatcgacagattctgttttcaaaaataggtccggaatctgaaaagtttccgtaccgttttcacccctactagcgactatgggggtgctgccctcactatcgtccgtgcctcccatcctgcccactctacaaggcattcggcctctatgacaccaccgttcctgttgacgttgacgccttgatgcgccacccctatcgctggtgagttcatccctgtcgacacactccatggctcattcgtcgtcaatgtcggccagttgtataccaaccactattctcgcggaaatttgtcaccaaatacacaaacgacgcgcgacctccttcaaaacatggaatggcggtggtgacagggcacggcactagcgggcatgacgaggagccagcaccgacatccttctccatctcctgcaccaccgatctccttcaacttccgcaacgccgcagcctcctcaagccccagcatgacaggcggaatgggaagccagaacagtagggagggtagcatccccattgtggctagtgaggtggcatcggtgatgcggcggtggagctaacggttggtgccggtgagctcttcaggcattggagaaaggaacaagaagagttaggggtatttctgtttaggatggtattttggcgaagacgtcctggagagtggtatcctagcgaatcccatttaagcgatggtactctagtgaatccagtcttatgtgatagcagatatgcaattttctccttgtgttctgttgtcgactgaagcattcaaaagcagaagcatgattcttagttgagctagcttgcttatataaaaacatgcatttattttgctaggtattatgtctagtcatgagttccctgactacaagtaacaccacatttttgtgtaaagctccacaaaccaaactgctgagcttgcttaagacataaagcctttgcatgattcggttaactagttgactatattgattatgaatttcatccaattaacctagttcccagtacgaagggctagcgaaagctatcttttcatgttgatgatgtggaattataacacatcaagatatggatcaaaccaccacatatataagttgttgatcattcagttgtttatacaatagattgttaagattgaataagtaatcatatatatggttgtcgttgtccatttgcattttggttaaccaccaaatttaacatgtactctaatttctttattgtttggccatttgttgcatgcgtctagctatctgctatcaattcacccatttcctttaatttaaatggacccttatcgtcttgaccatttttcatacatcatcctacccattattgtcaattgactgttagcttggccatttacatgtacagtttgtaacaattaatcaatgaaaaaaattacaagccaaaaaattaaccatagtaccttacatcattttagctcggaagctatcatgcattctgcggtagaatctagcatcaattgcaagcaaataaacatgacgtaacagagcatattctctctgcatatatagctccgatgcaaggtgacccacctaaagtgttatcaatcaacattgtctgtatatgtctttgtccagttgtattatggttaaccaacaaatttaacctttcctgctatttacttctcgtatcaatttaccactgcctttgaattggatcaagacctttttttcttttgacatttttcatatacatcatcctctgtacaggttctttattcttctatttaattaagtcaacttaccacttacagttttgtaacaattagtcaatgaaaaaatgcaaaaaaaaacaaaatctatatcattttagcatgaaaacaatcattccacggtacgaaatagcagcaattgttagcaaatagaaagggcgcacagaacatgcatattgtctgcctacataggtaccaatctgaagtaggagtatctagcaacaatgtctatattggattcaagttattgtatcactctaaagagataagacacttaatttgttgctatctctcaaaatgtttgcttaggaggtctctctctcatccaccaattttaggataggatcgagtacacatgtgtacaccgatgttcagtgcacttatgagttctaacattgtttcaagtgtgtagtcatcggcttatcgaaaaaagacgtgtgtggatatggtggtgggagtgtggtgtgtatgagttgtatatgttttgattattctattaaggaaggttgctaggttcatacgatagagttatcctagttacatttggtgtgttaacttagataaacaaattttaatggttgaaaatgctagcgtcttgccctttactgatttgccaacctcttttcatttgtcctttcactgattcaacaagaatattatgcttgtgaagtacttcattgatttagccctccgatattaattgttctatttcgtaacgccattagctcttaatcattttttcaaagtctcatcacagtttcaactttcatgggcacaagctaaagcggcattcagagatccccaaggtgtggaatagtttttagaatatgatattactatttgagttatgattatgtaagaagaaatggcttaattttataattgttgtggttgaaactggttttttcatgtctcaatgattgccaacttgtcatcaacttgcatgggtaaggagaaaatgacctgtttctctagaaaaaaaatttttagtctttgaacaatgcaaaatctatttgttcatttgtctttagatgaaggtaaaaatccatggaattggtgaccgatctgttcattgctgttaagtttagtcaaaacatgcagtgctgtgatgtgatgtttggttagttacatagagtacttgtctagtgcttcttttttcttttatttttttttgttttctgttgacatatatatgttacttttgttgatgccaaaaagtttatcctcttgatttgcactagtcattataatcggaaggcgttgctcaagcgaagttttagcgtcgacatttcaccacttatgttttactagctacagtaattaaatatcaaggagaaaaatattactagtggttgaaacataaggagaaatggttgtgtgcatctgtttggatgtagaggcctgtttaattcattattaaaaaaagtgtatttagatgacacaagattagaatagctaagttatatgaagaaaaactactaaatcagcccaattctttttttaacccaccccttacattttgtagaacaaaaaaagttgaatccattaccatccctaatcgcgccacgacctgtcacatgtaagctgtcatcgatccgtaaacataggtaatttttgtcctatagctaaatggagttggtcttcagacgacttaaaccaagaagaaattaatgaaaccaagaagtcgtctgagtcctgtcaaactaaccatgcattgtttatttccttcattagaaagataattaattggtgttgtcattgtcagatagatgaacacgttaattaatttgagaggaggcgatcgatcaacacactcaaagtcatcacatgcgttgcacctcgatcgatcgatcgagatcttaccccgcgttatcacttatcatcatcttcttaattacgttcttcttcgcgagaagaagcggtgtcggaaggtggccgcgccgccgtacgaccggccgtcgtggcgtgcaaaaagaccagcgacaacgacgacgacgacggcgacggcgacgataccacggtgactagctaattcagtggaaggagatgcgtttacgcacgtataccatatgatcgaataatgccgtcgtcaatttgtcgtcgtcagtgaaataatccaaacgaattaattgtacgcgagaattcgagatgccacttgtgttaatttagagcaattaagagaggcaaccactacataaaattcaagacaaaaagagagaggggaagagtagattagccaaacaaacattgggactactgtattagaattagtatagatgtgatatattgtatatgttacctctatatttattagttgatgatgtggtatgcaacatccacctcttttataaaacttgcccttagtcctaaacatatcccctcaacatgtgtccaacgttgtaaacgtgtctgtgattggctgggcgtgcagatcgataaccattttaattagtaataatgaagagacaatctagaagcacattgttggcaaggtcatttctgccctcgttttaggtgcaatattagatttttgacacataaccacaatcgatcacataattttggaggagggcgatggtagagtcgtatatgtataactctatatatgggtgtttaaatcttggtcccgataaatatgactctgtgaatccaccaggtgcagaggctgtgtgcagttagtgaaaatcttacttgaaatcttaagccacaaagctctatcgttcactctttaacttatcaaatttatactttaaaacttaattttagagttttttctttaatttttttatcatagtttatttttatattgaggcttttacgtcgctaagaaataagaacacatatataagtagtttaatgtataattcctttttattaatgtgttatgtacggcttatattcagttgtatgagaaataatttgactgaatgagattgtacaatagaatcttagtttttttaaggaaaacatgtttaattatgtacacaagaaattagaaacaaataatcagattgatgagcttgcgaaaaagtatagcagcaaaggataacagagggaagtaaatttaatcttgtgttgtttgctcataatttactttaagttggtgtacttaattactttgtttctaattctcaatctaactaactgtgggagggaagttgggcacgtgctccgatggtatgccaatgaaattaatgctgggaaaaacgttgcgctcatcctgatagaagcaaattaaccaagctattgcgaccacaactagatcctctgatctacttggccatgaccagtgccacaatttctgtatcagagagttctagctaatttgccttgtccagtaatcaaaagaggctgatttgtcctgtccagtaatcaaaagagggggaagaatgtatagtataattcttttgaggggaaagaatgtgtagtaattaatcaagttcttaattttccttttagtgtacacttattttttagttttattttgaatttttgaattttaattttatttcaatgtacacattatgctactatcaatctaccaccatcacctattgctatcatatgtatcatatttttttcatcaatccagcgccaggttacaagtttctgagagatccttatctttttttgaaaaattactctatctaattgaaccaaaaataataaaataatagctacgatgttatcttagaaattaccagttttggtagatatcctaccgccatggaacgcttttgcattgcccactagtattttacaaaactaatattctgtctttgtactaaagtctgagggtatttcctttccctttcaatagctactgtaaccgcgagagcttgtgcatgcgtccccactttgtttctccaagtccctctcgtctaaaagctaaaaattttggaaatttcaaaaagaaattgttcaccgcccaagtataatacataaacaaaaaaaattcaaatacttactaaagaattaatgatagttaagaggatactgcagagcataaatgcaatagatattaattgtctccaaaatctagcttagagcaagtttaatagtatagccactggtagctccaaatcatctatagccaatgtaatagccaatttatacaatagttgcttactgtactattaatatctggccccacctgtcatacacacgttacgtcttagagtccgtgctgcagctggctaccgatatatagcccgctgctcttctctctcttcctttatctctttaaaatatgtttatagctggcttatagcctgctattgtacctgctcttagtctaatattccgatcgaggtgcaggtagtaccccacttaaatttttattcccactgaagttaaactatatgattgcagtgccaacacttaagctgacatcacttacccatctactctctctatccagaaaaaaaaaaactaacccgggtatgaactctatgattagatttttttttacgaagagagtacaatttatagtggcactaaaccatccattataagcagactgagttcgggctacatggaaaacaatattacccattaacatgtgattaattaagtattagcctaaaacccttgaaaaataaattaatatattttctaaaagtcatttttcataaaaataacttttaaaaagcacactgtttaatagtttgaaaagcgcgcgggtggaaaaagagggaggtgagttgagaaagaaggagaaagaacacaaccttagtgtctcaactctacaattagtagctaaggccaaatgggcaacatactagtactactaaacaaaatgattggggagagagtgcagaggaagccaatgcatggggagatggtccgtgtaagtttagcaaaatactatatatgctagtagtagtagtaaacaaaatgattagtggctggcccaatgctcccacttgcaagctggagctctcaacactcttgtcctaatgagcttatcatcgtcaatgagacaaaaaaccattcaggtcgctcttatcaaagaataattatttgatcttatcgttggaatcatgctcatttggagaggaattccatgataggtcttccttcctctctttgttcttgggaaacatactcaaaaccattatcatgttcactttttttctaaagaaaatcattttttgacgcaaaggtagagagactctaccttaattagttaatggcaagattgagaaggcagagagagacaggaaaaaggtaaactgaaagggatgagaagctagcaaaaaatagagagaaaacaaaaaagaaatcagggtaaaattccctgagcctagtctattttcgccgccaagaggcgaatgtgtttcaagttggctgggcttgacgcgaaattcaaattcccatatgccaagacattctttgatctggtggatgtgcttttcaaagttgaggtttgtttggtgaaaaactctggcattacttgcttttcataagttgcgagaatcattgttatgttcatcgtcactagattcactttgactgtccatttcttactcaatctacttcaatgttaaggttgcaccaccatggaatgaaaaaagaagttcaaaaatctacagtaccccacaagttctctgaatgtgattactaacaaaaacacttaaatttttaaaactgaaaggaccttaatgcatcttctaggagattaaaataatagaatgaacctggacagtttcatgaggtttgatcagtctattctgaagatggaaaatgaggccgtaccgctagctacccccaagtttgaggaactgaatttggcactccctccatatcaaaatattttctacattcctcctcatctcaaccaatcataacctttccctcatttaattttttatctactttctaatcttaataaatcacaactatttctcacctcaacctttatctctttaaaaaaaatgcataaatagttatattttgagaccaacggggtagctgattacttgtaatttgtttttagctatgttagactagaaggagatttttatttccttgtgtaataaattctatgcaaccgcatatatatttaccatattaccatgtcacgcaaaatcctcctcaatccttctgtcacacatgcatggatggaacttcaaattgatcattccaagctcaccttagcataagaaatcgcaatgctaagtaatacggagttcatattttctttgtcgccattgactcttacatatatgtttaccctctctggttccataattctttacgttttgaacaatgacacagtctccaaatatatttttgactttattttttgttatgatatatatgataaataaatgcatgtttatttttattatagtactttgaaagacaaatatacatatatgttgttattattcttttaagtttaaatatttttaaagttattgatgttacattgatctctggccaccgagtcagacaattgcgcacataggcttggcctatcccacgcccacgcgcggctaacgttgagggccgattccctcggtctcgagcacacgttgctctctctcgtgcaatgatcggacgcactatctacgtaatgggctcgcccccgatcccttcagtgctcacatatatataaagggaatgctacccgttcgttggtggcgatcgatttacggcttagccaaacccaaactctcaaactatcgatcttaaggcgtgttgaaggggaacaaagggcgaaatccattgccactgctgcacggtgatcacatcaccggtggcctactactgcaacaccgacgccgacgccgacaaaggattaagtgtggtgctaatggcttctccaaacaccggttagtacatcaccaaatttcacataagcttaatggggtgattatgcatagcctgagttcatgattttaagaattaattccaataattgataaccttgcctaaaatgtcaagaattacgaaaccggagtgagtacgtttgatcgtttatcttattaaacttttttctataaatatgaaaaaaaatataaattatgcttaaattaaagacattcaatcaatgataaaataaatcacaacaaaaacaaatgataattacatagtgtttttaataggacacatggttaaatgcatgcttaaaaaatcgatggcattgtacgttaaaaatcgaagtgtaacatattgcgagtgatagatgaagttctggttggatcaattatggcattcatctccttccattaaattcttcgtttccccaagtcgttcggattcacacgcatgatataagatgggaaaagcttattccccgatcaatgcatgtcttcttttacttgacacgtcagcttgctgtaagaaaacagtaacaggtcaccattatcatgcatggcaattattatgctggaaaagagttagaccttcaataattagcacaatggttgtactcctagatgagatgtcaccaaaggattatccatatggtctagtactatggcccaaccatagttgtcaatttgattagctacacatagaagaaaacaaggtttggctaatccaacctaattgtaactagtggataagaaagcctgactatagctgaacacagaagagaagaaggttggctaatccaacctaattgtgactggcggataagaaggcctgactatcttatctgtgaatttgttgttcatatatgtttgctgtttgtacttttcaacttttttgacatttctttctgttactttgttcaagaacatatataagtatataacgtcgtttagaaatgtggttccggaatttacatatagctctacatcatctgcaactttctattatcaattctcaaaaaaaggaaaataatatcaaaacatcacatacaagcaggcttttgaattgaaatggatttcaaaattggatttcatttgtgagcaagtaatgttaattagttgaaccatcaattccttgtatgcatccaattcatatgcaaggaaccaaacagaactcttggtgtcctgtaccatttgccagctacctacattactcaaagccttttaagattcattgttaacttccaaaaagaacatgacataatgcagttaggacaagaccaccacttgattagtgaaggattaaggaagaggatgatagatacactgtgttgacgcacctgaaacagagattgccatagctttgcttttagcagaatcaggtaccctgaccctgctctgctttctagcagctaatctcctttcttttcacactttttaaaaagttacatgaccacaggggaatagtaaaaagcgactacaggtcaactataaatgtcctacctgtctcaactttagaactctcaacttcggtctctcggtgtgagacataggatgtgtttagttcgtatgccaaaaatcttttaattatacggacacacatttaaaatattaaacgtagactaataacaaaacaaattacagattttgcctgtaaactacgagacgaatctatgaagcctaattaattcatcattagcaaatgtttactgtagcatcacattatcaaatcatggtgtaattaggctcaaaagattcatctagcaatttacagtcggactgtgtaattggttttttttgtcaacatttgatgctccatacatgtgtccaaacatttaatgtgatgaaaaagttgaaagtttaaagaaaaaagttggaatctaaacacggccatagtctttaataagatgataaatgtgctgcaccgtttggtagcttatattatcaaacaataatttgatcttatcattaggactatggtttttttttgcgaggatcattaggactatgttgaaaacgctactagtcgtccgggctttacggtgatactggtttcaccgctgggctagtactaaccagacatttttactcgagttagttataaatgctttgcaactgtgtaaccacttatcacatctggcaaattaaatcccttcaattctccagcctcgcgtgcatatggatatagatggaactgcaagattgtctccattggagcattccaagaagctcatctgccacctagaccaaactgatcgattactaacatcagctcgtgaaacatgcatcacgttgtgtcggtgccagatcgatcagtttctctgcttcaattctgtcggccatctcctgcaaatttaggccatgtcacatcggacgtttaacacatgtataaagaattaaatataggttaaaaaataactaattatacagattacaactaatttgcgaaacaaatcttttaagtctaattgctccataataatttgacaatgtggtgctataataaatatttgctaatgatagattaattaggtttaataaattcgtctcgttgtttactgacggattctgtaattagtttttttattaatgccaaacaccctatacaacacctcatataatacctgacgtgacacgctaaaaccttacaaccgtggatctaaacaacccccttaactctgactcatcgtgtgctcatatcaaccgatctgtggctcctgctgccctatttgcatctgatctgacatgcactatatatcgatcacacacaaaatgacacaaacacagacacatgggagagcttcaggccctgtctcctctctgcttatctacaattttattctactacacatcctacgccgtgacacatcagctgctcctactgatcagctagaatcaatgtacgtacccagaatacagcgacgcctaaccttctccattgcagagcaacaacgacatccaactgtacacgataaatgctcatcagagtaagagaaaattagtgtctttagctattatcaatgtatcattatcaatcgataggagctgggatttatcatcgatagctagctggattagtcactgaaaagattccttcgtgtggtcctagttaatcttgggccccaaacgtggctgtcaattactcaagccattgaaaaaaatgcatcaaattaaatcgaagaaaaggagggagctagatgctgtagctaatcctccaaacctactgaatctgagtggccaggtataaacatgaataataatccgagtagcgtataagagggcccggctatcttatcatcatatgtgtgtggagaccatatatatgcactgatcgatcgaattttgtctgaataacatcacaaatttcgctgtcggaaaacctgtaggggatcatcatgtcgttcgcctataatttgatctgcagtgttcagtagtcgtctctgcgtatatataatatgatctcactggttggatgcaattatcagtagcaaattgcatgcatgtactgatcacacatcgacaacttgagtgcactgatcgtatatactccctatgtttctaaatatttgatgtcgttaacttttttaaatatgtttaaccatgtcttatttaaaaaaaataagtaattattaattctttttctatcatttgatttattgttaaatatacttatatgtatacatatagttttacatatttcacaaaagtttttaaataagacgaacggtcaaacatgtgctaaaaagtcaacggtgtcaaatatttagaaacggagggagtataatttcgataatagaatagactgatcgtgttactcgtgggagccatttgaattttgttattgggatggtattgtacatgatgagtagatccgcaagaaacaaaagaaaaacatcgtacgacctactgtacgtaccattggcatgggcagatgagatcaatgaaggaacagatcagatcggtctaagctaataattgtgctccttggctaggttttcaatatattcagatctcttgtaaatttttttatacatcgatctgcatctgccaattgcgttcgattgagcaagattgcttatctaccactactactgcaaatatagtatataatgcaattattgtcagtgagagttgaatatatattgccactcaagatgaggttgacacaaactctgcatgcatatctgataaagcgaaatagtactccctctgttttcggataactgatattgttgattacatacgtctcactttaaccacaaattacttttaaatgattgtgtcatatgatgaatgcaagctttatgtgtatcgataacataacatattttcaagtatttattttttaaaaaaaacaaagctagaggtcaaattaacttgaatagttaatttcatcgtccattatttgagatcgcgggggagtaacaatttacacacactagagtaggatatatatgtgtgcttctaggtcctttttgcttgctgtttggagagaactaatttgaaatgtcacaattgtgacctttcaaggcttattcctatgtttcttgaagtgtcgcaggatgaagaaatttgacttgatctttcggaaagtatcagaacatggagtgccttcacatattttactggcacgtaaattaaaattcttggtgaaacttagtgcgtgtgtcaaaaaaaaactgtcgttaattaaacaccattattcttgtaaattaatatattgtgccaaataatgtcaatatatacatagtggtctatacccttgtcatatccagccgtatggaaacaaattaatacataggatgattggaaattaatatgggatatcaaatatatatttgccctaatcccttgtagtcagagcgggagcaaagttgtagtttaagttttgagttggagcagagtacgtagaatctaaactccccaataagagcgtgggtcccttgttaaagatgccaatatagactatgataacataagaatatggaaaaaagttcaaatacccctctaaactttagatgaaagtctgtctaacaccctaagctttaaaaccggacatccatcccactgaactttgctataccatccatattatctcctaatgtggttttaaatggtggttttgcatattttggaaacttaaacgaataattttgaataactaatataacatatttgtgtatgatcagttataaatcatcaatttattcttcatatcatgctattattatgttggtacttgtttgtaagtgagagctaataaggagcacaaataaatattcaggtcaaaaatttaatatatatgtccaaagtgtatgacatatgatcaaactcatccaacttatatataaattagataaaatccactatgcaaaactatattatggggttatataaacggtattgtaaaatttaggagactgaatgtccggtttcaaagtttagggtatgctagacagatttccatccaaagtttaggggttattggaccttttcctaagaatattaagaacacaaattagtccataaataattcactagtagataaagtgcaaatcattttttatgtgcttcatgctaatgctgcatgggattcctcgagagatataaacaacacctacattatcatagtatattacgatagcatgctgtacgtactaagagttgtaagcccaaactatcctccatggccacaattaagcttctatgataatcttcgtcgtctagccttgaatatgaacttttgtatttttttcaccgaagaatattttcgttggtggtcatcttaagaatgcgcttgtgaaaattaattttcgctgatgaccctcttaaagaatgcgcatgtgaaaatataggatgttcacttgccattacttgctggtggggaactcggccgcctgcgcaaaacgtttttaggccgccagtgcaaacgcttttttaagtagtgcctattgtctcttctggttcttcaccatcgatcgctactagtagtgttggtcacaatcacatatgcctctccaatccttgcactaattgactgtgcttgccccattgctagtgctcaccttaatgttcacgctggcctagtgcatttgccgtttatgctgtactggcccaagtgcccgtacccatgctcacctacactacctagaaaaatcgttttttttttgggatggccaaaaatcgtttttccggatggatggaaagcccgcctagacgcgtaagcctaaaaaatagatcattttcacaggcgacatcaccatctttgcaggcgtcatagccacacgcctacgaaaatagtttaggcgaaaaaaaaatgccgccgctgcagcccctccccccctccggccagatctaggagggaggaaggccatcgccaggagctggcgccacctggagccgcgccggcaccggcgccgccgagaggaagggaggggagggaagccgccaccgcttggacctgccactgcagtccttcgccgccgccaccaccgccggtagccacagttgccctcccccctccccccttcggtcaaatctgggagggaggggagccgctgccgccaccgcccccctaccagcggagccgccgccgccgccgcccttcaccaccggctccaccagatctgggaggagagaggggagccgatgcctctccaccctccgtgccgccaccgcctggagccgccgccatcaccatcttccggcaggtgaggaggggagggagagatgagggagaggagggagtggagaggagaggggagggagagatgagggttgagagcctgataggtgtgatgatttagcgattttggtgggtaggtgtcgcttttaatatatttaatcttttttgcaggtggacaacgatcttgtcccacggttgtcattttcgcaggtggccatctagctttgtaaggcccacctacctgaaaaaaataccatcgtctggaaaaatggtttttctagtagtgctaatgccgacattggtgtactgcatgtgtcatccccaattacaatgcatgttgtatacgtccttgtgaagttttgcacatgtgcccttgctggtcacgttggtgattcctctggccttgttgtctatgttagcgaaccacacctatggtcttatatatcctaaggggtaaaaatggcttgaaaatagatggaaaccagctctatcatttctgtttcactttttttttcagaatcagaaaccctggatatgaaaacggaatcgaacattatagaatacggatacgaagtgaatatgaatcagggcgaatactaatttgaatatttatcagaatatgaaaacaactgtaactaagtttctcaaatcaactgagagatgtagctcattatatttttgtaaaacaatataataacattttaaatttttatcaattaataataatacaactagttgtatactccactttctaggagaattaaaataagcaagaactacataaaatagtatgacatagcctaatgaaataagaaatagtcattaaacaaaagaaaaacaagtcaaaagcaccggactagaaaaaaatatctccattcaacaattacatcaataatactcagtacaaatctaaacatcttgagtagagaaggatgaaggtaatcagctgtacatgaaaagtaattcgtttccgattaaaaaaatctgaatttgtttccaaatttatttccaaaaaaaatctaactgattccggttttccgacagatggtagccttaccgtattcagttccatttccgagaaagtaattccaaatttgtttttgtttctgacatttttcgaaagaaaatccaaccaacactttcatttccagaaacacatccggaaatcagaaactttccaaaccatttttgttcctacttatcctcctgacaccaccagtacggtgatagcctagtggatcttttctaacaagtttcatgctgattgcttgttgcagtataaggctttataattgactttaataatattttcagttcggtggtcaagcatgccacttttcgcacaatacttaccatgatgtgaaaaacatgttccttcatgacactctaacaatgacatattatactttttttcatccttttgggtttgttgattcatctcaacttgatcttgtatgtcacctcaatgagtcgttgtatgggttggagctcgcccctcgctcttggtatagtcattttccgctttgctcactctgataccatgaaagtggaatacctcatgcagtagattggttgcatactataacatgaatatgtatataaacccagtcttgccatatccaattgtactatgacttatgaaaacaaataccaaggattataaaggcatgcacggatatattatgctaaacatatggggctaatagccacataatccaataatgggagttaggtattcaattaatggtactatcaattgtgataagggaggccgatacatcacatgcaaatgtggcgtccatgtcatcagaagagtatagagacaaatcaagtgggaccagctcgatcacttgctagtgaaagggggaggggacgcgttggaaacgtgaggatacagctcaccgtgtaatgtaagccacattttattcttaatttcattgaaatttatagagataggcgctggatataaatactttggatgtggatacaaatccaacttattcaggcaacagattcgctctgaaaagacaaagaaactagagggccaaatgtttccaactcctccaaaaatttgtgagatcttggtgcttggtgggaatttttgagatgtgcaatatgctggaccaaatggacagggaactaatggcgataaccaatcctatctatatatatcattctaaagatatggagccacacaataagttcctattgattctgttggcaggagagaacgaacggcccaaatatggcgcaagcacagaccattaatcttcttcccttcaatttgcataccaaaaaattagttaccacaatttgtggatctcctacaattgcaaccatgcatttgatgcatatgcatgcacccaggagctccacacgacactccatcatttttgacgaccttacattggggagccagccagtttgtcaaaccattgggaactgcatgatttggaaattggataggccaacttttatacacaagagaagttccggacaaattaaacaactaattaggacacatgatcaatgtctagtcagtgatccaaaataagctcacctaccattctcaatttctaattccacagtccatgcatgcttaatttgcagaccagctaattaactctcatgccattccaatcaaccaggcttttgttagctgatcactctccttaatttcgttatacacttggagaggcacatcacagtattatgtaccatacagtacttgtcccaaccaaccaaaagagacagctagcttcacacgctgcacctactacattaccaatagtgaacaaatgcatggctgcccatgacttgtagtacatgggctaaaatttctggctcaaatgcaacctatggggcgcattgtgtgtgcacaataataagtttgtgatggtaacggagaattgccgtggtcccaatctgaaattaacttgatagagctagctagcaacaatgattggaatccccatgaaacctcgcctttcgatcgctatatgatcccatcatcgtcgcaaaatagggattactactatataaaatgagtgagatgtgagaaattaccataacaataattcagcgtcgcttataatcctcgtgtctatattaattaagttaagaaagaagaagcccatacttggtgtgtttggtaggaagaaattgttctccctcagttgttgaactattttccatattctattaatatatatttatagaagagaagtggattttatattaagccctataatatatgttcccttgtttctcatgtgcaattaaataatgttttaaaaaaatcaatatagattactgtatcaccaattattcaacaaacttttgcatggacaaaattaatatagaaatgaagaaacaaaaataacaaatttcattgcaaaataatttgttttgttttgttttcccctatggaaaccaaatttaaccttgcattttgcatattaacagatgacatcctaatctaccttgttccattttccaattattattttcagtaactatttaaatcacatgaagaaaacgtccatgtacgatcttgagggagtattttatttctagacactgggagcagtttaatttattttatacatgtagtagtacgtagtgcctaaggctgtgtttagttcagcccaaagtttggattttggttgaaattggagatgatgtgactgaaaaattgtgtgtgtatgacaggttgatgtgatggaaaaggactgaagtttggatccaaactttggatctaaacacagcctaaataattgttgcaaatctggatgagattcttcctcagtgatcatcccctcgagctcgagctcgttgcttaggctgtatttgggagtgctggcacgcaaaacggagcaacgtttaatgcgtgattaattaagtattagctatttttttttcaaaaattgatcaatatgatttttttaagcaactttcgtatagaaactttttgaaaaaaacattagttggaaaagcgtgcacgcagaaaacgagggagaggggttgggaacttcctataccgaacgcagccttagggattaccagtactccattttaagtgaggttgtaggtttctgtttcaaacgtttgaacgtccgtcttgtttaaaaaaaattaaaaaacttaaaaaaagtaagcattaaatactattcatgttttaattattatcgaataacaataaaaatactaatgataaaaaaatattaaataagacgaaaggttaaacgatggacaccggagcacacaactgaaataggatggtgggagtatataggagtactgtatcaatacactaataaactacgatcccgaagaagcatcttcccaagtcatcctcgttgcatggggattaacatagaaaatctgaattttccaaaacagttcggccacacacctaaaccaaaacaagaaggtcagatcgtgctagctagctagatcctgctggagtagtgctatacttcgatcctttgaagttaggggatcgtttttcggcacacaagggcggagctacatatgcaagggagagggtgtctaggaatttggttttaaaaatttagcaatagtttatctttttttattatatgtgtattcctctcactacgagtttatatatattcacatttgcctaaacttaatcaaagatgagtaaagtaaatgaggggtcctctagctactcatgaagctaagtactactccctccatttctaaatatttaactccattgactatttagcatatctttgaccattcgtcttatttaaaaacttttatgaaatatgtaaaactatatgtatacataaaagtatatttaacaatgaatcaaatgataggaaaaaattaataattacttaactttttttaaataagacgaacggtcaaacatgttatagcgtcgaatatttagaaacggagggagtattcaggaacatgaactgaacatgcctactctcatgaatcgtaatatacgtacattagcttataatttctgtgagggtgatctatcgatcgatccccgatcggatcggcctgcaggttaactataaccactttcgcattctctatcgttttgaccacaatgtatattactgtttattagttaattactaccagtaataagtaattaattaatcaatcaattaatcaattattatccgtgaaacacgcttgcatgcatgtgcgctggccacactcagctgctaccttggcgcgagacgcacggagccacacgtgagaccacccccaccccaccagcgtggcgtgggccccactcccggcccaccaggcccagcccgcgcgcgcggctctatataaatcctcctcctcccctcctcaccatcaccaccgcccacaacctcagctcagctagcaaaagtacaatatcccttgtacggacgcctagctaagctaagctaattaagctctaatttctcttttcttttttcttcgatctccggcgaaaaagtaagtacaatggccgaggtgaacggagccaataacggcaacggccaccacggccacggcaacggcagcggcgctgcggcggcggcggggcggtcgacgagtgtgtcgaggaagatcgagtcggagggggcggtgctgatgcccggggtgtacgacgcgctgtcggcggcgatcgtccagaagaccgggttctacgccggcttcatctccggctacgccgtctccggctccttcctcggcacccccgacgtcggcctcctcacgtaattaattaacacacaattaattaatctcatatatatatacacacacactctgtttgtgtgtgaattatttgctgacactagccgtttctccggcgaggttcatgcaggccgccggagatggcggaggtggcgaggcggatctgcgcgtcggcgcccaacacactcttcatcgccgacgccggtcatctctctctcctctctctctctctctaaaaatggcactttaatatatataagaccaagaaagaaaagcaaattaacaaagaaagcatcgtataatatatgcagtaaagttgacagtgcatgctagatttggaatgctaatgattcagctgggacatgtttgtatagtaatttaagtacaaacttgtgtgtatatgtatgtatgcatgcatggtacccctcgagatataattatatgttgcacatgaactttgctggaaagcacaattatatattagctgaaagggggaaattaaaaaataacactgtcctataacgctgttctggggtccatcaccatgcacaccagaagcttggaccagggatctgcaagtgaaaacagtgggtgttaaaatatatttcttgttctccaaaaaaaagtatatatgttggtgcatgaaactgtttaagaagagtagtttataaggacaaaattatatttttgttctcctggagacatttgctaggtgatctgtttccttcagtgctaaaagaatgttgacacaagtactgctacagctttttttaattatgcatgccatgacgatgattactgttgagatgacgtactttagccctttttaactttaaataaattgtattttaattagcatcacttactgtacatgattaatatgattttctgttgtctgatgcaaaatgtattctttttttccctccagacactggtggtggcaatgctctgaatgtgaagcgtactgttcaggacctgatggcagcaggtgctgcaggctgcttcctcgaggtgatggattcttcttcaccttgtcttgctcgcactgtgcaccacatgttccctttgcaactattaatcaatagtagtggttttgattttgacaaccaaaaaaatatatatcatattgtcactagtaatcagtaatattgattctgtcttctcttttgcaaattccaggaccaggcatggccaaagaagtgtggtaaggaactattcatctgtcacatcaggaaaattgttttttcctcaggattttcttctctcttttttttcgattgctaatttacttttgtgtctgtttgttcatcgatcgtcaaggacacatgcatggcaagcaggtaaatactgacaacacactgtttttgtccctacatgttctagacaaacatgtactactactgtatagtgatactaattctgtttagcactctgttcaccattgcaaatccatgccaatttatagcttaagtacgtacacttaatgcacacctgccaaaatctaatgaggaaataaattggtaaccgatcctgtcgttccgtgacatcgaaataataacaggactaatgtgatgaatcacaacttaattatcacaagttataatgcaaaaatagctagctaggatggttcaaaatgaccagaaaattcgccctagctatatatatttaccctctattatttcacatagcggagatttgatatatatatttatatctactttgaatatatggtgtcactttcactaaacatattgatattggaaatgaagattctgctgaattaattcagtgacacgtaggccccaacattttataccatgcatgcactgttaaatatggaggacccattacaactttgcttttgtatgtataaatatgtctctgatgtattaatggcaagttctagctagatccgatcgatccaacattttgtgcattaaacaaaaacaaactaccaacaacaatcaattaatgattttatcacagccattatatgttgtctagctagctatgtagtagagtggtaataagatcgagtgcaccatgttctgcatcttgtcaccatcatcgaggattacaaaattgtggccggcattaattaccttgatctctaactctccttgtgttggttaaaattaaattaggtgataccagcagaggagcacgctgtgaagatagctgcagcgagagaggtcgttggtgatcgggacttctttatcgtggcccggactgacgctcgatctgtcactggtcttgatgatgccattaggcgtgccaatctctacatagatgtaagcagatgaccacttcttttttctagagagagataaatcatgttctagagaatctcttcagagtcaaactctcgtttaaatttgatcgatctcaaccaccaactattaatcttaaacaagttcaagtctgtcaagaatcaatgttttgaaattaattagttctttcattagatattggtcaaagttgcattttgaaaactgatatatgtgaggcgaaaacactttctttttacatgatgaaatgaaaatggtttgtatctttgtcttctattatatattaggctcacaaacaatgtctgtggtatatttttctcctatataatggaatttaacccattggtgtttttacattggtctttactggttgtagaatccaatctaaaccgttcattttcttctaatcaaataaaatcctatcaattatattactatacgtacctcaactacggataatacaattatttcttttcctatttactagtaggatatattcataccagtagagatcaccgtaaattaagctattattattcaacatcatatcatatctaatatgaatatatgtaaaaaaaaaattgtaggcgggagcagacgcgtgcttcgtggaggcgccgcggagcgacgaggagctgatggagatctgcaggaggaccaagggttatcgcgtgtgcaacatgctggagggcgggaagacgccgctgcacacgaggcaggagctcatggagatggggttccacctcatcaagtcccccctcaccaccgtctacgctgccgcccgcgccctcgtcgacgtcctcgccgccctcaagcgcgccgagaccacccgcgacgagctccaccgcctcaccaccttcaccgagttcaacaacctcgtcggcctcgactcctggctcgacatcgaggttcgcttctccgtcaactcctcctcctccgttcccaagccgctcccggcaccaccggcgctggagaccacgacggagatggagaaggccaaggccaaggcggccgccgtcgtcgccggaaacggagctaccaatggggtacactaagatcgatcaagatcaagctaccaatggaataaattatcaatcgaaatgtggctgtcatcagggagccatgaaatatggtggattacattgattaattctcctgcattattggtgaattttgtgaggtatgtgttattattgcatggtacgtagctatatattgctgtgtgagtgagtgagtgattatgttgggattgggtgcgtgattccgcacataaactgtaaggtaaatatgtgttgagtattcttcgttttccaattttttcgattcagtacagtatatgcagctatgcatctgtctgaattttgagtcagtatgctcgtgtgtgcacggtccagattgatcgtcgatccatgaagcatctgtactgtcagtcagtgtcatgttcagtgtaccttcaaatttatttggaataaatcggcccatggaccgtctaccattgggctgttcgacatcttcttgtggactgaattattctgttgtattcagttatttggaaataaagaaacttgtgaaattttggccaagtttgatggccactactttgtttgtggaccagaattgcctattaattttctgctgctatgagtgcttctgaagatggaatttatgatttctatagattctgtggtttatcaacaagcattgcagctagcaacctgagcaagggtaattaaaaattaaattaatggtgatggttccctccattagtctagcaatgaatctgataaggaatatatgtgatgaatacttcacatgttgaagtttgcttggccctatcttctttctgctattgcaatcttcagacaagtccaagtcaggatgcgagctatagtttagcttttgatatctgtagttcctctgcacattctcatcgatatttgtagcttttgatattcatctatcaatcttgtaaatttgtaatagggggtgatctccgttggttctcggttgcagagtttccttatttaaaaacagttagctattacttcgacactagaatttcattgagttgccttggagtaaaaattctgggaatattaccatgagtagagcaagtcttggtaatcagtcattcagttgtgcgatgtttgattatggcaaaattgcaaaggagggtcataattgttatgattttattctagtttttgaccaatttgactgattcaattgaggaatcgtataaaatgataaaagtttaccaaccttacagactgctacttatgatgtatatagtatgattttttttccatttttttattagtacaaatgcatcactattttttttctgttcaaatatatgcatacaaaccgtaattatgaatgcatagaaaattcaaacacaggtattaaatgcaaaagacagatggacacccatgacattacccacaaatttaactttttttacatattttgggcctgttacaattgccgagtcattggaattcatctagtttgagtgattaagttgggattgtgcgtgtgattccgcacataaacagtaaggtaaacgtgtgtgcgtattttttttcaatcatttttttattcagtacattatatgcatctgtctgaattttgagtcagtgctcgtgtggacggtccactatgatcgatccaacatctgtccctgtatcttgaaatttatttggagcccatggactgtctacccattgggctgttggacatttacttaattattgtggaatcaaacctgtggtgttgtatattcagcaattctgaaacaagtttctgaattttgggccaaattttgatggccactactctgtttgtggggcagagttgcctcctaattttgtgctgctttgggtgcttctgatttctgaagatggagtaacttgtacagattctgtcgtttatcaaggacaattgcagcaacccatgaacaatggtacttgcagcaaattattgtggatggttctctccatgagtctaggaattaatctcctgatataaatatggctcttctttgtgccttccatattgcaatctctgagaagtcaggatgcaagcttgttgagctttagcttttgatatagtagggtaatatatattttttccatttctattactagaacataaaagctaaagctaaagctcattcgattaaataaactgcttagttgaacggtgcataattttatttctttcttatacaccgttcaactaaccagtctagttaatcgaatcgtagagttccagttaaagagaaaagaaagaaaaaaaaacttgatgttatatctattttaaaagataattgcttgaggtaggtagtattagagattataagtaagaataaaaatgtttagaaatggtcagaaatggtatcgattttttatcattatttcggaaaaatggatataaacaattagggaatttctatatttattatgattttaactatttattgtccacttcaatacgatgttaacagaaattttaaaaatggtactatatttattttgcgtaaactgtatcactgctattaaaaaaatttcataccatttccaccccgtatcggaacaaaggctgtgttcgcatgcttaggttgggaacatagtgcctccgcacagaaaacggagcggcccattagcgcgtgattaattaagtactccctcctttcaaaaatctaagttctatttttttttgcaccaagactaaaaagcaattaattagtcaccatgtgacaaaaccaattaacatgcaaccaataagcattaaaatagcttcttggattcctatcaacaatttaatttagcacataatgactataaataggacttagacttttgaaaaaaccaaaaaatgaaataggtcttacacttttggaaggagggagtattagctaatttttttcaaaaatggattaatttgattttttaaagcaactttcgtatagaatttttttttaaaaaaaacacacattttaggagtttgaaaaacatgcgcgtggaaaacgaggggaaggggttgtgatcaaggggttacaaacacagcctaaggagaatagggagacatagtttgatagggatagcagtgaccagtgagctacatccctggatgccacgtaggcaaggaatgcccacctcgagatccacacatccaaggatagccatccacgtggcacgtgggacccaccatccggatatagcgcgccaccacgagtgccaatggcagccaatgagatggcagcaagcctcaccctatccacacgccaaccacacccacaacattttccctcccaaatccgaatatccccaacccaactctcatcacacacaaaaccaataaaccatcaccacaccgtcctggtcgtcgtctccaaccaaccaaattcttgcacacgcgcagctcgagccatggccggagtgagcaccagcgtcgtcggcctcaagcccgccgcggcggtgccgcagtcggccgcctcgccggtgccgaagcgcgtgcacgtcgctgtgccgcccaaggaggagcagggcggtggcaggcgccccgcgctgctgggtctcgccgccgtgttcgccgccaccgccgccgggcaggccaaggccggcgtgttcgacgagtacctcgagaagagcaaggccaacaaggtgagaatgtgaggtcgatcgatgattcgttaagtctcgagttataattaattcatgatttcattgctgatcgagctcgagctagagctgagctgacgaggcgattgattaatcgtgtgcaggagctgaacgacaagaagaggctggcgacgagcggcgccaacttcgcgagggcgtacaccgtcgagttcggcagctgccagttcccctacaacttcaccggctgccaggacctcgccaagcagaaggtctcatcacttcattactttcacaaattccactctcttcatcctatcaaaaaccaaacctcgttcaggatgtatcacatctatactagattggttttttatggaacgaacaagagtactgcatgatttaatctgaaacctcttgtgttgttgcgtgcagaaagtcccattcatctcagatgatctcgagatcgagtgcgaggggaaggagaagtacaagtgcggatccaacgtcttctggaaatggtgatgatctgatgatgatcatcgatcgattggccagccatgaaaacattcctgtacctagaacctttgtgatatgacacaactgcatgcataattgaacgcttgtcgtgctcactgtgtatttgtatcatctgagtggagatttgtagcgaattttctctcgattcgtcgatctcactttgatttctaatcatgcatcttatattggttcaccaagaatagattcaatcaatgtgatccagaccaacaagggaaagggaaaagaacacttaatttactaatttgaaagaagtgagtatatatctgacacgtacaagcacaaaaactgcagtttatgttcgttggaatataagactcacctttaaacatgagatttttctaaaaaaaaattcctggcaaataaaagttaaagaattacagagaagtagagccatatgcatccttcagaaattcaattaaacttgggtgactcgggaggtgacaccccaagcccccgatcacctccccaccatgtgcgccaacgatgctccccggcactattggcggctcctccttccacactccacctctctccgccaatttatcctctcttcttctctttccccccttcttatttccttcagatatggtaagcttagaattccctctgccgctgaccaccttcactgtcggtggcgatgctccctgccagcgccggttgcacctctccttccaccatcgacctcccaacagccacccctcctcctctcttcttccctttcccaatcatgttttcccttcatcttcttggatttgaagagcttctcccccctggcttaagatttagtagcttctttgcttgggtcgtccctagacctgaccgaatcgaggttgaaacaatgcccaacacgtgtgtgctgacatgggtggcatccacatggagattgcactagccgatggccagtgccaccaaactccaactgacctccccttcactgctatgtcaagtggtagatggtttccttcctcttcctctctgttggtatcctccctctccctctctttctctctttgtggcactctccttgttcatattggaattagtcaacctagtctcacctctacgacactggtttcaccgcatcacatcttgtcctcgtagtcaattgcctccaatggaaacagtttgctctgccactaaggcaaagcatcgttcaccatccatggatgtgataagtgagggctgactgttcttagaactgccaacggcgggctttggtgtcaagtcttcttccatccactttatttaagaacaattaatactagttagaacaacaaaaagacatcaacatgtatttgatagttgtgcaccgggttttgaattctctccacgatgaaaaacttggaaaagtatttcgtatcaagtatctacacacatcacaaatcacaattcacatgatttctcacatgaagtacgtgcgtgtgaggtacataggattcaaacataggatcaactatatctccacagcctcccatctcaactataatgctctttttgcctaaatagcttatgctattattttcggtcttcaatgacaaatctgtagatctcatcgatctccacaacttccatatagagttcatgtttgtctgaagtcgttgaaaaattttaaaatttcgtttatccaaatagagccaacacttctaacatatattcgggcatataaatgacttacaatgaaaatattgtcaactaaaaattaatagatcgtgtcgccaatttttatgtagagttagtctcaatccaaggacatttgggaatatcaaaaaatttgtccgagtagatttgacaacttgggcatgtaaacaatctcaaaaatcaaaaaatcatcaactacaaagctgtagctttggttaaactatatacttttacataatgtttgtcttcacctgacttatgaaaaagttaccattttctttcaaattatcatttgagtactaatgacatatagtttgatactcaatggacatgatagtcttgaatatgatccgatccattgaggtctggtccattgaatatcggtgctggttgttgttatgaactaaccgtgatacattagtggaaacttaagtatcatagtaatttcttgttaattaattacgaaccatcagtgatatcagtgtcatctctaaaggaaccgatagtgatgagtcatctggtaaaaacaccaacgacttgggctcattgacgaaatcagtcgtgtttgtgttcttgcaacttagggcttgtttggttagtgacctgagcaacatgattgataaaaacgtatgtctgagagctacttgagaatttggtaaaatatgcttgactaggaaagcctgagttcaagattacacattggtaattaagatatgtatcaacttaatagatacatattaacgtattcattgattttatgtatagccttatccatgaccaagaaaaaaagaatttgtaagtagtgtgaaaaagagttgtaggataccaggaatccaaaagaatgattttttttcttttttgccttattcattcaattcatttcaaataagatgtaccttgttcaagccaataaatagagctagggttagagttaaaggagcaaatagaaaaccaaattaattagttatagtaagcacgaaagggttgaattcatttttttactacactacatatgttggtaaaacacttacctaagttatggaagattcatcattcatcgattatctcttgtctatcagtaacaatgaacactgataaactcgtactcctcaattatagcaattaacaagtattaatttagaggaaaaaaactaaggatttgaatcaaaatcaaaacaagctcatacttccgatttaatcaatatagatgggactattgccaaattttttattccgaccacaatgtcgcaagcaactgcatgcatggagttgacgtgcctgaagctcgggccagctccaaaatgggaagccggacgcaggctaaaggatgcaaggcagtggttcaagtcaggcatcctgaaaatcctttaggcctttgaaccaaacaacactcaaccatgtgacagggagggattaggccaggctccttttcaccaggatcatgaaccaaacagccccttaaacattgagtgatttcctaacgacaatttaacactataatcaccatcgctctggtcactcttttatccttgtctatctcttgatttctctcaaataaaagtacaaaacaaaaccaactgtggtagggcttcggtgactaattttccaattgggcgagtatcagttatgttttattcaagcaacatattctatgtcatttggatatatgtaccattgttgttgagcgaaacacttgtcacgtgatacatccacgcacacaactgaatatgacacagagaaataagcactaggtcactcgcttattagccatctcattagcttaaactctcatgaaaaagacttcgtacagttctgttaacgaccaaatttggtatgtttttttgcatcgacaagttctcttacaaagacttgatgaacaaaagaattaagcgtcttttaattagttagtattgtgttttttagttgcgcccatattgaacttgtgtcacatatattttatgcttctacaaagctgaacttgcatcaggtacatatgttaagtcctgaagattatgcaaaaccataagtgggcgagagacctgagacttcagatgcaacttcacgcactgtaatctcccttaggctcagctcacaggaagtgccttcacacattatactctctcgggtgctaatctcgcatcttggtggcacgagcaacctagccagagcactaactatgactgcatgcaatctcatccatcttattttttccagtaatgggccaggatcaaattattcaggtaattgaagaacaatggttgttctgtagtggaatgtgtatcaacatgctcataattccaagaaagatagtcaattatgtctttcaatgtattgcagtgttgttctgaccttgctacctacaacaaggttgtggtactcaatatatatctcagtctacaatgtggcttgttagtgttattgcctcatgccattatgcatattgtccaatgctttttctatattcatgtatcaagcattgttgttcacccaaatgtggaggacgaggctactcaatcttaccaccaaagccatacacttcattgctttgtctacctcaagttgcctcactcatcggtatgtactgaacagcccaattatcatgcttcttgtactttccgcccacaccgcaagtacacaacaaacacatcctgccaaaggccatgtcctattttcccctttttctagcacttgtgagccaatcgacgaaggggatgacctttatcactaagccagtttgacatggccaagcggcggccgagagatggattatgttgcctactttgccaagtgaaaaagacaataatcgccatctttggtcaatggttcaatcacatacttttttgtagtaattgtgtgctttttcttttttgaaatttagttcattcctatgaaatagggaaaagaatatttccaaatagaaaaataaaaaaggtgttacatgtcttagtatatatataggtctttacctcgtctcagtcgcacctaattcttagctaggggcccatccttataggtcagtggtgcaattttggacatttgtcgcctatttttagggctaataaggaaagaaacaccaaaaaaacttattttggcctatattgagatgg

SEQ ID NO: 30446 - DNA, 2227 bp, Oryza sativa
cgcgagcactgaattttgcacatagtaactaattgaaatcagtaatcctcctgctgcattttctttcttataaatatgtcttattagttgtaactagtagagtcaaatgaatactaccaatgatttaggagacttcctcgagggactaaaatattggatcctcgattaattgatcccttctttctcctcacttcataaaagtgaatcagtttcattggcgagagggggttataaatcaactgatggattactttactaacattattacaaacaaaaggaataaatcgaaggattgtgaccatcagagcaaaggctttctctttgttatttttacaaatcaaaataggaaacccatttgtaggttatggaatagataaaaaaagtcgggttataagagtaaaaattccacaggtcctttatgctctaatcagataaaggggggtaacaactgcaaacataatgggggtaatatgtatgtaaaaaagggctatagataactacaatgtgtattattggaacaagtcagtgttacctttttttttgttgaaaccatgcatgcacatggaaggaaatatcaagatgtacaatcaaacatgaagagaaagaagaagatcttagtataggtggtgccatattaacctaggatagtaatgcaccaggattttatgcattagatggacttactattatcgcatactctttattggtttcattaaatccaccattaaatatatttctgtagtatatttgttttgtgttggaaacactactacattgtttggtcaaactgaaaatatgtatattcaagtttgattagaacaaaccaaaaatgtcttatataattgaacatagggagtacatcaagatcgatgcagtgcatccagcgaacatttgttctgtacctggttttggtgccaaagcatatctaaacctgtaatgcccctaaataactttgctagctaatttacatgtaaagaacaaaactgtattttcagtcagggaagaaaagacattccggtgtttgcaggaaatttcctcctttgcatctcttcctttattaagatagactacattatcaactaaaaacctggattttttttttacttgtagatgaagctctcgggattacaaataaagtagaaatttggcccagaaacacccgtgatcatccaaagaatatatcgatttcattgaatatgtgccagctttcacaaattatatatcatgcaattttaccatcattctcatcaagtgtaataggaggacctttttataatagtcctatcagtctcaaactataaagcatattagttttcttacactgtctacaatattatattttaacaattagtttcttcaataatatattatcaagaactagaaaattacatcatacaagagtgctttcaaatatgaatcttaggatatgaaatggatggcattaaacatatacagtatattgttagtttgttatttgtcaaaacctacatatgttggttttgctaaaactatatatggccaccttatattttaggacaaatggagtatcaaacagtgtgacatttgtaacctactcaagaatggtctgctcaaaagggatagaacactaacagggctaactttagaggcatgcctaggggaggggtgcctcctgtcgaggcgtcatgtaaaaattggttatagtaaatgtacattttctcctattaaaagtttatatattgatcctaccaagtccttaaaaaactcataaagatgggctttcggctttcgtcaatccagtatcatcagttacccacatctagagttcaaaataaaatctagctctctaatagaatgtacagtaccactctttgaccattgcatatctcaacagattgtaataccaccttaggccaggatcatgcaaaaatatagtattagtacccactttagttttctgaaaatattgcggagatgtctgatttgtaacacataaccttccaaaatggggaataatcttttttaggctagctgcacaaacccaatgggcatttgatataaaagggtgcaatttccaccaacatttacatcaaagactcaagttttctgaaatctttgacacccgcagattttagtctatctcataattcaatgacatttgttcgtggtatctagaagaataggaggtatgatccatccaagtgaaatgtaatacaatgggaggaattaatcaaagcagccctccctt

SEQ ID NO: 30447 - DNA, 55660 bp, Oryza sativa
  unsure (1)..(55660): unsure at all n locations
cccaaatagacatactactccctttccaaatgtcagtgaaaataaggcataggattgaaaatgaattctttttttaaaaaaaaaatctcccttttaggtatgttctaacttctaagtaatctatgatctctactattatttagtattctccataatgttgtgttattttttagaactccatattgttgtgttgagttgaaataaggaacaaacaactctaaagagcatttttttttcataactggagtggataaaggtgttactggtacagaaagggcaatccttgcccactgatctctatcggttcggtgtgagccaacagggattgccaatctttaccagttcatggcgttggagtgaattttcccgcctaaacagccatgaaccggcagtgatgctcaacttctttcaaaagggcagggcgtcactggctgaacaactatggtgccgatggggggaggagggggtatgatttagagtaggataggtaatacaggtgtgaggggaggtttgacatgagtttctgattttatttttcatggatccaaacaaagggcttcacacattataaagaataaaccacatattcatgtattccagcaaagagctttaaataaaagctcatccaacatgtcgattaagaaaatataattatttaaacaactctggagattgcataacatttagcttgcttcaaacataatgtaacattaagtacacaccactattgtagaaggtaccacaatactatttgataggcatcattccagtgcaaataataattagaatggtgccatcaaatctaggaaggccttgacgtcattagcaacgtttttggcgtcatgagcaataccagataatcctctcctcgcaaacccaacacagtagagtccatttgaacctttccagtgatttgggaagtccttcttgggcatgccttctttgttcatcatatcctcaccattctgcgtttttaatcataattattttattaacaaatatttccacagaaagaaagaaagttaaatatgaagatagcaccattgtcttctaattataactataattttataacaggttttatcactaattttgttgagtcaatcacgcaaatgcttttctttctaaatctgtctaatagtattgtaggcactcttaatttgatgccccacttgaggtatgcaggagagagaaaataacaactaaatctaattgcaataatttttgtatttactatttaccatatgagcaacatattacataccttaagccagttgtttgcagtacttgtgtagcctgtagcaaaaacaatagcatcaaagtaactttctttcccatcatcaaattcaacaacatttcccttgatgcaagatattgtaccaaagacctacatgccacataaattccttatagaacctgtcaagtaccaaatagaatttatatagacttttctatgttgtgtcaagaattttgttaccatgatatcacctttctttattatctccacagtgccaacatatataactgctgaccgaccagtattggccttaagaagcaatggccccttattgggcctcacgatgccatactttgagagattgccaaaccagagatatgcaaggaccacaagaataaaatcaacaaatttcactgggaggctccagcttgcaagtttcatccccatgtgaatcagctcctttgtcatcacatgcagctttagaataattcaagaatttgtggtgtaagaaaatgatttaataggatacttacaataacttgacctggaaaacagggaggcaaaataaagaaaggaaacttttatgcaaatgtattatttacttacagggctgcggatgactatggaggtatttgctccatggcttgaaagatcataggcaatctccatgcctgagtttccacatccaacaacaagcaccctttgcgcagcataggaatctgctgacctaaagcttgatgagtgtatgacatggccagagaaatcctctagtccagggatgctaggaatgttccctgcactattttcaccacttgctacaactaagaacctagctgcatacttggacaccatgccattcacttggtcatgtgttgtgacaacccaatatttttgcacatcatcatacaaacatgactcaacagatgagttaaatttgggacaaatgttgaaatgctccacataatcatccatatacctcaaaaattgaatcttggggatgtaggttggtgtgtcttccggatatggcatgtggggcatctcgcagaactcctttgcgaggtgaagcttgaggcgatcatatgtgtgcttacgccacagcgacgcggtacaatcctcacgctcgataataacatagggtatagagagctggccaaggcacgccgctgttgcaagaccagatgggcctgctccaacaatcagaactagagccttctccatgagaaaataaaaggaaagggaaggaagtgaaactaatgttgggacactattctgtatatgttgttttttctcttggtgagatgtataaattctcggagagcacatgctatttatacggaaatttgtccgttactattgactgtaatgcatatccctcttacatgtattttggacagattcacttcacatgtattaagtacattatttatgctaccggccaagatagaatgacacatatgtagacaaaagtacaaggtttcttatttaatatgtcctctcaattaaagagcatatacaaatgatttttttctacattaacatgatcattaagtggtacttgtatatttaattattgattaattcatactttaaaatacttatcttgtatataatacttatcttatatgtcatgattattgggaagtgttgaatacgacataaaagggggggcattgtgttgtgagtttcccaaaaaaaaaatccaaataccttttacaatgactggaagagcctctgtttgcttttttcagataaaaccaactttattatgcatggatgccttgtttgaggaacatgtctctttataagtactttcggtgggagatttgttttatttatcttcagttactaccacattagctagcaaatagagcacgtataccaattggattctactaggttcttgtctaaagtgcataaagtgttgtaatatggcatgaagctgtttgaaaagttcaacttattgtatgcagtggacacgaatccaaagcatttcactactgaaatgtggtaaactgtgaatttggtttgcattttccccatctcaataacagtatcctcaaaatcttaatttatatatgtatccattttaaatatatatggtagtgaacatatatggttttagcaatcttaacattatatcaacttattactctacaagcatcactactggaatctagaattttcttggtggcccgttagtttttttggcggccaaatcccgacaactaaaagtgcttgttacctttgcggttatccgccaacaaaatgcaaaatggactttccctcgctctctagacttggcaggtattccttttcggttagccgacaaaacatattaatttggtggttttgatactatccttaacggtctatacatgtctctcaagaaaattatggaatatggtaaggcatacacatttgaactccgtagattttctattagttctaaatttaattaattagtaatactatcaataaataaataaaaataaacaatattaaacaaagtcttgaatatgtatcctttaattattttaatgtattagtaccattgattatttgtagtttcatgtgaatgtatgagctattatttactacgaattgatgcactaattagttataactccatgcatgcttggtgattttaatccgacctaatttaatgagatgacgtactacttgtaatgcaaaacatgtttgtgtatgttgttctaattattgtatcatctgcctactgcacaaaaacagaaaatctttatcttaacaactaaatgtataaaaacgcatggtgagttgtgataacatattgcttcatttttttaggcaatattagaaaagtggagggggtaggaactagataatacgcacactgtcctgcttttgtttttgcaataccttgtttttctaaatattatgtgcaattcttgaactaattgataggacatacactaccttctactaggacaatagattgctccaagtgagagctagattcctttccatttttaagtatattgtcaaacatgtaacttgggagctcttagtcatcatactttcgtgaaagatacatgtttgacaatatactaacacattccccagaagttaaagaggaaactgaacttaattttttgagaaaacttgctttgggcctggaattaactattaataaattaagttagaaacttttggagatgaaaattagaaaccgaagcttggccccacatgttagttagatgaaatcaaccatgtctggatacgtactgcttaattaagagtgacgatgcatgttgatcatatttgttgtgaaatgataatgcacttaagttggaagttttgcagatcgagtcatttaattttgtcaatatgtgtacaggtgtatggttagctatcaattataaactgaaacggaagccaatacctagggatgtttgtgtgaaaagtaaaatgtttgctagtaaggcttttgcttgtttgtttgttccttctttattcctacatatcttcaactaataacaacccgtttttccttagatacattctttatgaatatactattcaagagcgtgccataataatggaagataggactgagcttgtgtttgcgtaaagcatacgtgtataagacagtattaatggtgtgatttttttggggtatgccaactaagacaaattcatcgttttctttaaaagaagcatgttcaactttttcatgtgattacatgtgttctttctctaaattaaccctgcactgtgggccatgaaccctaggaataagtcccctttgaatcccttaatcaaattaatataggtccaacctgattcatatccgaaactacatcaccggatgttttaaccactaactattaaaattgatataatttgactccctcgatggttttaagagcggttttaattggcatggcacatcgactttggttcacctatgctggcatatagcaacccagatacaaaacaaaaatggaccccacgtataattgacaagaaaaaaatataaaaattgtggggcctacttgtcatacgccttctcccctctctatattttccctaaccaccctgatctcgttggcttcttgctgccaccttgctgggtcccaagcttgcctgccactgccgccttgcctaggtcctccgagctcacctttggtctaccaagatactccggcctgtagctctatgatgtatccgaacatggagggatacaacggacagacagggctatcaccacctgccgctaaccacacttttcgtggagaacaaaacaaacgaaggcaaccgctaacctaggcaacacgcctaagttattgattactactctagcctcgcgtaagaacttcattcttcatccagagtcctagtaccagaacacttaatataaatactaaacgacaaacccacaacgataagaatatatctcacttaaataagctaattaaataacaaaggaaatcttgaacacttactttattgaagaagcattctccgaggtacaagagaggatagagcaccgacaactcgggcactcctccggacttcccctcactctctactcattttctccatactactaaagtgacacccaatgtatgaaagtgagatgtactctactttgttgtgtgctataaagtggcttgagctcctccttttataaccgttaatgatggttgtatgcggtttgggaggtcagtgcgctagcaactgccattagagagttatcaaggatgaccatatggaaggccaggatgagaggtggtgatggtggtttggtcgaccccctaggttggccgacccatgggccccacctatcagctactccttttgctaggaggctgactggtgagcccctatgcgggtgcaccatggataggcttatttttagtcggttttgactcatgcgggcccttcaattcttgtgctcgcgtacgattggctagaggtacatttcgtcgcatggcgggtgtagattcattcaaaattacctgtatacaaatatttaccaatactcgtaaaaacggttagtaataaacctctaccattaagtttgatattacattttgtttcttttatgcaggagttgacagttaaatagtgcttaatgtccgtcaactgagaggcggaagcagactcctacttgggttgttcacttgttggtggagaacaactcgtggtggcagtaggggggtggtcattcacgagctcgccattgtccatccgccgtggaaggaattgcccctttctttgccggccagcttgaggttgtcatggatttcgtcgagggcgggggattaaatccggtgaggtgggcaagagcccggcccaggcacaccccttcatccttcctcctgtcagcctctccacgccactgccacacaatggagaggggagaaagagagagaaaagagacaagaaggaaagaggaagggcaatgacatgtgggcccgaatgttgactcacccagttaaactagtcagcaagtcatgtcaacgaaaaccactctcaaaatcgctaaaagagttaaattacactaatttaaatagttggaggtaaagacatctagtattgcaatcgaggatataaacattgaacttgctcctgcctaagaatgcatccgggggcaatgagccccacattgggccatggctcgatccagtccagtgctttggcccaacacatcaacgttacatcacgggctttaacgttacatttgttggtggactgcaattttctttctcagctttaattctaccatgaatttgaatgttaagttcctcacagtggaacctgttcatcaatgtaaactaggtcaaggtcaacgtgcaatttaaatatgagtttgaatgttaagttcttatagtgaaacttgtttatctaaatttcaatctttaattcgacacgaatattcgtatttatagttagttatctttttagtggtaagcgatatgacagttgatagcgtgagtcgtttatggtagtttcgtccatatccaatccagtctcatggatgtgtttataagggtatgttattcgtgcgtgcattcattgaaactatatcgttcataaaagttagggtgtacgtgtgtgcagttatgagtgtttgaatataacaattaagaaaatgaaccaataacctaaaaaaacaaacatgcgattggattaaatatgtttagattcgttgtaatagaatatgtcacattcagtattaggttgatttttaatgaggcagcgagtatataatatcgtttggaacgcatgcagtcagtaataattaatttctgagaaaacgacaggtcattttacttatttcctccgaattaagcctcacatttttgtgcagcctctcaagccttatcctcgtctcgcctcgtgctctccacgacacctccgcgcgcgcgccaacgtacttggcgcgcatgtgacccgcgcgaacgcacgcgcctcgtcgtcgtcgtctcgtcccatgcaaccgcccgtgacgccggcgagctcggccgccggcgcgcccccgcccccaccaccacccaccaccacctgttccacctcctgccgcttcgtcttgcccccgacgaggaggcatctgctcgcgtcgtccgcctcctccctgctcctcgccgccgccgccgccgccgcggcgccccgcgcggcgagcagcgaggacgacgacgccgtcaccagctacgacccggtgacagcggcggagcgcgcggcgagcgcgtcggtgtcgcggcgcgtcggggaggcggtgcggctgctggacctggggcgcgacctgcaggcgcgcggcgagttcccggcggcgctggcgtcgttcacggcggtggcgacggagtacggggacctgtcgctgtcggggtacgcccgcgtggggcgggcgctggtgctgtacgaggtgggcgaccgcgacgacgccatcggggagatggaggacgcgtcggtggcgctgcggggttacccggagatccacgcggcgctggcggcggcgctttacgccgacaagcacgcggcgctgctcgccgagaaccagttcgccatcgccacgctgctggacccgcactacacccgacctcgcctacgtcagggacaccaagcactggccccccagcctcgtcgactcgctccgccacttcatcaccctctcctgatcattgcttgatcaattgagctttgatttgattaattaatcaagctatagctgttcgtaatccacaccacaatttgatggactcttatcgtatggttttggggttcatctaaattatgtatctatacgtgaaattgttcatgtctgaacgatttttgaacattggatagtgggtatgtataatgggcaggaaatgaattactagagaggagaatcaaagagttttggtgtttggttataactttgtgaatgtataatgggctctcatgatctagcttgattgcttgattaatcaagctaactgttcataatccacaccacaattcgatggactcgtaatctcgtatggttgatggttttggggtccatctaattctgtatctatacacacatggtgaaagtgaaattgttcatgtcttgaacgatttttgaaacttggatatatatagtgagtatatgtataatgggcaggaaatgaattattagagaggaatcaaagagttttggtatttggttttattactttgttagtagaagtattatttaactttttttatatcgatgcgcttgtttgtattgtttttccatttttaaaccgatatttgtaagggagttaacaaacagaactggctcgactgttgaaacaaattaactgtggcaaatgcaacagttgagctagtacgtgcttctagacagtcgatacttagttttctttaatttgcagccagttagttaattttcttggcggccgcatataatcctgatcatcaaaattactcgttgttttacggttatccgtcaataaaataggcttcttcttgctatctagacttggcgtgtatatatttcttatcgtttggctgacaaaacatattaatttggcagttctgatgctattcctgacggtatatgcctctcaagaaaattgtcactacaacaaacatgtcttgtaaaggcattttcctaatacaggcatttttaaaatgcctttacatcattgtagagacattttgaataatgtctcataattgtcttttggtgaattgtattcactcttgagttgatcatttttatcttcaatacactaacaacctcaacctcacataattactttaaatatgtgtttcatgttacttgtatctagttacttttatatctagttacttagtatgtattaatattcggaaaagtgtctctaggtttaaatgtctaaaaaaatgcctttacatataaagcaaattttaaagtttcgaaaagatgtctatacaagataaattcagcaaaatatgctaaaagtgtctttagagtaaaagtattttaggtgattttgaaagtgcctctaaaagtgtctctagactatagaaatcgcctctacacaagggttttttcgagtgtctagaaatgataaaatagttaaaataataataataaggtaataaaggctaagccattaatccataaaataatttcgtgagcaccaaacaatgtgtttcttccttgttgggctgatcgaaattcttttaattaatagatcgattgtgcttcaggaaggcagtggtgcaattaatggcggagtcgtgggtatgtgatttcacccatcggagtttaaatcaagatgccaacaaatatttttgcatatgtgcttatgctatatatcaaataggaatttcgtgaggttgaagatttgccgttatcctccttccgtctgagcatgtgctggaggacgtatttgatacgtacatagtgattgtgtactacatgtttatctttcgtgtaatcggggaaaaaattggttctacttacttgtagccatcattctctgttcggtggtctggatggccctagtgagcttcgtatgagtcattctggattaggctagcttaattagataaaatcataaaggaatgcaaatgatctttttggttgtttgtgtgcaataaatatggacaacacgtgtaatcgatagtgtttgcttggatcatggatggatagcgagagtgaagctcctatgagtcattttggatgaaggaagctagcctagataaaggtgcagatgttgcctctatggatggagccagtataacatgactcatgagctggtgtttggttaattagttgcatgaaaagcatgatggagttgtatttactgaagatgagagattattttggtcgattttggtaggtcacatgaaccctgagtcagcaagcccccaaggcccaccgcagcacaatccacccaccggatttcagattaaagttcactctagttccctcatcatctaagagttagtttcgactttataacgtattcccatctttcgaaaccagtgtaaatatagtcccaaaacaatttagatgatgatttcagctaacatgacaccgacacggcatgttgacttgggctctgtttacaagacatggtgtaggatcgaacacaagtaaccaagcctaccagaggggggtgaatggtagggaaaaccaaaaacccaaaaacttttagcggaaataaaagttaccctcaaatcgatggaaatctcgacgtagtcctgtcgccgccggtcggatcacctccctaccgcctgaacctggagaaacacaaatcgaagaactctcaaagtagatgacaactttattgcttctctctgtgtttacaaagtgcaacaacagcactccttacaaaaatctcgactaaactcgaaaccctaactaaactatcaactccacgctctgaaaaacgatacaggaaacctcacactccctctctatttataaaaaaaaaactcctacttaaaataagtgtagaactgctattttcaacaggactcaatccaaaatttccaaaacacacagccgcaacctacccgtgcgcctgccatttcctgctcggggtcggacatgccatccaaccgagccgctgctgctcctcccagtccaagtcacggacatgcatacaccatgcacacatgcatgctatctgcacacatgtacatcacgtacatgcaaactacacgctaagtacatcgagtatagcaaccatgtactccaccgtacatgaacatctctatcttctctcattcctcctcgcgaacacccacgcttgcacgcacatctcgtgaagcccgttgcgaagatctctctcacatggtgtccatccaccgtataccatctcgtatccaacttcgtcacccggtatccttgaccgtctggatctcaactcctccctaagtcttgtcccgatccccaccgttgaccgaagttgacctccaagaattctgactctagtcaccttctcacatggtatcccgaccgcactagacctctgttcctccctgaacatagtcccggtcctcaccattgaccaaggctgacctcaagtcatctgcacacaatcagacaaaaaaaccgtttctgggcacagatatcacaacctgacccacattagtcacacgcactcacaccaacatccacacatcttttcaaaccaattcattgataaaatcatttgcacagccaattgttcatcacaaatattaatcatgacaatgatttcacacatggttcccaactccctactctcgcttttcgcatgcacgcttttcaaactcataaacggtatgttttttttcaaaaagtttctatacaaaagttgcttaaaaaaaccatattgatcctttttgaaaaaaaacgcaaatacttaattaatcatatgttaatgaaccgctcagttttccgtgtttactatttgggttggaaacatattcatgcgaacacacccttgatcttcatctcatgtggtatagtgggacctacatgtcactcaaaagggggaaaaaccatgaatccacatgtcaccgacatgggaaaagaataaatttagacggtggtttcaactaacgtgacactgtcgtagcatgttgacttggtcttcatctcacgtggtggcacttacataacataacaatcaaaaaataaataaatatagtggaacccacgtgtcactcataaggaaaaaataaaaaccatgaagcccacatgtgtcatcctttctttctttctttcctcgctatcctctcttcctcatcctcttatctagttggagcaaacatagcgattgaagcgctcggccttcgcctctaggatggccaaatcgcgctgggagaggacacctggggcagctagcgtctatattaggtagcacaccacggcgtcgcgggtgcgttgcaacggcggtcgtatgctgagcaacaagaggagcacttccgtagctccgcggccttggcggctggtttcgcaggagcggcgccacttccctctgcagccgccggagtcagagagatagagagagttgtgccatggagtcaggagacttggagggtggggtttgatttggtttgcttctaaaagatttcctaaaggggaacgaacatgcatttcatcatgggcttacatccaccgcatggacccgctgctgccccatggttaacctcgagctagagacaaggagcctccttgtagggatgcagctcggggataacttgtagtggatggcacttgtctcactgatttggaaggatgggaagctcggcgtcgaggtgcgccattctataggaggtggtggggagggtttcgtgctcctagcctcaccttcctctcgacctccggcctctagaccttccttccacgtcttggcagccctcgtcttggcggaggatggctctaaggagaggaccgaggagacgagtgagctctctcagccaaattggtgggtttcccatcatcggccttcgcctcctcctgcgatctcccccgcagtcgagcttatgctattgttgcttcaccgccgctgcctcctcttgtcaccccacgccacagcgatggtctaggaagcgagaaggccatgtgagaagctcctcgcttgccacccactgctggtcgccacgcttccgccttcccatcgatgagctggcgagctcgaccttgccggcctccaccgctaatgtttgtgcacacagaaaaaggagagaggaggtagggaaggaagaaatgatggtatgtttcactaacacgtgcagctcactgtaattttctttttctaattgatgtgccacgtaaacgccacatcagctaaacccaggctccatgctgccctgggatctcgttgacactcgtattagaacgtgaggatacgttgtaccaggttttgagattaagggacccgcttgaaactgactctaagatgagggacatgaactgaacttcttgttcctggactaattaaaatctgctcgagggagcccatcatggccagaaaacaattagctcctcggcccacgtgggacacacggcccaagtcgcgggcgataccttccctcccccttcccgccgccgctgtcccttgctcccacctccgctcctcgccgccgccgccgagagtagtagtgcgggtctcgcgctgccgcttggcttggctcccatggacgcggcggcgccggaagcgacgggtggcttctgcggaggcggcggcggcctctccaccggccggaagctggtgccgtggtcgagctgggcggagtggcggcacgtgcgcgacggcctcttttacgcctcccccgccgccgctcttcgtagggtaacgctcttcttcccccatcccccacgccgcaaaatcccccaaaaaatttcagcaaacggagtgtgatttgtgactgtctcgcttgtttttttttcttttttttggttcagatcgcggcgtggaggagcagaggcaccctcccggtccccgtcgatgtgaccgcggctttcgtcgagatacggctgcgggatcccttcttccggtaatgttattattatgtttgattggtgcaaagttctttacccttgtgggttttgtggctgtgggagttggggatggtgtgtttgtattgtaaggtgatgatggagtgatggttttgtttcctataggagtgtaatggctgtggatgatgcgctggagtcggaagagatgctgtcgatgctgtatagtatggcgatcatgaggcgagtgcattcctaccgcgatctgcgcttttgtgatgtatggggaagaactctcaaattggaaattgtaatgtgtcaaattgtttcgtagcattgttatgctgctgaaggaaagactactattgtgtgggtgggtttcaaatgttgcatggaacaacttattttgtgcaaggaagccgactttttaagttacagtggtttccgcaatagcatattgcatggtttaggagattgctaagcaattaatagtgcacctatggataatatagaattagagcttaacagtacttaaggtggcaatatggcaatgagaaaagtgagtctttttatagcacagctgaattgttgatcgtactagttcaaagctcctttttgttggtttatctttataatgtatcctattttcagttgttacttaagttggtttttttatgaaagagaataaccatagaattttctacttccaggctcgtaaatggttttgtggagaacccacataagaaaactggctattcaatatctgaattagctgaggctgttggaataccacgagttcttgtcgacattcgtcatggttagaagattttgtttgttgcatcaacctttgaagtggccctgttgcagtcgagctaataaaattatctgtcccttgtagagagttcacatcgcactcttccctctcttcggctgctacgattggcagccattaaggtataatttgttggttaatgtttagaaggactcttaattgctagttattttaatcctgctgagtgttgggttttggttattaggaatacttttcagtgttatttgtaagttttgtttactgtatcttgcctcaccaattgagattattttcaggcatttgattggttgaagtgtatttactgggattcccagactaatgctattcctgatgttcaagttgaagtaaggtcaaaattgcatgagatcaataactttatgaagggaaaagattcaatgaaagcaaagtcgggttcaaaaaggaaacgtgagtatcatcagcttatagtctgaaattgtgattcagttagatctgggtcttgtctgtttcttcaggacctatatagccaaatataggtttccctacttggggttgcattaagatttctctgcaggcaatgagaaatcggtcttttcatgccatgtctctgaaaacctcctgattagcattcagaattttctggtcggccttatgtttgaatattaaagttacaacttgtacatgacttttatcagccttttctgttcttggtaggttttgtttttcacacttcgctagttctcttaggcaaattaggaagtttgtgccttacatttttctaacaaatttaactgcaaataggcaaatctgttcccaattgtgtgatttagctatcacttaatgttacacttgatggtacgacaaaatcttggtcacatgtaatgtgatgcccaattcaagcttgttggagtacaatgttaccgtcattttattctgtatttgtgttggtttcatttacttatagttgcttcggttttgcatgttagaatgtcatgcttctttttatcgttgtactgagaaaaacttaggattatacttgataatgtggtcatacagctcatgaaattcttctgttgcatgtctcttttattaatcctaactgcactagtgcagaattattgaacatactatagaggattacaggtgtaactacaagcatcatcattgtttgttaccattcagtatctgatgtatgaacattattgaattagtttggttgctaccatttgacactgacatgataataaattatgacttagcattcatttcagatggataaagttatatgataattataatcatcttcatgaccctgtattgcaggttctgagaaaatgatttcgagaaacataaaatatgtacgccggctttactacgcatgtccttctgaggttgcctttgttatattggactttttccaacgtggtgccccagagtcctctgaaaatagcgatgtgttagaaactgataaggatgtagatcagtcatctgatattcacagtgaaatatcaaataatgatatgagaactatcataactaaattatcagaaaaggaaccaaggttgctgcttggcatactgaagtcagtaattgaaacaattgagaccatggaagaccttgaaaacaaaggtactgttcttaaggctagatgttatgttttcaaaggtactgaagtcagttcacttcatgcactgtttccaaagccataatccggccatggaaagattattgtttttttttattatttcactgttgttacttgatgctagcatttcattcctggctcgttttagagttgtattagcactactccagtatgaatctgcccttactgttttttgttatatttataggtgaatacaatgctagcctgccagctaaagtggaacttttaagttcccatgttctgtggcttgtgacaaagttaaaagaattgaaggattcaggttgcattggagttgtccatgagataggagtgctctcttcagacaggaatgcagtcccacgtttctgtctagcaaaacttctgcggaagctgttgagtttgtctattatagatgaaagatgtatcatagatgcagccctagtgctgattgagatggccaccaacaatgtgcaggagaaactgaggaagcttcctatgttatccctgggaaaggtggctagagattctaccctcccagagcccaccaaagaaacggaatcagttgaggaagcaacagagaagctggaaatgttcaagtcgcggttgaaacagaaggatttacgtttggcagaaaatgacaccggggcttcattgaacacaatcatgccagagaaacgtaacagatggtctacagcaaagtcttggaccccctgtccaataggaatgataccttgttcatttagttcagtggctgttcttccgacccttgacgtcgtagatcatgaatcaagagatgaaatattagagcaacatgtaagtgttgagcctgatgatcatactgagaggatcggctattattctgacccagagaagcaattggatgctgaaagaattccggaattatcaagaccatcacctgaagaatgtgagatttcagatatgccagaactggcatttcctctgaagggtaggttgctagttggtggggtgtggaagatggtgagcgaagaggagctactctttatcaagtcaaagatgaaaattttgttgtaacaacagctagttcagttttgtcatcttaaatcaacaatttcaggctgtaaaacgaacaagggtagtactgtgctagttaagagaaaaatgtatcgtttaccccccagttttgcttagcctcttctgttgaaaattgagataaagcagcagctttattagttccggcaggcagccattgctgctacctgctgatagatatattcagttctacacttctagtcatgtagtttcagttgcagctagtctgatactaaatttcccaatcgatgtatgccaaaatgccaatccaattcaactctgtttttcagatgataattatattgtaacatggccacttcatataaattaacaatttactcgcagctgtaaaggaacaaagaataggtgtgtacagtgtacgtcaagaaaagaatataaaaactaaattaacatcaatgacgcaaaagaaccccccacgacaaggtaaaacaagcaaacagatcagggaagatgtgtagttattaacaatgttcatcacattagatccagtgctcaacagcacaaacaatacaaacagtttcacagtttctctgcttaatatttgcagagtctgaatatcagagcagcagggaagggaggagcaagtagcatgcaggttcagacacaagactccaggcagttcgattacattgatccttataaaagaccagcaaccataactatgacgaagctaggcgaccagcgggtgaagactgaagaagactgatgagaagacgaaggcggcacagcgctttaccaggccgacaacctgttctaccgtctcactgaaggacgaggcagccttccgcgacagcaggaggggcaatggagacaggcgtgtaggtggcgtcctcgtcttcgctgacttcctcctcgtcggactgaaccagaccagcggcatcaaagatgtaggccttcacttcctcgaagcgttcctccgacagggaaacctcagcgaggagtctccacgcagaagcttctgatgcctcctcgtaatcactccttcgtttcagcacgatgtggccactgatctcccacacagctgggttaacctgcgtgtccagtagctcctggctcacttctcccagagcctgcttctcggcatagcactgtatttcggaaacagatgaagcttagaaagaaatcacaaacatttcacacaattgttgatagcatgctaaaactcatacaccatagttttttttgttaggaacaagtaaaagtttactagagcgaccttatacagatcagctaggtgacaacaagtctgagatatcaatgttagtggatagaactaagtaaatgcatgggcatatacagttcagtcaatattgaggttatatgcatgtatcattttacctgagggaagaggaagatctttttgccgcagtcagagataagaacattgtaaggcacattgttgtcctgcagccagatacaagcgctggaaaccacattggccagatcgctcagtgagttgcctccctcaaaaaccagtcccctcacagggtagttcatcagcttggacacctttactccactattcattgtgccctcagcaaggaaaatcctcttggtagctgccttctcaacagggaaaggcactgtcaagtagtatgcctgtggataaaagaagcaggtaatgatttagtatacaattgtaaacacaacactataacatacactcgtacaggtagctttatcagctaattgttcagatcaaatgcacacataatgggaacgctgtttttcactaaagaaaatatgactcctctagatgtatctgtatgggcattgggacaagggaaccaggagttttaacaagatcgacatttacatcaaagtaaattaatctagcaaccatacaaacaataagtctatttttggtttggtctgcagatacgcaaagttcagtgtcactgtaacaactgaaaatacatgtacccatataaaacacagttcgtgcaattttgcatgctggaagatttatgatttatctaacagctacaagtagatacaacagtaaacaaattccaaaaccatgtgaagagtacctgaaagtggaggtggttgatggttgcaaaggcacccaaactattatagccaagcctgaagtatgggcttgcggcttcagcagccatgtgcagtgcaagcaagaagctctcctggtcaatcctctgaggcaggcggtccagtacacggggaatgagaagaacatggccatattcaattgggcttacctgcagagtgtcaaatagaaatgttaacaccaagaatacataaatatcagaattaaaatagattaccagtgcgaatgtagcctacattgattgcaacaacattaggagcacgatcagcaacactgattggggagctctccacaaagaagctgtcatcaccaccaccattctcaaattggaagagcacctcctcctggccaactttggtgaagttgaacttggcagcatcaaatggttgaagcacacggtccacgcggaattcagtagggcgcttcttgaggtggcgtccttcattcagttgtgcaacaaacccaaggttgcctgggataaccttggtctcacaggcagtgacatcatatcggaacaaacctcgggccatcctgtcttcccactgcaataaacaaacaaaatttgaacttcagtattcttacataagcatcgtaacatggttacacagatgcctattataaacacaggacagattatatcataaaacaaacggagggattagttatttgttacttgcataatcagcaataccatctcgcaaataatgctgtctggtgtatatttggctagtaataacttcatgcatatattatttctattgcatggaaaacatagtaagagcatgcaaaagcaacaaaaagagaatatacactcaaacatgaatgctggatgctcaaaattgaagaacatttctttaatgcgtgcatgggtgctcatcataacttccatgcaggttatacgtcataaatatacgcaattgttacttcttgacaatatttttccacaacttaactagtaggttgataatcacaaaatataacgtctcacatcttagctcgcatgtaggaggaaacgagtcagaatcggtaagcatttccagtggatatatagggagcataacgatcttttggatccaattacagagtatccgatacttgcccatttgaaatttgaaacaaacacatgtaacaggcttggaccaaactggtgatgacccaaaactgcacaaccgaacgctactataatacatagggcaaatatcttatctaattgcctcagtagctctccagagagctaacaagatttcgtagttgtgcgcaatacagaacaaatacttgaacttctcctgtgcgaaatttaaagtgtaagcttctatttagtatttaccaggccgagcaggagattgacaaagaactcatcgttggaagcatcctcctgcgaagacggctttttcggactcgccttgaaagcatacagcggaagcttggaatctgctcaaggaaatgcaagaaaaaaaatgttaattcacttaaaaacaagtggtagtaagcctatccacacattttttttttgtggtgcctatattccctataagattttgaagcatctaagtaaaataatatgtggctcctatttttatcctaccaagttggaggaaaccaaactacaagtggtgaacccaaaaacattcccagtaggccagtaacaatattttaaccgcaggggttaaaaatagcaaaggtaaagcatccttcctactagtggtgacaggatcctccaactttcttggaagttgcaaagatgttcttattcttcttttttttttaatttgcgacgaaagatgaatttaatattcaagttatacccaacaaaaataagcacaaccatttttctaatcaaacgaatcaagaaaatcatcacagaagaaaactgtaaccaggatttcggaatccaaggtgtaataataagacaataaaataatctaagagtttttttaatcctgatttgggaggaagagactcaccgggcaagcagcaatccccgaggcaatccctcccgcagccggcgcgggggcgttcgccggcggtggcggcagcatcctcctggtagttggaaaccacggtgggcacccgcttgatggtcagcttcatctccatgattaaatctcaattccttcctctctctcggggtcagggtcaggtcagcgaaagatttttgttgattggatgttagagaaggtggatggggggggcgagcggtctcagaggcgaccgccgccggcgaggaagaggaggtcagaggggctgccgccggccgagggaagcgccccgcggccgccgtgcggggctgggctggacgccgtcgccggagaagcgatggctcccccactgggcgtgggcggcgcagctgcgtggccgcgcccgaccgcttcaacgctagccgtctttgccgcctttcaactcgcccgtctagggatgagagccctcctcacgatcacaacccactcccccccacctctcgtcggcggcggaatctcccctcttcctcttcctcttctcagtcggcggcggcggcgacggtggtggtggtggtaggcgaggaggggagagggtggaggaggcaataaataggcgagaaaaaaaaagaaaaaagaatttgcggcttttgtgtggtttgtgatgtgtggtggatctcgtgttgggattatctgtggacagactagctttactgtgtgtgtgttctgtgttgtgatgagttttgcttctgctattttagggtgggggtttgtgtacgaatttgtgcacgttgggggcatatggttgtggttgtgactgttgttgtttattactctcttcgtcccataatataatggattttaggtttttgcttacaaacgtttgatcactcgtcttatttaaaaaattttaaaattattaattattttatttgtgacttactttattatatacagtactttaagcacaacttttcgctttttatatttgcaaaaaaatttgaataagacgagtggtgaaacgttacaagcaaaaacttaagcacgtgctggggttggttactgtgcttgattcggcagctgtacccgttgatagtgagatttagtactaagaagtattaattgtgtttgtgtagctaggtcttaggtctatgcgcatgtataagagcaagtttaatagtatagcccactactagctccaaataatctatagccaatgtaatagccaattcatacaatagttgcttactatactattaatacctggtcccacctgtcatacacacattacgtcttggagtccgtgctgcagctggctatagatctgtagcccgctgctcttctctctcttcctttatttctttaaaatatgtttatagctggcttatagcctgctattgtacctgctctaatataccaatgctaaattttgagccacggtttaggagatttctgttatagaaatactaaaatgattgggctattcatataatatgttatttacgttttaaatgctacatgtatgtgcgaaggttcaaaccaaattagattcgtacgtcccattgcatgtaatcttggtttggttgtattccttgtagtacatggaacgttttatgttggactcacaaaggtattaaatttgtaattccttttataatctcattcctcctctccttcccactttctagcattctttgttgacatgagcatatgttatccaacactatcaccgactacaaggagatacaataatctgatgatccggtggagttgagctctcatgtagccaagaggaactccgatctaggcacaccaatctaggagcgtggaactttgatctgtgatgggcgcatcaattcatcggcgtggagcttgatctgacgacaagtatgtctatcgagcgataggaaccttgatccatccaaggagacctccatccggtagcattttttgtcctcgttcaccactacctcctcctatattagcgtctaccttaccctactatactttcacacttgatgtgaaatgacagaatataactgtttggtttagttgttctattgatcaaaccaaaccaagtcttcttctttgtgcttgcttcgttctattttgaggtaacactggagatatcgatatccttactctactttctctttcataattttcgaactactactgcaagtagattctacatctcccctccatggtacgttcatcttagcacaaactaaatttatgcctctttttttatcatgaggatcatattgaaacatgaaaacaccatgcgctgctagctagtgtcactctctattacatgaggggtgcacaaatttggttataagatgatgtgacatggagtccatacgcataactgtgtatgttaggcttgaaggtcgtggcacttcgtcaaccttccttcttgtgcaaaacaaggtaatggcgatacatggagctccttttaacctagtgttctagttggatcttagctttaattatcaactccgatccggtagttagatagaatttgattgtaacaagacaaggacaactcaatgtacatacaattctactacacatagtgtaacaaaattacgaaaccgtaaagatgatctcgatctggtgcaaacaccgcatgacagaggacagcataggttgattcattgagtgggttcagcgatatgcggttgatgcacaacaccttaacattagtatgcatcatgttggttgttagttgatagcatgatgtgagggcaaggtaagatcatgtaatcacagcggccctgccatgtactccctctgtttatatttgatcgacgcctcaacaaaaatgaaatattcaaaattgatcagtgcattaaccttaggtgggatgcatggctctttggtttgtatgctgatttaatgcttttgcatgcattcaaggaagtgctggtttcctagccattcagtttgcatgcaaggccttggttgaataaaaattgaatgcctgcctaccttaaaaatcgcatgcaagaaattgaagggacaaattaaatgattaatagaagatattttatttgtcttggtcttgctgcacacttgaaatatgacgatcaaatgtgaatagagggagtactattttggatcagcgatctagccaactcccagactagtcagccggctgctaagacttccccatcagtagaggtgggcagaaaaagaccgaaccgaaagaccgagaccgagaccgagaaattcggtcataggcagtgaaagactgaatttttgttcggtcaatttggttagtctcctcggttaaccgaaaagatcaaattaataaaaaatatctaaatgcaacctacaatttcactaaattcaataggattaaactctaatttttacatctctacctcttctaggcatgcaatctaataagagtccttactcatacgtgcttatgatttttttggtgatttttgtgttcaaaatttttattatttctttgcatatatgaaaatattgttgaatttcagtcatgactgagaccgagaccaatttatcggtcctgatattttcgcgttaaaattcgatctttactttttaaaaactgaaataaacgaaagaccgaagatcaaaaccaaaatttttggtcagacccacccctacccttcagcaaagctcttgatcgttaaagatcaacaatatcactggctccgtacctattttggacccatgacgtgtccattctatatacacgctatatatggtttggcatgtatatatacgtaagcatttacaatgtctcttcttcaccggcaaaccaatatttgccttctcaagacttgaaaggcaaaattggctcttttggatcagcaaatgcataagtttctcccgtacatatgtacattaatattgttggccttattctgggtaccgtgtcgcactgaaactagctgatatcagcttgtgcaatttcgcacacatgcatgcatgcacgctagagctaagttttcatgacttcatgagataatcgatcttgtgcatgatgtaactgtctcaattattcaaaacttaacactagaccgatatgctacctctgtttaaaaagacaactcctgattttaagtctagacatgttctacgtacatattcgtgttgatatggagggtttctttttattatgggagaattggaggaggggttaacataccgtggcccagcggcaagcccggtaatcacagtaatcatgtagttatcatagtactagaataaaaaaaagatgaatttatcaaaattaaaaattgtattaaatgcccttttaacttaggaagctacttagcctctatcgttagcacacttatcctgatagtaaatctggttatcattaagaaaacattatattcgataacaagaaaaaccaattcttatggtctttttttattaagatataaaaattttacatcggtattttattagcacgttttttaaacggtcaaacagtgaatttcgtatgaaaattttcttttatttaaattgttttaaaacattggttaacttttatcaaatttataataattaaaacttaattaattatacgtaaatattgtttttccgtgacctgattttatctccttgattactgcaaagaacaccacctcacgttacatgaaaagtaactcgatcttaggaaaatatatggtggaaactacaaatattatggaaacttgaaaactactattggatagaaatagacgtctgagattcatctacgtcaccatgagtaaaaattttactcgtagattcactcataataatatggatgaatctcgaatgtccattttttaatcaacggtagtttttaagtttttcctgtacataggatttgcactgtatatttcccatcgatgttagctcgcaagtaaaaagtagtggcgaccatgtacagcgggcggccaagtaagaaacgaaagatggcgacacggcaaacgtggtcgaatctcgagccgtatatacgctcctgtgattcgagtggctgccgtaccttcttcttctctcaaatcaaaatccaagttagacccgtttcgctgtcgacatctctacagtagtcgatgtcaggtgatctggtccacacagcaaatgacgcactggcacgacgccacgtcatctcgcctcttgtctcaccgcatgctgcccggtttccttttgatgctccggatgaagtactccctattttctaaaatataagtatttttttagctacgaattttgacagctgtagctaggaattaatatttggttcgatcgactccagtagctaggaaccttcctcttttggcctcacctactttataattagttaagaaaaacgtttgcaggttatactcgaaagtaacattagtgaattatcaaaggtttttttttcacggtttctctgaaagagtatcatattttagtagggatgagaataagacggcattattttgttattattatttttagaaacggtcatgaaatttaaatttaagagtcacatcgttgacctaataaacaaatgaaaataccaaaatttgaatttttgaatttgattttgaagttgattttaagatattttctacgtaatttcgttttggcaatggcttttaagtcgctacgaacaaatatataaaagttttacctatgaattaatttttattccctaataagctatttagacttgttaaaaaatatgtgcaaccgataaggcactaactatatcaacttcaataagatgctgatataaattagaaaaactaaaagttttaaaaagtaacagtttataaagatattattattattattattattattagtagtagtagtagtagtagtagtagttttatgaaaaaaatatcggtacggttgagaactttccgtaccgttttcatagtactattttatatgcatggtattagtttatgatatcgtctgtagtatctctatagtatacacactcagaatcgtaagagccaagagtttattattccagccacaaaaccaccgtaaagagactattggttttacatttttttatgctgatctcacttggtttatactaccatttcaactagctagtagtagaggaataatttttcttttggtaatacaacttataaatcaaatgatttcgatccaatactagtataatacagtaatacgtactaggtcaccgtacaaacatactccgaaaaaattgtatccctttatataggaatacatatccgttatcaaccataaaaatgttaaaataattaaatatttaaaataactatatggagcttgactcattagggatgcaaacgcttgactgataagcaagcctatcgatcagaggaaaactatctatactcccatatgtcctaaaatataagaaataagaaccggataggacatttttactatgaatttggaaagacagtctgttcagattcgtagtattagaaaatattctatctggttctagattattatattttgggatggacggagtatatagacttctttattctcatcactacaaagagcatcagtcactgttaattcattcattattccaagcacagaccagctgccaaaaaatatgaacagattgccaaattttgatgatataaaatacggggaaacaaattaaactatgttttcttgatctgatatggcacaaaacactagctaggatcggatgaaagatctcctatatggagtatcaaagtatagtcaactctgccttttctttttggccaatgattgttgaaaattaagctaggctgttggtccttttgacaaaatgccaagagagcgaatagtttgcactgtgaacataacacgcacggtccatacacacacacacacacacacacacagttgtttataggacttgatctttagttctttaatcagtagaatactttaatgtgtgcacataaagaatcttgatccaaaacttccatgagaataatatataagagagcaagcacgcacattctctccatgtcaaaactacgtacaagtatagatgacttctcttttcttttgtttttttatttacacggaggatataaacgtaaacactgctgcgtgcgcgcaccatactcttacaacacaaatgcatcttcaaacgcaggctcaaattaaatagatggagatatggacaaatccctgaaagtgtactcatgtatgtgttatgtttgtggacagaaggatttgcacctgggcccccatcgtttggcttattcatggaataagccaaatatttgcaaatgaaaaagtaatttgctaataaaacttttatataccactggtggagaaaggggctttactcccggttaggaacccccctatagtcccggttatataaccgggagtacgaatccgggactaaagatacccatctttagtcccgggtgaaataaccgcgactaaaaatccatctttagtcccggttgatgttaccaaccgggactaaagatggtggagcagtcccggttgattctttttttttgttgttgtttctttgctcaatcgatttgctccctaaatatcccaaatcatccacaagcatcatagatctgggaagaaatacatcacatattgcaaagaaatgcatcatagatcataaatacatcacatcaccaaatctcaaacaaaaaatacatcacaaatcctaaaagaaatgcatcacaactcaaatacatcccagatcagatccaatatcacatacatcacagatcaaatccaatgaaacacaaaatcaaaaaaaaaatcggcagcaaatgggtgggcgccgccggcctcccggtccccgtcctctcggcgtccgcgccagcttggccgccgacggccggccgctgctctagatcgaggggaaggggaggaacggcaggggaagtggagaggaaggggatgaaggggagaggaagagagagtgaaggagatattaatgagaggggaggagatcgagaggagatcgcgcgtggctctcgggatagtctttgctcccggttggtataaacaaccgggactaaagatctatttttagtcccggttatttataccaaccaggagtaaaaataattgggatctgtcttgaactcgacaactttttgaaccgggactaaagataaaaaagtaccactcaacttttcaaccgggactaaagatgctttttagtcccggttttttttagaaccggcactattgtggaatttggccaaccgaccaaagatggtttctccaccagtgtacgtgttcttagcgatttaaaagtaaagactgaaaaataaatttcgatgaaaaaaaaatcccaaaaacaacttcaaattttggctgataagtataagcgaaaagatgaagcataattgtgcaccaattactactatcatactatctgtgcttacccaatataaaagacctctcttgtgcaatgttgcaatcaatatatcaaaatgaatggagaaaaagaattatactggtatcctatgttcatattcgtagcctccgttttttatggcacggaaggtgtgtactacataatatgaagcagctaggcagtttccttctagagttttgttggggaaatattcgtagatagtcaactgtggaaaacccaatggctctcaagtctcaagcctagtcttgtccctgatggggcacatattgcaagttgcaacggataaaattttgacgatattcatgttattacaaatctgttatactccaagctttcttaggtcctgtttcttttagcttgaaattattataatccagattattaagagtaaactgaaagaaacagacaacttattggagtagcttattataatatggagcccagcttattataatctgataagctcatttaggtgagttttttttccagattattgggtgaaaaattacccaccatgccaccccacttcctctttagatttacaaacccaataatctaggctctaataatctagaaaagaaacaactaaccgcttattctactacagattataacaatctagcttatagtaatctgactcaataatctagattataataatcttaagctgaaagaaacagggccttaattgtctagatattcttgtaagaacagtgctatacatactaaaaaataatccttacaaaattcttaattagtaacaaatctcaactgtttgatctaatttggtggtatttatgtacagaaaagttaagattaaatcacaatgtgacatcagcatttgcaagaaagaattattttttatgtatatcatttcccttcttataactttcacttataattaaatttgttgattttgaagataaaataatatcacttagtggaacattattttacaaaacttactaaatgttgtatatcatggtgatatatgagaatgagatgtagatcctctgctactaacatgtgagctccattctcctctagcactatgcccatatatcggtggcaattactactatataactgtaattacactcccgttcgttggtgatccttatcatgatcttaacatattgctctttttttttaaagtaaagtccatcaccggtccctaaacttgtacagctgtgtcatcccgatccctaaactcgtaaatcgaccgtttaggtcctcaaacttgttcgactgtgtcatcccggtccctaaacttacagatcacttatgtcctctaatttgttcagttgtgtcaccccatccctaaacttggatttgaatatcatcttgttcaaataggacggtctaaggactttatatttaaaaataattcataacattttcatgtaaactctaatgaagataaactttatatcaaacttgtagccctcgacacgatctacaactttgtagttgattttttttttattttaagtcattttttgtcccaaaatgtaattttaaaattaaaatttcaaaatctataaacgtgcaacaatattttgggaccctaaacagttttaattcaaaaaattttcaaatacaaagttgtaggtcgtgtcaagggctacaattttgatatagagtctgtctttattagagtttacatgaaaaaattatgaattattttttgatataaaatttttagaccgtcctgtttagagaccggggtgacacaactgaacaagttggaggacctaaacgagtaatctgcaagtttagggaccgggatgacacagtcgaacaagtttgaggacctgaacggtcgatttgcgagtttaaggaccgggatgacacagcggtacaagtttagggaccagtgatagactttactcttttttttcatcaatcattaatatatccggccggtcactttgccttctatacgctttaatttcaacagtacaatatttacgcaacagtgaacacacgccgtttaaaaccgagaaaatgtcatttgacagctataaagcatgaataattcaccgggattgcaattcgatcatttgtactctatgtgacaagtgattgttgggaccaaataaaagtgtgggcacgttttgtcttcacctatattgaggtgcccccacatgatgggatggtttgtggctgtgaaaaatgaacatggccgtaatcctatggaaaattcattgtaataaaatactgcgtggctcaaatttgcttttgtgctagaatttcgtgcagtcatatcaataattttgtcaaaagttatatatttgaaaggtatcagttgatgtactggcatggattttggccgcaaaattaaacataaagtgtaatcgttctctatgaaggagatatgcaaatgccttttggccaccttttgatatgactatcaatttcaggaggggaaaaaaaataaaaaacgattccgatcggcgatattcgctgaaaatggactctgaacttctgaaaggagatgcgtgatgcatccatatcagaccatctgtttagtttgttgaagtagctgacctttttttcaccgtggagtattagttaattacctctgttttttaacaccaaatcctttcatgcctgagttatacaaacacaaataccattaacgtcgacgatgctcaagatatcacatacggccggagctgaggaagaagctaattaagctagctatagctagcgatgtcgtcagccatggcgtaggtgatgacgtacgcgcgccacccagcttgtcgttaactatctggtgagagagtagttactcctaaattaatggttgattaacattgataggagatctagactgtggagatgatgctagaatcttttccttcacacgatatggtgagatcttgcagcagaaaataacaatacagagtttatataacatcatgcacatgcaatacctagcttattattctatcctttttttaatataagatgacgtttcctttaaccatagtcttattaactttttttatataaattgcaaaaaataaaaaatgtacttaaattgcttctaacgcatgataaataaattataaccaactaaataactgataattagattttttttggtaagacgaataatcaacgtttgtaaaaatcaatcagtgtcatatacgtacataaataagagatatctatgatgatgcaattaagctgcattcgccggccagtgatgagccgatcgatctagtgagctcatcatatatatattatatttacatatgtatgcagatataaataatctttggacacctacctgctacgtaatgtggatgatcttagctgctagaagaccaagagaggcggccattgactatttgactggctaactactacaaagcatatgcatgccaaatacaaatgggactttacgtttaatttttatttcaaccttaaacaaaaaagcaagtattctttgttcatagtctttcaacatttgacttaattagccgcgtcattcaccctaaaaaaaatctactgtaaaaatattataatataattaaccatgtaaaataaatgtcgcttagctttgcgactgataattaagccgtagaaaaataaagataacatgtgagtttatctttaattaatcacctcagtcatacggtttccaatattgcttcaatagtatatataattaactaaagagaaaatagtatatcatagttgggcgtatatagctagtcttgaaaaagtccgtagacctatggaatctaagtactccctccacaaatataagcgttcgtagcatttaaaacatacccataaataacaggaagtagtactgttatcctattagttactcactccgtctcaaaatatagtaagggcctgtttggcgtagctccagctccagttccaccccttctggagctggagctcagccaaacagtttcagctctaccaaaactaggagtggagctgggtggagctaggtggagctctctcacaaaatgaactagagttgtggagctgggtttaagcagctctataactctactttagacccaactcctgtagctaaatttaggagttgtagctgtaccaaacaggccctaaacttgtaatggacccatgtccaaattcgttgtactaggatgtgtcccatccagtataatgttgctatattttgaaactgagggagtacatttcttttaaccacccacctaccctcatccatggcaatgagtggcactaaaatcgacttttcttattgactttaatctatgagataaccaatttagaaattttaatttgttgaatgaagggagtacaactaattagacttaaactgaactgccatctactgcttatggaagctctaacaaatataattaatggatatccccccacaaagaatgtcttgattgaaataagcacgcttttgtacctttacaatataattccacatatgtatcttataaaaactgctaggaagatattcacacctttatataggttctctcatttaatagaaaaaaaaacttatatatatactccctagattgctcacacgcacccacctcaagaagattccatcaaaatctataggaaacaacccggacctcctaaaattcatgtaaaacagctgcatccaagttgccatatttcataaaggttccgaacaatcattgagctgtttcttgccgcttcttcacactatacttctctgaagctaagcatgtgcactttatgtaggaccacgtctatcatgaggcgagtgctctttcatttcgagcacgttttacacacgtgcacggtgcacccaatcgaccagaagttaccttcctcaaatcctagaattttttacgtttaattagtcctttttttaaaaaaaactatttataaatagatctccagaaaacttatttcaagaatgaaacaattttttgcgcaagtgaccttgacgccgaggtttaacgtctcagcaccaattacgctggtgctgagacgttggatcttggcatctaaaatatggttctgaaataagttttatcaggaatctattgataaaataagttttcaaaggactaaaatgtaaaaaatctcataaagataatctcgtaaagttttatgtggtttcttcgaaaaaaagtaatcttgacaaaagataatctcataaagagaaattggaggggaaacaagcaatattgttttttaatacacaagagatcatccaacatcttttctttgactgtcatgttacacgttttgcttggcgatgtgtcttctttgccttcaacattccccctccccacaatgcaaaagatattttttggtgactggctaaggggagtgcctagacccacaaaaaaatgattttgtttggagctagtgctttatgttggtcaatttggcgttgccgtaatgatatagtttttaaccataaaaaaatgcctaacatcatgcaggttatcttcatgtgttccaattggctccactcttggtgtatgatgttttcacaggaacaacatgatactatgcgcaatggtgctacatgcttggaattagtagccaaggaacttttattccattttggatggtgtagtacctacagaatttcgtgatagaatctacgtgattttgaaaaaaaaaattattttagtagatcatatcatcggcagaagttggggatttgtctcatctcgccttttttaacttttctgttcacgtctgaattttttggctgtgtgcctaccggcagaggccggagatgtaacacatttccattatctaaaaaaaaatgtaaaaaatctagcctcgaatccgtcgcagcatagctcgggaatttcggaacgggccaaagtccactaaaccagcccaccaaacagcaaaagatcagggcccaatggagcccaccagatcagcccatcaaagcacagctcctgcgcccaattgagcccaccaaaatcagcccatcaaaccgcaacgccaaggcccaccaaatcagcccatcaaggtttacgtgggcttctctcccctttgcctcctctctttctctctctcgcctccggccatggcgaaccctcgcggcggcggcggaggaggagcgcgccaccacctcccactccggccgcggcggctgctccggtcgccgatctcgcgctgcgcggtcctcctcgccgcctccgccgcgctcctcctcgtcctctccctccgccaggtccaccgcgtcggcctcccaccccgcgaccacccgcccgcccaggcccgtctctccatctctccctctgttgcattgcagcgtctcctcctcgccctaggcggccgcaagtgcaaccacggaagttgccttcgcgagtgtggttgaaattttacctcatttctttggatctttggacttgggaggtgtccatgaaactgatgatagtagtagtggtagaccatgatgaagttatctttagtagtgttattagttataaactttctaggaaaattacctcaagatcattgggagttttgagccggcgaaactcgagcatcgcgcatggccgtaaacttagatgcgtgtgtttttttgctttacttttagttagttggcattgcgatagtcctatgggcaccattgtgatgctcagtaatttttgactcgagctgtgtaactgatctgcaggaaccaaatgagcagctgtggggttctgatggttacggttctcatgcttgtgtcacaccaacatctagatatatgggtaaattcctttcttatgaagcaatttttcatcgtatatgcgatgactccgttttagtttactgagctggatatatatggctctttgcaacttgaaagtactagctgttgttaatttgaagtcagaatttggtggaaagtttctcgttgtctgttctgatattgacttcactaatatgcttgtagtaataatctataacttggtttaactacctttgatctccctgtaagatagtaaatggaatgttcgttcagtacgttacttttggttttaaaaaaacacgtgttttactgcaatagggttggcacaacaatggttaagttatagattattattttattgccgggccgacgatgagaagccggccaagatttattaaggctgaagaaaagtttggttacagtgaacagcagcacagtcgctgaaaagataatctcagtaccaaggtgctaagatactataaagcacagtcaaaagccgaaaagacacgaaccagagcatttctggtcaaaaccagcacgaatatcgaatataacaatggggaggtatggctatggctatgtgattggcgtgccaagcccgacaatcctccaagtctaccatttgtccgtaatggcgtcagcgttaagttatagattattcttgctgtctttctttagggtgtctctattggcctatccatgtttattatctacatactctagtatagtgctcaagcgaattcagtgaacatacatgcatatgtaataatcccttccttgatatggttccactgtatacagtcctaacaccatcatttgtattgtcagctccaaaagggtcagagcgctacatgacagttaggagtaatggaggactcaaccaaatgcgtactggagtaagtttgtgacacaaaagcttaggccttaggcttatatctgtcttacttttatacagttttgcatcaataattttgtagctgcccaataccttcatttgtctatgttattttattcattctaaaaataaaaattcggcattgcttttgcaaggttcatcctgcagaaaatttcttatgttatatttgcaattattgtcatttattcatcttttctttgtgatcatcctcaataaatttactgtaacatggttaatttgaggattgttcttccctctgcagatctgtgatatggttgcagtggcccgtttggtgaatgcaacacttgttattcctcaattagataagcgatccttttggcaagataccaggtgcctaccattagaatgtgcttggtgccttggttagttgtcatatactgttccctccatgtttagtgtgttaacaatttactctgctttttacagtacatttaaggacatcttcaatgagcctcgttttattaaagctctggaaggggatgtcagcattgtgaatgacttgcctcaaagcctgcagtctgttccaagagctcggaagcactttacttcatggtctggtgctagttattatgaggaggtgaaacaactttggaaggatcacaaggtatttcttcagttaagcagctctccttcacaatgaaccgcctcagcactgcagagttttagatgcccataaaaatgatttcttttgtttttaaataaaatagcgacctttctgtgcagagtatctttgtgctattagctcttaaattttgtacttcttgatattgaaatggtttaatgtagttattccgaaataggatcaagaatgctagagctgtagttatgatttacatgatatatatgaagcataatcatgaatttgcgtgaaaaaaatattactcatataatttatcatgatggtcgtttatttctctgtgctaccagcattattgcattgagcacctgctggcataaaataacatcagagattctcaactagatacaaaatttgttgaataactctgattttccaactgaaaagatgaccggagagaaaatatctgttttttttttaaatggcacttttgccttctttgaaacctgaaagccatttatgcgagctcacaccaaccatatttgttacaggtagttcacatcccgaaatcagattcacgacttgctaacaatggtcttccgattgatatccagagattaagatgccgctgtctttaccaagcactgcgtttttcagatccaattgagaaccttggaaaggcatgggcattctcttaataaccttatcctttctctaactcaggatctgtattacagttttcaatttgcatttggaaatttatggcaatctgtaaactaggttctgagccaacataacacttacaacagaagcttttggagcgtctaagatcacgtggaaaatttattgctcttcatctccgatatgaaaaagatatgctagcattcacgggatgcacttatggtctgagtgaatcggaagcagatgagttaagaattatgaggtaccaataatcaatgaaaatcagttcctttattttttccctatggttgtatgaatttgctttctccatctgaacagggagaaaacaagccactggaaattgaaggacataaactcaactgaacagagatctggaggtaactgtccactaacgcctgaggaggtggggatttttctgcgagccatgggatatcctgaatccacatggatctaccttgcagctggtgaaatttatggcggtgataagtatatatcaaaattgagatcatacttcccgaacttggttagcaaggtcagctgtgctacctttttttaatcacttctgcgaaccattgtatactatatttctgaaccaaagatttttttttgcaggaagtgttagcaacaaaagaagagcttggtaaatttaacgaccatgcttctcaagttgcagcccttgattacatagtttcagttgaaagtgacgtgtttattccatcacattctggcaatatggcaagagctgttgagggacatcgtcgatttctaggtcatcgtaagactgtcactcctgacaggtaaatattggaatattcacaaaaacgttattttttttcctgtatcatgcatctaccaatcttggcctggaggctagttgcttgcttagtttattttttttctctcacatctggattaaaatctttgtcacatttaatcttcaggagaggattggtggaactctttgatttactacaaaaaggggaacttatggaaggtccaaagttttcctcacttgttactgagatgcataaaaacaggtgatttgatttatgccacatgtactcttctgtttcacgctttaaggattggactgagattgtatttctctgttttcaggcaaggagctccaaggaagagatatggctccttgccagggagcaagggcagagcacgtctaaggaccgaggaatccttttatgaaaacccatttcccgagtgcatctgcctgaatggaaagcactgatgtgatgatgtaggtttgccacttttattttgctgtatgatattattttttagttaggaggtagaatactgttgattaaacaagtatgaagtaattcctgtaaatcaatcattgctgcatacactacatttatctcattaattctactggcaagctactaaaaggaacatgtgattataaagaaatggccagggtgcaaacgcattatcaataaaattgtgcgtcacaatcacatttgcttagttctcaagcaacttttggaaaatgtctgcttaggagtttggactacgttcttcttgagtgaacctatttgttccagctctcctttgaacgttgattaccctattttcttgaaattcttttatcaaagaagaaagctggtccttttccaattaaacgattgctaaatggtttgtcgcatgttttccatgaggtttttgcatgcatgctgtactggtttcttctcttgtagttattacccatgccatttctagccagtgtcgtacaaaccttagcatcctataacctattgaatgaaatggtgtatgttcttaatttcagctctgcatggcgacctaagtccatttgctctctgtattggtgtttctgtcgacgaatggagctccagtgacgcatcagaattacactggtactcgactcagtcatgcaagtcaggcaagggtatcattctttcagtgatctacatccaagaatcctgtagcctgcaggtccagaattcaagatgggaaaattggcaggtagagggaagaaattgtacattcatcggtttgtcacatagtcacagagacagaaattgcaaaggatgtgtgatatgtgtgtctgaatttttaggttccttagatctagaaaattttgtatctagtattaggcatttaggcctcaaaaagggaagtttacgtacaatgttcaaaagcttcagctttaacaactcatattcaaaagttatgttttcttactcattgcccctctgcagtctgtataatagcacctcattttctctaatggtatgcacataaacagatacatcgtgagcaatttatttaaaccctagacaacacgaaatgattcagctatttgcttcaggtcattgtaattcctcttccattgtagccctgcaacgatccatatcttttattcagcattcggagttctaaagaaaatgtcatacagttttgagataggaacagtagttttaccatttgcagttacattgaacaggtagagcctgtttccagcggcagttgcagtgatgaagatatgaggtggttccagctcaaactggtagtaagttcttcctgaatactctgctgttgccatggacaaaaccttcccttcaacattttcaccgatcacctctggtccgaaggcgtcgatcaccttctccggtgtaccgatcttttcaattgtcgcatcgtcgagttcttcgcacagttcatcatgtcagttagtagtgctaagattgttaccatcctaggaagatcttacagaaactgcattctcttcagaagaatgtgcttctcacctgcaaacctgcgaaccggtgctacaacgacgaacaaacgtccctgcttggaattcgcaaaccgcaggtcgatctcggtgccaccaagatcagcaatcgacaccgggacctacattgaaaaattggaacagcatcaattttgcatcggaaagattgtgacagtgttctataaatctgaatttgtgacagtagcttcagtttttcacctcttcccagccatcacgaactttgaagctgtagggaatgattgggctccatccaactccatgtccaccggacttgtcgtctggcctacggtatgttctccaacctgtctgaacaaactatatcatgaaaacaatccagcagttcctttttttcagatagcatgcctgaaagatgatccttatatgacaaaaaatggaagctactgcaaattttgtacaaagatattgaccatatatcacttgcatgttgcctatgtctcatattaaacatgatgctataattctttgacagcaaaaacatgtagtagtatttacttgtggaaacatgcatgatatcgaagtttatggctatgattcagcagttacagtattagcatctatagcacttggtttcacagtggagattactgggaggtcattaaagtatttttaatcatgggcaataggtagaccattttcaaccatgttcatttatcctgaactgaagggttctgaatatccttatgagcacaaaacaagcaacaaaactattgtctcaagaaaggcatgaagaacattagacaatctgtctctctgtctaaactgtctaaatggaaccttcaaataaacaaaaacattgtaaagcacatgaattaagggtcaaaatggtagaaagaaccaacctttttcatcagggtcagagagcccagggatccgcccagccagaaggccctgcttcactgccatgctctcacctgcaaaaccaaacactgaaactccacaggcagcagcagcagaagccattgcatgcctcctccccatcaaggaggctacaccatcctcctcctcatgtgcttctgacagattgggcccactgctgcacctaacagcagctgctgctgatgctctgcccttggttgcaggtaccagctgctttgtgaggaacagggatgagcttggcaagaacagcactgagctgttcatcatctctgcaagaagcatggatagtttattgggagcaagttcttctttctctgtgatgctctagctctggctctatgatgtttcttgaataatttttttgcttcttgtttttcattgagagaattatcttttctttggttcaatactccttaggctgttctggaccacaagccatgagtggacaggatgatttgggagttcagcgttcagacaaaaaacttctgtcctagattggttgagtgtggctgcttcacttttttgctttcatgtatgcttgttttgcacatataagttgaggtgttcagctacacccaggtttggttagaacttacagattaaatcaaatatcagctgaatatagaatatccttattttttcaggtaattcctcaccactattgcatgtgtgttcagttgtaaaattcagattctctttattttctctctctggtttgatactatgttaaaagacatcaaccacatggcaagaaaaatcattcttgtggcccatgattgatatccattagcttccagagcatccatgtcaggcagccttgtgaacaaggatgattgatcatttctcccaagctctgttgctggctcaaagttttcaaaggtaaaaaggcccaaggtacaagggcccaaaaactctagtttgatttttttttgcttctaccagtccaatataaatagtaattacttgaagaagtaattaaatattactacaagaatgatcttctggtagaggaaaagaaacagaaattgtgctgtgcagtgtgcacacacactacacaggagagacaagaccaatacagcgatcaaactgaattattttgtggtcggcggtgaagaggagactgaccaaagaagcttgcaacgactgactgacgtatatactgacatatttagtattcaccattgtgtcaatgtaaataagatttacaaagacttttggcatatcatcaaatgttgaattgctatatcgtttcgtcattccgcgtgttcgagaattaatagtcatgcattgttattctgtattgaacgtactactaatctcgatctccaaccccaggtgatcttttgaattttgaagtgcatatatatgaatactagctagctagtggatttcatttctgtggatacactatccgaaaccttcacgaattaaatttgactttattcttaaatattattcactcttaattataactttctagctcatcctgcgttaatttgtgatgttgaccatcacactccacgtgtagtctactgcgtcatgcagctaaattaattgattctgaggtgtacctaacaattaacgtaatccacgttgcatttctcgctaattaatattctgtcacgtctacgcgtatatatgtacgtattacgtatatatatacagtacttcactatcacagtatgtacgtaccatagctagcttagctacatacggtcagtccgtccagtcgtctacgactgtcacgtacgaccagaaaagtcattcttccctctgaaaaattaggaatggtttagtttgattttccatcatggatttgttggaatatactagtcttttctctgttttttttctcccctccggccgacaagaatagtcttaatttctgacttcaatatatatctatagtcatatatatgatcgatcttattgtgcgttatacggtgtataagtactatgaacctatatgcatataaactagcacatgtgggtgtatatatatattcaaagtgtgtacttgtcctattaatttctgatattttaaatgtgtgataggatccatccatgtacatccatgtacataagtgtgtgtggcaatgcatgcataggtataagtatgacgtgtatacatttatgtccaggacttgtccacgtacgcaagggtatgtccaagacccatccacatacataagtgcgtgcggcgatgtgagtagagatgagagcagtcgaaaacaatactagtttttattttacggcaatgttattacggttaggaatttttcatatttataaatttaactatttagtagcaacttcaatacaacgcaaatagaaactagaaaagctaaatttcataacaataggaagtgatattattttttacggaaacggtattggtgcagtcggtaaatttccgtaccattttcatccctaggtgttggcataaataccatgtgtatatgtttgtgttcagaatccatccacgtataagtacgtactccctccgtcccaaaaaaagtcaaaccctgagtttccgtgtccaactttgacggtccgtcttatatggattttttttataattcgtattttcaatgttgttagatgataaaacatgattaatattttatgcgtgacttgtctttttaatttttttcataatttttttaaataaaacggacggtcaaacgttgggcacgaaaaccagggtttatctttttttttttggacggagagagtatagtggtgtgtgggtgtaaatgcatgtgtcggtacgtttgtatacatgatccatccactacgcaagtgtgtgtggcagtgtgagcataagtacagtgtgggtacgtttaggcatatatgcgtgtgtacgtttgtatctaggatccatccgcatatgtaagtgtgtgtggcagtgagctcgcgttggctctgtttgagctcaccacgaccgcgcccctgaatatgccacgccgcttcgatgtgaggtcgcgtcgcaccaccaattattagtctcgccacgacaactacatgggtataggaacgatgatatgtgtatgtctgtgtctacgatccatcacgtgtggtggtgtggccataagtatggtctgtgcacgtttgtgtccaggattcattcacgtacgtaaatgtgtgtggctagtggtcaacttagagaaaaattaccagggatccaatacataataattatctaattattagctagtatattagtttaaatggcacattttagttagtattggataaattacctggtcttgtaaccccggtaattgaatgcatgtgggagcgccactgcatgtggcgttgtgagtataattacgaggtgtgtatgtttgtgtctaggatctactctatgtatgtaaatgcatatcgtagtgcatagataaatacattatgtgtacttttgtgtctaggatctttccacgtatgcaagtgcatgtgacagtgtgagcataagttccgtgtggtggtgttggcataacagtgtgtatatatgtgtgtccgttctttagggaaaaaacttatatacatactgatagggatgaaaacagtcagaaacgatcggataacagcctcaaccattttcataatcatatttttctcggaaatgaaatcgaatatggtaaagtcggaaacgaaaacgatatcggaaatatcgaaaagccggaaatggaataatacggacggaaaaatgtcggtatagatcggaaaccggtaaaaaatacggaaacattaaactatagaaaacatttatttaactttacataagtatgttatatgtacaaataaattcaagctatactacataaattataaattaactctattttagccatacactcaagttagggatttgattgaagagtcaatcaatctctaaactgtgggtcaagtagagacatgccctataaatatcgagatatttagaaatacggtaattattatattataagaaacggtaatttccacaagaatacggtaaatacggaaatgattagtaaaatagcaaaaccatttccgtttccatttccatttttttttctgtcgattaccatttccatatggctcggctggtagaaagtcagaaacgaacaccggtcggctgggaattaccgttaccgttttcacccatacagactgataattcattagttggagtatatcattgcctatctttccaattttccgagcataagttataaacaagtgaactggatttctacatgacaagaatggcatgcatatacatacattagcacaaattctatccaaagttgatcaaaaggaatatgtatacacacacgatcaaatcgacaaactataatacttattccatgtttattttttttgctaaatctcaaaagagaacatggagcgcctattttcatttaagaagaagagacttcacccaatttttaagaaaaaaccgagcccaaaatatatcacaaatgcacgagtaattgcagaaaccgaccaaaatcccacatggagaacaaactagacacttgcagtggcacaactgaagctagaaatacaattcatcattgcagagctcaaaagagcaattccgacttcatatcatcaagccacgtactagacaaccaattatatcaaccaagaaaccgtagtgcagggtcttctaaacgaagcctacaaggaggaagatagtgtccaagacgtgaacaatgttcgtctgagcatcgtaacaagattttcacccaaagaaaagatgagagcaaagcaacgacgtctttcaagatggaaacgatgcccataggcattgacatgttggctatagtcaaagaccaaacaagacttcttcctaggctctcattgcgtgtcaactatgaaatctaaggccgctgcagtgctgccaagatgaaagcagataagggatatcattgctaagcttgccatcattgtagagcaactctgattccatccgaacacaccaacacatagccacgttgggaatccaactgcacaattactcctttgatgctaccaggatgaaagagcatgagggttatcattgctgagtttgccacacctgactaagtagctcagtctccactctgacacaataactgatggttgcaccatgagggcctcatgcactacctctccaccaaaccaaacacctcgctaccgcaagaactttcaaaacacaaaaagtgttgatggccacatgatcactaccaaatagaacccttctaactgaaccggagcctcaccgcttgccatggaactccccacgaccagagtctggaagcaaactggtcaaaagaaggggagaagctccatggaatggaagaagacctagccggccagggaatgtttggacatggtgtaatgaccccttgcggtcgactaggccaccatccacactgttgttcactatgtcccgtggctttccaaccaaacaaactacattggcggctgtccatccatctcaactgcgccctggtggcaatctgcttatttgactacctcgttcattatctaaaaagaaaaaaaatctggctacctcgcaaaccacctccgacaaaagtgccaggcacctggacaccttgttggcctcctgcacatagtttttggacacttgcgcctccatctccgattggctttcacctccacctccaccagtcacctacacctccaactctgactcgctgaccatctccaccttcacctccattggccacttgcacctcgaccaagctgctcccaacttgttggatccaggacagggtgtagctagtttggtcttggagaggccggtttggccgtcattaacgtccttgcgcctttgccttgccattgccgttttcttcctcgctgcctccaccccgttccactttcgatgtgcctcgctgttgggtccctgttgtcagggctggccctggggctatgcagctgaggcgatcgccgggggcccatgatggtgggggggccaacacctaatactagtagtctagtacttgcctatggcctacctggaagcagaaacgcccgagagatgggaggagttgtagcgttggcaactcggcagatgacatcgtatcgcatagggcacaaccgcacaggcgcacatcgtcgtcgactcgttcttgatgattttgcatcaagaaatgcccgaagaagttcattagaaacaatggatatgatgggattctattcttcgttaaggtaatgaatattagttcttaggtacaaatatattgttattttggtcgactttatttttctcgataattaccagacatgttaaatttaatatatggatgtatttgttttcgttttgcaagtaaaattagcgtcaattgtatcataaaattttatatatagcttaaagggcccatcacgatgagttcgtctcgggctctcaaaatcagaggatcgccctgcctgtggtcgccaccatgcatcatcctcttctcccccgctgagatccgggcccgccaccatacggccgtctacaccgtgcttatgtgtacatgcttgtcttcatctaatctctcgtacttttttttgtcattattttccagttgcttaatttcttgtaaactaggttttccatagttagctagcctgcctgaatttcgtcaactgcatactggaatgatacatagtaattgtccactcttaactataactagatttctagcacatcctgtgtttgtgaagttgaaccatatgcatgcaccgatgaggtataatgcattctgagtacaccacgtgtaatctcgtgtgtcacatgcggcatgcatgctaattaaattaattaattctgagtgtatataacaattaacgcaatccacgttgcatttctcgcgagtaatattctgccacgtccacgcgtatatatgtatatcagtggagtacttcactgtcacagtatgtagctaggtcgtctacgagcagtacgtcgatcgactagcaagtcatacaaattctttcctctgcaaaattaggaatgatggttggtcagcttgttgtttgaaatagtcttttctttattaatttctgactaaattaatttagttctccataatctaactatacagtctataacgtgcataggcgctcataagaatatatgaacagcctataaacacatgttagttactccctctatttcatattttaagtcgtttgattttttttaatttttttaagtttaaccaaatttgtagaaaaatatactaatattttcaatacaaaacaaacatattattgaaatatattcaatgctaaatttaattaaactaattagtattataaatactgctaattttttctattaatttggtctaaagaattttaattaagaaaaaaagtcaaacgacttataatataaaacggatggagtactttgatagtagatcaaatagtattactacctccatttaaaaaaagtacgatgtcctaaaataaaatacatgctatcaatgcaaacctcgaaatcttacatcatttagaaaaaaaatcacgacttaaaaaatgtcaaagaatatttttttatgaaaaaacctttttataattatatatttaatatttttatagattaatacttttataaaaataataataatataacatgtatattgaatactgtcgatttctaaaacatcaacagtaaaaaagaaaagaggtatgcacaagtacacgcgcgcgggtgcatttagtaatagtcaaattgtgtactgccggcacgattttaagtcttttaaatgtgcaataggtataatatgttcttttcttgaaaaagaacatatgcacataccgagaattctcagtttggtaagttttcttcacacgacgcttgcatatgattgtatcattgcttgtcttttcaattttcaggtcataagttataactgcgtgaacggcatgtattttttacatgacaagaatcgcatggatgcatgcatatacaatcaggacgaattctattagatcaaagtctgcaaaaaggaatatatatacaatcaaattgacaaatcatacgcttacaccatgcttatatgtgtttgtcttcatctaatatctcatacgtttggtcattattttccagttgcttaatttcttggaaactaattaagttttccatagttaggctagcctgcctgaatctcgtcagctgcatgctagaatgatcttgatttttacaaaacatgtacaaatcaagacggtgtgccttgcaagtaagaaggatcacacatggcatgattattatacccatgtgtaccactatgctgaaaatatatttattataaaccagttaatcatttgactagcttgcaattattttggaattcaaatcgaagtacacgtcacatcatatctgtacatatatatatgtgccttgaaaaatattgttgcaaaaatcttaccttgtcttaattcctttcagacttactggccatcaaacaaatatatcagagatcgatgtcgcgatctttaatttcatacctgtgacaactattcttggttcagattgtgaaatacaacaagacagtgaaatctgcaagtacaggaataaaaaaaattaaagggacaccgtaccaatgttgattgcagaattgcaatcacatcgagatgacatactaattactcctattaccacatgccatatatctctcgagcatttagttgaaagtgttctcctcctgtaactacattaatccagctagctggttaccttcatatgttgaaaactactttgccaaaggtatgtgcagtgtgcatatatattacatccgtgacacttattttcctgttaaaaatttctagctagtcttttagtaattatttttcttcctacaaattttttttctgaagcatttaatttgcaccttgctctcggctaaatcatagcaatctgcaagcatttcatgagaactgaatttttttatttgattttttttcttgatctgataagaattgatcagccttaaatttatttgattgatcaaaaatgtttttatttgatttttatttcatgagcaactcctgaaatcatatttctgaaacttactttttagtttgcttgaacttttctctagtcaaaggtacgcgcgcagtatctgataagaatatagttagttcatcgttctgattatactttccatgaaactctccagagaattccggactattctgaaaaatcaagtacgcatgatgtgatactgatctatattgtggaataataattttaaaaagggatctcttgataattgagaaaaaaaagagctccatcacactggcacatggaataaaaatcaggtgtcgtaatcatgtcacgcctgtattttgacttgctgcaaccgtccctggttcggattcagaatcgagacagtgaaatcagctgtagttgaggcgattagtcaagtcactctatatgattgctataaatttagttatcatgcacaacattctgtttgtctcttgaattgttcgaccttttttttgtggacgcgactctccgtcgggtgcccgatgagaagttaaaatcgggcgctcttaaattatttattcaaatcatgatccgattgtaccattaaattcgttacaattaaaccttcaaaacaagaccacatatggatatattccgacgaaaaatttttttagcttattattgaattatttttaaatgttgcatgatgttccatcagatatatcggaattgtttcactaagtagatcgaaaatgtttcactcgtttaaatcgagtgttgtttcaccttatataaaaaaaatgtttaagcaaatagctctgcgcaataagtagatcgagaggtcgttccgccccttgtccccgaagatgggtaatatgttctcatacaatgttgctccaactttttcctagagggcctagctggtgagcgatcccagtccgcggcagagaacagccagaagcaactagtcgcctcctttcctccgccgaaagatgcttagccagaagcgacgaaggaggggagctggggaaggctgacgatggcaatgaggggggaagctgtcgtagaagctttgccgattggtttgaggaacgtcttgagattcaggcaattgcagatgatataactagtaaatatgttcctcctcatgtcaacatattttattgtttagggggaattataattacttgttttctagtacaagttgctaccggttttgctatgacttttgactatcgcaacggaaagaaaatccgctgcaccttctccacatctcattggtttctattctgcaacatgagatcagcaactaactgaactggatcatcagtcattctccctaacggcttcattgttcagatgtttcagttcactgcaacattagatctatacatagtgaaacattgtgagtacactatgtgaacatgtttggtgaacaaaaaataaccaattngtcttaatagagagtttccaaaatatgtgggtttttttgttgcaatagagttatctgtggataagcggcaggtggatagggacacgtgggggggcctaatggggagacacgtgcgctggggagcgaccgatccaggcggctggcggcggtcgaccgagcgtgggcattctccttttttttgttctgtaattgcaaccgtaagaactacaaaaagacatataagtcttcaactcttctgatttttctccaaaaaaaggagaccccacatgcgcacaactgtttctgatatggagttcaaagaacaattgatattacttcgatatggagatcattttcgtgggaggtagtattgttaaaaccaatttctaaatcaaaatacaattgatattacttggtaccatttttttggcacatttattttttaaaggtttacatcacatcctctaactgtgtagtcggctatcactattcacatatattatcatacaatgaatgtaattttctgtcaagctgtagcctaatcatgatatctaaaattcactatatatgaaaaaggaccatgtcaggatctacgccttttgggatgctgacaatctgctggttgatatttggcaaggaccgtgcaattttccttgcattctccaaataggtttcaaatctcatatggttgggctcaggcttcttgtccaaattctttgcaattcttgacttaatattttctgcatattgcacactagtggcaagggagagttcctccctcaaaacatggtatttgattgcctgctcacggaaagtccagttaccggtgatccagtcaaatttgtatagcgggagaaagcggtgaccatatgccgctatgaactcaatggcggaaaggatgaatttaaactcctcctttgagagatagtaagcaaagctcagcctagtccatccaggcttcagtccactgtacccctgaaataatttgaccgtagacagtagcactagttagtaccttgatatatactaataggtttaaatttactgtaggcaatctaatcatacctcaagaatagcagaacggatgcgaacagagagttcgttattaacatcaagcaaaatgtgtccataagggcctgcacaagcacaccctccccttgcttggatgccaaaaagatcgttaagaagctttgtaacaaatctcccatggaggggtagtctcttgtttgtcttgttttccaatgaattatagcaaccgggctcaacccgaagaaaaagtgaatcttccactggagggtagatgaggaacgagaagattggaagacgatcaactgttgtgttgcctaggacctttatattcagattatcaaggagccttttcattgccatttcagagtacactcgctcatgtagttccattgtttcatatccaatgtactccttgacccaaaatgctagggatgcacggatcttttgcactatcggtggtgtgccagcatcctcccgctcctcgatatcgtcatagtagagggtatcctacacatcacgtgtacctttgttcattagtatttatgaaatggccatgcttaatttggcacacaaatacttgtaatttctttgtctatatgctaacctcttcgttgaagccattgacataggcaactgttccacccccgcacattgagggaggctgagaattgagtcggtacaacgatttgttcatcaaaaggatgcctggtgtccctgggccaccaacaaatttgtgcggactcaagaagactgcatcataaccatcaacttcgccagacttcatgtctatcttcacataagggccactgcaaacatgggtaattgttaaatttaggtattcttttataaatgtacaagtgaagaaatataattaatgctagctaccaggcttaataatcctgaccatagctagtgaatttcaagtatgaggttgaacaattctgatcacggttatataattcaaaatgaagtgaccagtaagtttaagttgaaagtctccgtcaagaaaaaagagagttgaaactgtagacaaatgaagtacaagattgtagaaatttggaagaaataaaacattcagattaattgtttgtgccctgtcaaagtcaaaaataatttcattgtcgcaatgaactacttcactagacttttttggccgattaatttcctcaatcctccccaaacattagaatatatgcctcaagtagttcatcttggttcaacaagcaaacaaagatccacagagtctcagtactttagttcataccttttgcatatatagacaatatattcacataagtcaatcatcatgagatcatatgcttgaatgtttggatgagatagatatattgctgtcatatttaatgcaaagtatagaaaaaaactactagctagctgtttggtactgtcaggcaaattgaatgaagacattctgttgttcattaattaga

SEQ ID NO: 30448 - DNA, 11147 bp, Oryza sativa
  unsure (1)..(11147): unsure at all n locations
ttcccgtagaagggaaggacctcgttgaggaggtagtcctcgatgtagcggaggctccggccggaccccgtgtggtcggcgtaggtaagaaggcggcggccgaacggcgtgtcgaactcggcgtccttgccgatgagtgcgaccggagccactccaccctttgctccgccgccgccgccgccgacccctttttctccgacgacatggcggcgccgagcaggctcatcatgctgctcaccgcctcatccaccgccgccgcttcttgcagttgcagagatggcattctccttaactagctatagcctaattctgtatctaattgtaattagcaactgattaatgggattagcttaattagaagctcaatgaaagatcaatggcaatggaagctaagcaaatctctcaatttatcaatggcgagtagtagcttcacttaggttgaaggcaactaggtaggttgcatgggcagtggtatatatagcgccattgatgtggaattaattaaatctaatgcaatttttagaaagagagaagggtcaggaagaaaaaagaacaggaaatggggaggaagaagagggtagctgtttgatttaattaatgcgccgggtcaacatgacacaattgcttcttcggctctcaaaatatatatccctcctttatttgtgacccatttattaatggccttgaatatattccaacaccttcttgttccatcatatatactccatgctaagtacatactctcttcatctaaaaaaaatcaacctcgtactatgatgatatattctattcagattcggtactactaggataacgaggcttttttttaagatagagagtatatatactccctccagtttcatatttactatcgttcaagcattatgtgagttggatgataatatatgttgtttcagaaagattaaagaacatttttttggacaagtttacaccttctagttaatgctgctgtggtttccaacgtgggagaaacactcagtttaatatggacgggcagaaaatagacatcttaattaattaatcaattaatattactcattggcaaatgagattatgtccaaaattaataacaggaaacacggaactggagggagtatgcaaaacctaattaaccggagatcattgccttttcttcgcgagtcttcggatgctgttgatgcattaaattaaaagcgttgggctgtggattttccggttcaaaaacatcgatctgggacttgttcatacacacgacacgtatatatacagtcgaacgcgtgcgaaattaattaatattaagaaccaggggttttcaattctgaattcgatcagagtatcatttaatttcaatacgggaaaaaaaagaagaaaatatatgctggcatgaaaatcacaaggatctcgtgttgtgctgtttgtgtgcgtgtgtgttcctgcattcattcattttattccaaattcaactcctcgtatcgtacgtagctaggtcggtctcttaaaatagtcagggaatgtacgtgtgtattaattgtttctatgttgacctaagctctcttaatatcttgttaagtataggacacaaaaatatatctcagggcttatccgacaaagatacaaaatctaagccaacatgaacatagaattaacaaataacacatgtaagaaataaataattgtgagcaataaataattacgactactgcttaaatttaagattaccgttttctcctctatatataatcaggtgcgacctaacctagaggcaaggtatggaccggcctatgataaaattttcaccatctcgagccactatgatgaaaagaagtcctggcctataggctttcaaccccatgccctaggctaacgcctggggtgtctggattcttggtttgtccttgtatagattattattgggtatttacttcctttatctaaaagaaaaattaaaatagttttatagtaactcaaataaatatgagaacgactgatcgagtgaatacaattaattcactcaattggatcaaaatcacgatgtagatatcctaaaataactataatgacttagtaaactgcagcatgggccactcaacttgccaaggttggtttaaaggtgtcaccaatcttccaagctagcatatatagtattagatattggtcaacacactcatatatattattagataattacaatatgccttataatgcaatgaggacgagcatgggttactgcagagagagatgatcgatgtttcttcttggcttgttccatgcatggcaacatgcagacatgggtcatgggggtacacaagtgtcacacgatgatatcccaattagtgaccatgcatgtctactgtattgttgttaacgttgtgaaagccagtatttaaatttagcccttaaaggtgttatatggtgagtgaaaattgttacatagatatagtagtgggagtatgttgtttgagccatatatacttggcccatggcctaatataagctacctgaggcctagctagcttggccactgattattagatgtttgaaacacaccattgtggtatatagtataaaatgtagaataaatttcacaaaacaacgtatactttaaccaaactataaaacaatatagatttaagtcgatatatcacaaaactacagagatttaacaaatttatcacataacttcatatttaattaagaaaaagtatcatagaactatagatttaataacaaaattattacaaaactacaagttagcaccaatttaatagcaaaactgtagcatttataacttgaagacaacattagtgctaaagatttaaacactaaaaactttagttttatgacaacatcaatattaaatatgtagttttatcatacttggtattaaatctatagttttgtgaaaaaaattaatgctaaatctacaaatttgcgatacaataaaagtatatttagttttgtaagatatacccaaaaattacatgctattgtccttatttataataataaggttggcattcaaatgaaatagagtgtcccacttaaagaaagtttagtcagataattatactgttacggtgtttgatgacttgcttcaagtcttcaactggcatatatgcgaaagctcttatatatgcaattcattcttgaagcccatactccatgtagcaccagttaatttatctatatatactcatatgggacttcatggtgcccgggctccgaggtataaaacacacaaattctctccaatttttaaaaatttacaaattgtaagtagatatctaggtatatgaatttgattcatacaaatacctaacaacaaaacaactcaaactcaactttattttacaattcattattacatatctaacgaattatatgtttggatgttatataccttgaaccaaaaactaacaaaaaaaaagttcaaactcagttcaaacttgtttgaacttgttagtaaagaaattaatgttcatatctaaacatgtaaaaaaaattcatactcattcaaattgggtatatacttaatttgaatcttgaagcccatactccatgtagcacaagttaatttacctatatatatatatatatatatatatatatatatatatatatatatatatatatgtctatttattttttcccatgagttgcatatacacatgcagtcaaaatatgatcagtttaaaaaagcacatgttcttattttttaagcttttttttatcaaatagttatcatatattatttcatttgcccaacaataagataatcaagatatgtttctttatataagtgagatcggcatttcttcttctaagttggattatattacctacgtaaaaaatgagtttttaatgatatatttaattttgacatacatatattttagaaataaacctttggcataacttatttctaaaggcctcttttttgtcacaccatgacaaaaacaacaacaataatagagtatatacatcatgttttgaaaatgattctttaattgtgcctcttcatttatattttactgctgtggcaaaaacaatatatgtagtcactccactgccagaacaaatttgttggtggcctggtgccaataatactaacattttaaaattttataaatatctacattaaatatactgcagatcataagcagtagagggaggtcgaagacccctcctggcctatctccagttctccacaagtcgaatggggagaaaaacaacgaccattctaacaaattgttgtggaagccgccagtaagtcattaccagaaaaactatttttacatgcggccaaaatgcattttcgcagatggccaaatactccgcccgtaacaaaaggcctacgaaaataaacacggtcataagtccgcctgcaaaagttaattttcacaggtagacccattaagaggagaacctgcaaaaataattatgtgtcaaaaaaaaaaggaaaaccaatctattattcacagcatgcaaattcacattgaaacacatatccgtggtggaagttctcaaaaacaaatgtggaagttcacgttcaaaatcatattcaaatccacatctgtatttttcacagcaatttggaagtttttttttaaaaaaagaaacatcagttggacgccgtggtggtggtcattgtcgcagggaggatgccgccatcttcgccgaggatctgatccggaagccgactttctccaccatgacgacgaggaagacgaccacgagcagcgcgaggagggtacattgtcaccttgccctcgtcagatccatcgcccatgcgcgttgctgtcgtcagatccgccacccggcacatcgtcgtctccggatcccaccaccgaactccgccgaaccaccatggagcgccactgctactcccttcctcctcaccaccaccaccctcgtcacctcccctgtagaccccgccgccgaactgaggagagggagctgggacttaaaagaaatatctgaatgtttcaattttctttagcgtctatgtaaatgctaatgccaattttcgcagacggatggcttaagaagttcactaaaaaataaaggtatttttataggcgtgcctctaaagctgtgcccgcgaaaatagattttcccagacggccggtcattagacctctctctacacaactacacatgcggacaatcatagtaaaaaataaggtccgcgtggaaaaattatgtgttccgttgtagagagattttttttacatatattttgttaattcttgtggcaaccataggagcctccttgtaggtgaaattagttaattagttgctggagagttatttattactagtaaaaatagagaatggaccaaatcaaatagtattagatttccaaaaggacacaacttgtactagcagtagaaggtcagataaatacgctagctaaacggtcaaaatggatagacaattaaagcagtaaaatttgagactagttctatattcatgcatgcatgcatttcgtccagtcagattagggtgcactagttctatattcatgcatgctttacacccagtctgtcctacacctaccttaattttcttgtagttctggatatcattgaaattaatggccacaattaggactaactaaagctgcccggctgaatccctgaaataaaaactacagttatagcgcacagttttgcggcctgatctgattagaagtcagagctgccttttcttgaattccagtatatatactatatagtactatactatatatatatatgtaatgtcggcctgcagtcaaaatacaatgtgcgcaagtaccatgcatctccctttaatttctgcgctttctacttgaagttaattagtttatttcaactcttcttatcattaccgatagcgagagttcctcttactgtattaaacataaggctgctatctaatattagtacttgttgagtgatattacagaccatgaccatatgagaggctccgagaggcatcacatattaattttttaaaatatatttttttacacttctccaaactttagggacaaggaggtaccaatatttttaaatgtaaattttgacacttctttatactttaggtacaagctagcagataacaaattttacaacaaaaatgatatctaccacctctcagggaccgtgaatcttcttaaaattgttagggaagtatttcactattagctcgatctacatcaatctttatgagtgtagcaatatttatggcgccatattttttatcaaaaaatagccggcatgtatttacattgtaagtccctaaattacatatgtaattttagtgtatttacaatgtaagtctcaaaattacatatgtaagtactaacattacatatgtaaattcaaaaattacatactaattacatatgtaagtggggtgtaaatgagatgtaaccactgtgtaagtggctgaaaaaaatcgactgtaacatatggcgccatatttctagcaactccaatctttattggtttgttagaggttatgagagatttttcagttcgtaagagataccatattttctaatataaattttaatacccgctagagcatcacaaatggatatttcctaatgtgaattttaaaacctgttggagcatgaccaacagatatccaagatggtttcaatttctaaaattttaggctagcttgttagtgaaaagttggcttcaaccgttcctatagttagctggccaaaaagtgaaatccgcttgttcgttcttatcgctctccactactaggaggttcagttcccaatccactgcgatcaaaccatgcagagggaggggcacacacaatcgaggattgctaattcgcgcgcgcgtcagctcgtgcctcctccccacgcccttctttttttggttttttttggcgattttttcctttttttctgcttttttctcatttttttaatctttagcacacatgttttttcaaatattttgagttgaaggtttttaaatcttaacgtaaaaattttcaaatttgatatgaaggttttcaaatctgagtcgaaaggttacaaatctcgagtcgaaaggttacaaatctcgagtcgaaagtttacaaatctcgagttgaaaattttcaaatctgaattaaaagtttttaaaaatttatctagcaaatttaaattacgagttgaaaattttgaacgtttgagttgaaagatttcaaaatttgacttcaaggtttaaatcttaagtcgaagttttcaaatctaacttgaaagttttcaatctattagaaaaaagaaaaagttctcgtaggtactaattatgattagcactaatcactagtcacgccattattagtgccaatcacatggttagcgacgggggcacagcgtatgcgtcggccttcggagcgggtgcgcaacttccgctcaaagcgcgtacacgcacattaggaattccccacacgatcatgctagaggaggggagaatcggagatcgatggacttatgtggatagtttagaggtggcccacctagctttaatttagggggttaagtttaggctatctcttaaaagagggaaaagtatatcttttaatccttatatcctcgttatacataaaaaggacatttagggatagaactttggataactgtcgtgacgctaaaaaatattacgtcagctatcctatatatggcatcaaattttaactaacattttactacttaacaactctataattcctccagagggtcatagaagatgcatgatattcttctcgtgttatcttggcaaaatacatatctgatccggaggctggattaataaatactacatctcacaaaagtgtaatctagtatgtatgtatgtatgtatatatatatatatatatatataggacactcatatggggcaccatggtgcccgggcaccatggtatctaatgcacaaaatcactcaaatttttcaaaattttcaaattgtaagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccggacaccatggagcaccaaacaaatttaatatatatatatatatatatattagctatagctaaactgaaagaaaatggacatatatattgctcatttgtctaacctcagtcccgatttgcaacgagaactatttcatgtacatttcaaaaatccatacttgcaaacatatcttaatttaattaattaattttgcgtgagatcgatcctgctgaacgttaaataaattgtctgaaaaattattgatttgttcgaacatgtcatcttacgctagcgcgctatcataccgatagtcactacacgtgttaattactagtaacgacccaattaattagcaagttcagcagccaaagctatggagtagctagctagaaagttcgcatgcagtatatatgcaaatcatagtactggccgccattaatttttcttgcatatgcacgccactctttgtgacgcttgatttggccaaattagtattacttcaacatatttggctttgacattgtctccggtttatgcatgcaagtagctagtttgcattagtataaacaaataaataagttcaagtactgtaaattagactacatacattaatattgatttatctgattaattcaacgatgttttaagtattagccgatcgagaggcagttgcaaaaaaaaaaaaacatcggctctgattgttttatctatagaaaaatgaacagtcatgtagaaaaatgaacaaagtaaaacttgtatgtatatgtactagtagtattaacagtataaatggcaaggatttaagaaatagaatgcgatcgatgaaaacgacatacaagcaaccctaaattaaaatttaagaatttgttatggttaataagtcaataaacgaatttcgaatggagctgggctacgtcgtgaagaaaacttctggggcatttgtgccactcagtttttcaattacgaatgaatgccactcgaagaacagtgttctaatggcattttttaattttctagcaaaagtcatgtaattaataacggttcaaaccaatgctaaatttacaatcgtcccgaaaacgtcgttgatatcaaattatcaacatttcatctggctgcttgaattatttagcagtatctcagtcttttaatacgtttggttatctgtcttttttttaaaaaaaatgtaattattatttatttttgttatgatttcatttattatgaaagacttttaaagttatgacttataactttttagtaaaacaaatagtcaagttacctgtgttacatattaaaaacgaagtgagtatccgattattcgaaaaacgaaaacaaaaagtctctgtctcagcgcggtgggatgggctggaaaaacatgttttccgcatagtatgaacgttgacagttgacacgcgttttcttgagcctaatagtaaaccaaagaaataccggccggtcaatctgtcggcgccgcgctggctaagctagcacatgctccattcagcaaattgttggtaaggcagaaagaaattaagcccaatcgagggtcaacagaaaccggagtttgacatgtattaatttcggttgaaattaatgaaaaaagaagaaaaaaaacaagatctagctgagttttttttttaccactatcaggttcttgatgaagatgtgtttgagttgagaagagtcatgttatactccctaatattctttgaataaaaatccatttagctgcatcttaaactataaattaaaaccggataactaattaacttccttaaatttattacacctgatcattcaccctagctagagtggatttggaggcagtgattttatttaatttgcatgtatgtcgatggttttacgtgatatttttcacgtatatactttttgtcagcaaggcggttttaaacaaacatcattcatgtaactcttcagtacgtgatacttagtttgagtaccgtgtaacttgttttcatgtatttcttttatcaacactatatatttaaacaaatatcatttataaattgctctctaagatttatactccatccgtcccaaaatatattagtcttgtactggatgggacacatcctagtacaataaatctggatcatatgtcccatctagtacaaggtttctagaacggatggagtaacttcttagggagcaaggggacactcgcacggtctacaaggccaaactatcaaaccacacattgacgactttatagagaacccatatcatatttcatttcttttacatatacacaactaattaaggttgtatttttttttctaccgtgccgtcctaaggacatatagttttcattactgttggatagacggggacataggtctccccaaggccaaactatattaatgtgaaccatgcatgcattgacgaattaactatatactcatattgttcatattgtacacatttattttaattttttccattgttcatgtatgcctcctagaaacatgggacatactcgatttcacaatcaaccgtacgttgaccatcacacacaggcaaggaggtgcaagtatttttttttccacgtatatattttctatacgttgaccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30449 - DNA, 623 bp, Oryza sativa
gcagcaatggcgaggagggcgccatggctcgccgggattggggccgtgccgttcttgatcgtcgtcgtggtggcggtggtgggcgccgccgtgccggcgatggggaggttcgtggtggagaagagcagcgtgagggtgctctcgccggagcacatccgggggcaccacgacgccgccatcggcaacttcggcgtgccggactacggcggcacgctcaccggcgtcgtcgtctaccccgacaagaaggccaccggctgcgccgagttcgacgccaagttcaagtccaagtctcgccgcccggtcatcctcctgctcgaccgtggaggtaggagattgatttcaaacttccaatgattgattcaattagtttgtgcttgttttgatttgcataagtatttttcaagaaatttgtgttccaaagtctgcaagtctgaactgaacaaacttgagaagtagtattagtttttgatgattatttggattttgagagtttggtttggtgatgatttgattccaatgttctaagtcatgccaatttttgttctgttaatgggttgtgtcaatccaatggttagctagtccactgattaaaaaaacaacaaaagaaatggttagcaagagag

SEQ ID NO: 30450 - DNA, 231 bp, Oryza sativa
agggaggctcgccgcacacgtggcgccacaccattggctcccgtgccaagcctccctgctataaaagcacccgtcttcccaacccctcctctccgccgaacaaaaagcattcgcatccacgagaccactcgaacccgacccgcctcgccgccgccgccaccgaaggttagggttgccggaattttttctcttcctcttcctctcgcggttgcatttctaggcgtgctcgat

SEQ ID NO: 30451 - DNA, 455 bp, Oryza sativa
ttttggcaaatttgtgctccctatcacttttacaagagatgttcttcttgattaccgccaaggtctcactgccacgagtgaagctatatgtattattgaacaaactccacacaatcagcccacaaggaacaatcggttttccatctgctcgaggttttctcaggttcacaggcagatgtatggtttgacttcgcagcgtcccttagctgtccatcatttaagctcttcacatatctgaatttggaaagagttatacatactaggtatcaaatgcatgttattgttatcataaggcaaaaaagtcataggtttcattgttgccagattggttaggaaggctaagtaatcaaattcttgattgaaaaccttgaatagaatcatgtcatacctcctatgattctggtagaaattatcaagttgatagtatacaaaaattggctgattcatatcctctg

SEQ ID NO: 30452 - DNA, 71812 bp, Oryza sativa
  unsure (1)..(71812): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagctagtatttttgcttcttcttgtgaattgtattctgagaacaataggtcatttgcaatttgcttcctcatgtttgggatatattctggtctgatcatatctttcaagtgcatccttgggttccaccattccatacacttcatagcgtagattccgcaatcatgccttgatgagacaaaaacaaaaataaatcatttaagaaaaacaaaatcatgggaaaaaaagggaggagttttggacaaaaaagaaaatgatatgtaatttggggatgtttgttggggttgataggtagttacccattgttttggcgagtaatttgtgggtattggatatcaaatttactaaagtctttctccacatctgagaattcttcccacattgcaatgaatcctggtatctgtgtataaacaagaggagcatgaaaaaaaaaccagaaaaaaaatcagtggatgcgtctataaataaattgtatggaaaaaaaagaacaaaatttgtatagctcaccagtagcccttgaattttcttatgatatttgctgttttcatcataaatggagtccaggaagacaaagtgatgccccttgatgtccacagtaaacacaaaccaatgattgtcatacaggcatgggaaaataagctacataacataaaaaccaagggggcatcactttatgttaatcacacacacaaaaaaaccgatcaattttatgtttgaaaagaaaaatgtacaaaccaagtcatagtagtgcagaggtttcttgttcctagcaagtgtaaacgcttgtcttgcgcaattttcatagtcttcctcttttccagcaccttcccaattcttcaagaaataaacctgtggaaaaaaaggtagagaattttgaagtgatacaactggagatgagaaaaaaaatgtatgtgatacaaagtatgaaaaaatcacatacactacttctgtggaagaagtaaaaattcatgtattcattttctttgttattctggtcgttggcaatcttcttggcatacgcgttgaggacatatgtatccaccactccccttggtgataaatatttagacaatgatgaccatgtgacttttacattgtccattagaactgcaaatttactgtaccagaaataaagaagataaatgcttttagtaatgcttagtactcttaaggcagaaagagtacaaaacaaaaaagttcagattacttaatttcagaaaattggaatagtcagcacaagctctttgttatgcatattatgaaaaaatgcaaaaataatttgtaatgtcatagatttttcaccttctttgcatgccttgttgtgttaaacaaaaagtgataaactttcatttggttgttaatgcaaaattcagctgctcctaccacttcaggattatcatacaaaatataaaatctaaagcaaaagtgggaaattagtgcgacatgtatcacttcagctgtgcatgttcgactctgtgttatgaacaacgtttgtaaaaactacagaaaaacaccccacctcccattcctttttaaataaaaaatgcttgaaatgatcacaaaatctaaaaaaagcaaatgtaaaaaagcacccattataatgttgttttgtgacacttactttttatattgttgcgtctcaccaatgctgagtatgttgttgtagtgattgagttcagctgccgagatggtttggtgccgtgtgtagttgtcatatggtgagctcttgtatttacttggatgtacaattcttttagggcgataaagattgtgtctggtaccagaacagttgccagaagcatttagtgagtcgatgattcttgtcattgaatattgtctttcttctgtttgagcatgttgatttggttccctcatttatgttattcttggagaattcatacctatattaggtgatgattgtgaactctgcattaaaaaataaaacaagtgaaaaatgggaaaaaagagaatttattgtaataatgtttaagagtataagacatagttttatgtcatgctgattgaaaaaaattaagcaaaaaattgagaggaaagtacttacaatttgtattaccttttttgtagcaggtgtccttgcagaagtaatgtttatgtgcagtggtgtttgagggctactttgctcattgtttatttgtggttgctgcaaggatgaaaaataaaagtaaaagaaaaaggacacctgaactgagaagaaaggatgtgaactcgaaaggaagtggtgaactcaaagaggtagtggctctgaactgagaagatgatgctctgatcaaaattgcaattttggactgaccttccgaaaaccaacaaacctgttaggttgtgctgttatatttaaagtttaggatcccaagatagtattatatttttcaaactgccagctttttgctactagtttattcctccaatatctacttctatactactacctccatctcataaatataaaaagaattattccttttttgcataagattaaggatagcaacaaaaatactataataccaatgttaaaatatcagaagttcagaaattgttcagtaaggagcatacccaaaaaagggttgatgtttgaaaaaaaaagacaagtaaaaaaaatcagaggttattaccgcacgttgttcaaccatatcgatgttatctgatggttcctcttcatataagaattctgcgaagtcatcttggtactcgttttcatcacagtgctgtccctcaagcctcctattccccatgtttgcagtgaagtttgctaacaaaaatcatccacataaaaataaaaaaaagtaacaagaaaaaacatctaacatgattgtgcaaatataaatttggttagttaatctttttattcttcctagacattttgattcgccccccttgattgttactacttatgtctataaaataaattaatgatagtacaaaaaaatcattttatgtgtacagagaaaaaaggtcaaagttttacctgataaatgttgaactccaactttattgtttatgcatgttttgggtgtgttcatgtacctctccccctgcgtcacctgaatgctgctatgttcaatgtccatgatgtttgtgcctgatgttgtttgggacaagaagtgcccaaggctggcacttttgtttgtttttgatttatcatcaaaatgatgtaagcattcaaatttgggttgatgtgtgtgagttacatgagaagaaatgaaaaagttacaaatcgggatagatcaaaaaaataaggtacattttttgtacattaaagtgcaacatagatataaaaaaatgttagtttatcagtcaatcaatgctgcaaaaattgacaggattaaaatcaaaacaataaaacaaatcagtacacagtactggtagaaaaaaatgtgacaaaccaaaattttatgacatgtggagtttagattttgttcttgatgtgtataagataagatgacactgtaaattaaaagatgacccaaaaaataaaagtgatttagaaaacacctgtatgctctagtttcatctgttttctaaaatttgaggtgttttctaaaacaatgtctatctgcttctaaaaaaatcatccacacatatataatatgtacaaacaaaattatggaccagtgtacaatgcaaaacaaacattatataaaaaaatagaggtgtataatacacaaaaataagagaaaatgaaaaaaaagcggtttgttgctcacaaaacaaacactaaaaaaaactaaaaaatactagtgctttaaaatgcatgatatatgtttgatacatttgtgctcttgtttggaatgttgtctgattcatcttgtgtaggatgttggctcttatgatcttctgaagagtttgaataattcacaagaatgaacttcgtcttatcctaaaaatattaaaaaagcataataaaaaaagatataaattgattaaaatcattgaaacaaaaatggaacaaaaaaatattttttttaaaaaagtacattatgtagtcgaaaaaaatcatttcctattaccgttgtgtgacctgttatgtcttcaacatcatatggaccctctatatcaataacaaactatgtagagttgctttcaagatccttggtgggctgcacctttttttgcaaaaaaagaaagacatgtagtgaaaagccagggggaaaaaaatataatggtttgaaattttgactcttgcctaattttgaattttacctcctcctttttggctggtatagtacagataggttccacgaaaagaccatccttgtttgattcttccttgtctggttgagtactgataggttgtgttgcttttaagggctgaaaaaaatgaacttatattatgcaaacattttttgtaattttttaatccatgaataatgtattgtgtataatgatatgacataaaaaagtaatagtgtttttacctgtttccttactgctttgcgaatcttttggtcagaagaattttttttcgatgggctaattgatacaaccgacaaaggggatgctgaatgtaatatcttagctctagtcctggatgccacagagttgtttgattgctgactacaaacaaagtccttactggatgcttttttatctggaaaaggattgttttagagtgaaattatgctaaacaagacattgcttaagcgtgctaaacaaaagataaaaacataccagaaaagaaactgggaaaaaaaattgacaccaagaaacaaacccaaaaaattatgtttgtttcttggtctcaagtaccgtattcgcctataacatgaatatttatgggagcatgacacttttgttacacaaaaaaaatgaacaaaacaagatattgctatagtacaaattgaacaaaaaaaacctgcatactgcgtttctttgcaagcgttgtccttgttgctgtttgactttgagttttcttgttcagtttgttttgatggtggtgtggtttgtagttgggaacatataacattctctgaaaaaaagtttgtttcagaaaaaaagtattactgtcaaaacagatattaaagaaacatctaccagtaagactgcataaaaaaatggagtagatggtgtgcagtgagattatattttcagattcaaaaaatttcagcttgcaaagctacagaccgtggcatagctgaatcctggagcatattatagcttaaaaaattggtgataaaaaataaaactaatcagtgtgatccatgggtagcctactggaacaaaaaaaacaagatttatgtgaaaaaaattgaatgaacaacggatagttgttcgctttgaaaaaatttaattgagcaatagactaatagggctctgtatgaacatcctaatatatcttctatatttgtgaaatacagaacatatatttgggcctggtaacttatggttctggtaacattgagtactgacacagaactaggctatgcttagtcatgttccagattttaaagaaagtatacatgccaagtaaaaaaaaatgctatagttcagaatgaacattttttttggactggatagattgatattagtggtagggaaattttgcttagcattggcacaaattatttgatctgttgtgtttgtgtgctatttgtctaaaaagaaaaatttacaaactaacagaataataacatatacctgtagggggtgctcctttgctagtgctggtgttgttgatgttagactttgtttcatgctctacagttgattttgtttgtggtgtctttggtagttgggaacagacatcagtgttgtttgggtggttttgttctaggggtggggcattaccattatgtgctacattgctgccaccctgctttcttccctccttgatcttctcttctctactcttctcttctcttgttatggtgctatctttttgtgtgaataggcttgcttttgacatgtagacgcaatccaaaaccttggcagctagttgtgcattttttccgtatgttgtgtcagaaagttctcttgtgaaccacttgcaaactgtggaaatgtcatcaatgagctacatttaaaaaaaaaacacaataggagtgactatattggagcatacatatacaaaactaggaaaacaatttttttaaaaaaacagagcatttggaggagcaaaaaaattacccttgggttaaatgatttgctatggtattgctggagagcatcgctgcatgacatgttgctattgttgccctgttactcaatgcagcgggcccctgaacatattgcgtcataacttaatttcttcattgctttgatatgtgaaaaaaaatagagtatgatctaagaaaaatgaaacaaattgacacaaaataaaatttttctgttgtttttacttactggtcgctttccaaaatctcctgttttgcattcatccatttttgaatactcttttatcattccgcctttccaaacagagattcttggtggtggaccaattggaatatttctaaatccaaaatctttgaaatcaagataattaatctaaggaaacaacacaaaagaaaaaaaataagtcaatgtttagaaatattatgggtttaaaaaatgacttaagtaataaagaagagaagcatacagcaagtaagtgtccgcagccgccaagggttttttgtgacatcctgatttttgtttcagggtttataaattatttaataaattaataatagaatttatattaagtgttctttaatttacaagtgaagtaaaatgtgggaaataaaattttctaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggatagataaaatttcattaaatactttgcttaattctataattcctagatttttctgggatttatttgagctaaggaagtatttttaataaatggaattgcatttaagaaataatttaaattgaaaaatgtttttaaaagtcttcttttggctttgggccgaaagtcggcccaaaacctctctctttccttttctccctccccggccagttggcccaagtcggcccagtccgcgccgccgctctcctctctctctcagccgctgacaggtgggtcccgtctgtcaggcttgtcttcctcctccggccgccgccgcccgaaaccctagcgcaagccgccgccgtctccttccaaattcggccgcgtctttccttctccggctgaatcgtttgagggcaaatgatccttgagatctcctcttccttttctcttttggaatcatcgcctaattcggtttggaaactcgatggattcgagatcgaatcggattcctctctcccttccgaaccctaacctttcttctcgtcgccggcagccgtgggcctccgtcgccgctcgctagcccctttaaaaggacccccgagctcccctctacccgtcgcctcctttgccttagcctgccgtcgcgtctagcgccgccttcgcgtagccctagtcgccgccgtcgttgccgtcggttcagccgcgccgcgccgccgttgcagccgccgtcgtcggtcgctgttgccaccatcgggatcgccaagttgtcgccgtcctcgtccgccccttcgccgccgccgaagaccgccgaagcaccgtcgccgtcgtcgacccgatctccgccgccgcttcttcctcgtcgccggcgccgtccgttgctcttccgccgtggttttggtcaccggtgagttcgccgcgtcgccctctacccgttggtgtcctccgtttgcgtcgtcgtgccgtcgttcgccggcgagcgtgcgccgcccgagccgttcgctccgccgagccgccgccgctgtcggtgacgtcgtcgctgacgtcatcgtcgccctctcccgtgagccgccgtggacccattcgatctcggccgtccgttttggatagggttgatctcggccgttcgtttccgtgaaccgctgccgtgcacccggtccaccgcaaaccctagccgctgacgcaataaatccccttttccttttcaaaaataattcattattgcgtcataattcaattaaaatccatataaaggttttaatccgatttaatctttaaaaattcataactaattcatttgaactcagtttaatgtggttcaagttgcaaaaattataaaataaagatctacatattaaatttgtccataaattgaattaaatttatttaattctttttaaatgggctttaaatagatttaatcttataaaattcataataaattcatatgaaatcagaatgaggccgttcaagtctcataattcatctaaaattatgatttacatgtttgtttactttttatgtattgtttatttggtttttattagtctttttcttcgttttgcgtgttagcttgtcgtttccgtcgttccaaaggttcgcgagtgcgtcggaagtgttcaagaagattaattgaagaccgattattgcaaggcaagtcacacagatcctaaacacaatcctttgaacatgttgatcctatatttaaattctctatttatttcaactgtgcatttattttcgaatgtcattgggtggaattaacctattctttgttatggcccttttgttcttgattactttattccttgatacctagggttattataatttgactagttgagctttatatatcagttcaactagatattagatgtgattgcttagccatgctcagaaacattagcacactattgggataacttatgattcattattatttaatgatggtttaatgatagttcacgatggtcaatcgtgattggttaattaattacttgccaactaaaacctgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattacggagcaccagactgagaagtggcggagataagcccacgggggtcgctggggagtccatgccttgttttataagggggtgattatgatccaggaatggtgcactgtggtgagttgtgttatgcagagggtattgtcacagcctctatttgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctgataataatttgcttagctcctggtttggagattagatctgtacagcccggtatggttgttcaggatggttgggcctgtgcagcatgggtgtgctgttcagtgttgattaaaatttctgattaattactccactgttttacttctcttaaatgttttgctgaatgctgcttttgcaaatgagcctatattaggccatcctttggtattcttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacatttttgatgtttgttcctttgattttctctccttttggaacttggctatgtatgtcataagccattcataaacaaactttgaccagttccactttgagctggacttgacatcaatcagaggttcaaggtattttgggttggggtgagtgcctgagttggggcaaagaaaggttgatagtgcaaccaccatgaaacaacgtaggacatcatcttctgatagtttgttcacacccttgtcactaagcaacttagtgccaaagaaggaaattaagggttttgtgctcccataatgctgatgaaaaaaatgttttcctgcatcattgtcatgcttgatctctaaacctccatttgggataccaagtatgaagttggtggtgtttggattgattggtatggatctcccattgacaactatatctgagcagctgacgtcagtgtgactagctatccatttgacaaaagatagtggtatagcacacctttgaaagtttagaagagaaccaaaagcagaattctcaataattgacctttgctcgttgctgagcccttcaatcaaattggaaaagtatgtgatgtttagtctgcttcttggttttggggactctgcacttccagatttatcttggtcatattcaagttttgtgcaacataaactaattagcatactgggttgtggaaaaaaatgtttaggaaaaaaagacagaaagcgataccttttgtttttgtctccttactggtttgtctgacctacctcttttccttttgatcgatcctgaaaactaacagaggcaaaacaagtataaagttattgatagctgtctgtggtagtagaaaatgatattttggaaaaaaaaggaagaaacatatataccagatctttttttgagatgtatttgtcagaatcgctggtttcttcctcttctgaaatagagttggcataatcggaatctgccaccttgttgtccgacttgctatttgatgaacattcatcatctgatgatgtactgtcacttgccatgctgttaaaaaagaactagagaagtaagtacattaaaaggaaaaaagagggatcttgtcaaatgtcttgatattttcatgtgtaaccaatcaaaaccaaaaaaaaaaaactctcaatgtcctgataggctgctaagccacatgttaaactgtgccaaaaaaaaagaaccagtgccaaattgaaacaaaatgtataattgtgaacccgtttgatacccctcgcacgaaatcttaaaaaaaaagcaaacaagatgcgagtggtatcttggtgctaactcattttaatcagcactgaagaatttttagcaaaaaccaacttgcatgaacttaacatcggcaaaaaaaataataataaatgttttttgaagctctataactgcaaattaatgtgttgaaccaaaatttgattacagttacatatacttgataaaatgtcaactacaacatcttggtattgcaaaaatttgtgttaactattcgcatgattatagttgcacaaaatcataattaaagttgcacgaattactaaccaaaaagttgcacaacattaaaaaatggcaactgtaggaacaggaaggtgcaatttttgcatataaaaaaagtaacaaaactggatggatatgacattattcaaccgcccacatgtcctagcttaccggcaaatcaaaatcttagcagaagaaaatgtattcttcttgccctgcagcaagctcctccccccccccccggtagaatccaacgctccctgaaaacaaaaatcgtagtgagctactacatctgagcatacaatcagtctgaagttgtgcttgtttataaccaaaattaggaaaaaaatcatatagtagtcagctaaaaaagaattagttgcacaatttaataattgaaaattgcatatatttataacataacttgcgcgaaatgtatagtattagtttattttgctatttggactatgctgctgggatgtagatggttcaagcgggaaaaaacagtacatgagaaaaaagaggcacacttgctgtcgtgtgttgatgagaaaaaaaaagatacaacataaaaagtagtatgggttgcaaaaagcaaaaacacatgaaaagttggacaaaattactaagaaaacaagttgtctaccaaaaaaagtccccagttgtatgcatgttttcccaaacacaaacgctatttatcaaagtaaacggaaaatttggctcaaaaaacattagttgcacaaacttattacacgacttgcacggaaaatcaaaatggctactacaatagtcagggagtgcaactagcatagatacataattttcagaaaaagaaacaatgaaaattttaaggccatgtgctgatcgaaagcataggttttagttaaggccatatttaaagcagcaaataagtgaatcattgatacaacataattgtacatagtgtatgaagagatatgctttatactgtcaatttatacagtactatagcaagttatactgtccatttattctctatattttagtttcagattaatcctactgttaacgaccaaatttggtaatatcagcatcggaaaaggagattagatcaaggtggagtcgaaggcggagattgatctgaaacagagcaagaatcggctgaagtccggatcggctacgattaggatcggctgggtctgagtcagactaggtgagccgatgtagccgattctgacagtataatttggtgtatgacattgggttgaattgaggtacttcaagatgattgccgcacatggatagagtcctgagaaggcaattgtatctattaattaggatgttttatgtaacttccttagatatatgtttgggcaaaagtctgccgcaaagtcggctagcccaagcactgttaaagaaaagatccagaagttggggttgactgacgtcaatgaaggaaacgtcgtgcccatcgatccagagaaattcacacctgaacagaagaaggattttgaagcaatgttgtagcatgcccgggatcagttcttgaactcattcatgcagacccgcaagggaacattggttcagaagtataaagtaaaggtagttgctgatgatcttgggaccagttcttccaaaggtgaagacgggaaacaagctccagatggctcggctcaactgagtgacaaaggtgctaccgacggttctctaggaagtcaaggtgacaactctcaagggatccatggagttcaaggcgatggagtgcatagagttcaaggtgatgctgctcaggggttgcaaaggggaaatcttaatcagaatagtgatgttgcacaagattttttcaataatttccaagaccgggtcgactatgctgtgcaccatgctttgatcaatcagtctggggtgttagtcaataccttatcaaacatgatgaagtcaatagccgatggatcaatagctgagcatcaggctgtaggcccagtttatttgcaaggaggtgtctttccaaattatcggctttgatcactgatgcccagccatctattcagccagtttcccccgtcgcaccatcatgtcagccgacagcgccggcatcgacccccttacctactccgtcagcattggcaccaggccagctggtgaaccctcagttgttaatgagagagcagccacagcatagtgggcaggttgtgaatcggccgacgcaagatcaggttgctgccatgtttctgccgcctcaacctgctgttgatccaatacagcagcagccgattcaatagacactcccgattcagcaggttgtacaacagattcaggtggccattgagggaggcaggattaagtttgatgattccaaaaagccgatgagggtcgatgataaccaatttcccgttaacatggtacacaaagctggccgaacagctgatccggggcgcatgaggggttatcaagtaagttcggctagaattataaacaaatgtcaaaggaaatatgacaagcaacaggaaaggcatcatgaagaagataatggtggctttgatcctcattggggctgtgagttcttcaggttctattggaatgaaggtatgaggttaccatctatcgaggattgtcctggatgcagtgatgttgcagggggttcaagccgattgtacgatggaggcagttggccaaaacagacaagagtgcctgttcatcagagattgggcccagtaaaccaacgtggtgattcggaatatgacgaaaataagaagactcaatggtgtcctcctgttatttttacgaagaatcagaaaagaagggttcaaagattgaggagtagggaacgcttccaagaggtcgagcaagaaattaatcatcggctgaagaaaccaaaaccgaggcaggagtggagtgttaagaatcaggctcctgtagccgatgatgttgcagctgatgaggcaaagaggttggcaaaaggaaagagtgttgtgacggcaccagttaacatggtttttaccttgccagccgaattcaggatcggtcaagccgatgtcgacgaggtggaagaggaatcggctaagttggttctatcaccagaacaggcagtgttcgagaaacctgaggggacagagaatcggcatcttaaaccattgtatataaatggctatgtcaatgggaagccgatgtctaaaatgatggttgatggtggggccgcggtgaatttaatgccttttgctacgttcagaaagttgggtagaaatgccgaggatctcatcaagacaaatatggtgctcaaggactttggtggcaatccatcggaaaccaaaggtgttctaaatgtgaagctgacagttggcagtaagactattcctaccacgttttttgtcatcgatgggaagggttcttacagcttgttgcttggaagggattggattcacgccaattggtgtattccttcaactatgcatcaatgcttgattaagtggcaaggcgacaaaatatagatcgtaccaacagacatgtcagttaatgttaccagtgccgatttagctctttgggagatggatggccttgattgtttatctggaaaagtttggaatggagattttctaaaagtgtccgattctgatatacagccagttgaagatggagaacccaagctattattttgagggcgtcgtggagggttcaagtgtctacactaaggatacggtagatgatctcgatgacaagcaaggccaaggttttatgtcgaccaatgatttggaagaaatagatataggtccaggcgatcggccaaggccaacatttattagtaagaatttgtctccagaatttagaaccaagctgatagagctcttaaaagagtttagagattgcttcgcttgggagtattatgagatgcctggactcagccgatcaattgtagaacatcggctacctatcaagccaggggttaggcggcactagcagcctccgaggagatgcaaagccgatatgcttgaacctgtcaaagctgagattaagcgtttatatgatgctggttttattcttccttgccgatatgctaagtgagtttctagcatagttcctgtcatcaagaagaatggcaaggtgagggtatgcattgattttagagatctgaataaagctacaccgaaagatgaatatccaatgccagtagccgatcagctggttgatgctgcgtcagggaacaaaattttgagttttatggatggaaacgcagggtataatcaaatttttattgctgaagaagatatccataagacagcttttagatgtcctggtgcaatcggcttatttgaatgggttgttatgactttcggcttgaagaatgctggagctacatatcaacgggctatgaattatatttatcatgatctaatcggctggctggttgaggtctatattgatgatgtggttgttaaatctaaggaaataaaagaccacatagccgatttaagaaaagttttcgagaggaccaggaaatatggcttgaagatgaatccgacgaagtgtgcttttggtgtatcggctggccagttcttgggatttcttgtccatgagaggggaattgagataactcagagaagtataaatacgatcaaaaagattaagcccctagaaaacaagaccgaattgcaggagatgatcggcaagattaattttgttcgaaggtttatttctaatttgtccgagaaattagaaccttttacaccattgttgagattgaaggccgatcagcagtttacttggagggcagagcagcaaaaggctttggataatattaaaggatacctgagttcccctcctattttgattcctccacagaaagggataccttttagattgtatctgtcggccggtgagaagtcaataggctcaatcctaattcaggagttggatggaaaagaacgagttgtattttatctcagttctcgactcttggatctagagactagatattctcctgtggagaagttatgcttatgtctatatttttcatgcacgaggttaaggcattatttactgtccaatgaatgtactattatatgcaaggccgacgttgttagatacatgttatcggctccaatattgaaaggaagggttggaaagtggatattttccttaactgagtttgatcttcggtatgagtctccgaaggctattaagggacaagctgtagccgattttattgtggaacatcgtgatgattcaatcggctcggttgaaatggtgccatggactttattctttgatggatcggtgtgtactcatggttatggtatcggcctagttataatttcccctaggagggcatgttttgagtttgcttatactattacaccttatgcgactaataatcaagctgagtatgaagcagagcttaaagggttgcaattgctcaaggaagttgaagccgatgctattgaaaacattggggattctttgctggtaatcagtcaattggcaggggagtatgaatgcaagaatgatacgttaatagtttataatgagatgtgccaagaactgatgaaggaatttcggctggttactttaaagcatgtatctcgagaacaaaatatggaagctaatgatttggcccaaggggcatcggggtataagccgatgatcaaagatgttcaggttgaaattgcagcaataacagccgatgattggaggtatgatgtgcgtcaatatttacataatccatctcaatcggcttctaggaaattaagatataaggcgttgaagtacattctattggatgatgagctttattatcagatgattgatggagtgttacttaagtgcttgagtgccgatcaggctaaagttgcaatcggcgaagttcatgaaggaatttgtggcactcaccaatcggcccataagatgaagtggctacttcggcgtgcagggtatttttggccgacaatgctggaggattgcttcagatattataaggggtgtcaagattgtcagaagtttggggcaattcaacgagcgccggcgtcggctatgaatcctattattaaaccgtggccatttagaggttggggaattgatatgatcggtatgataaacccacgatcaagtaaagggcataagtttatattggtggcgactgattatttcaccaagtgggtggaggccattcctttgaagaaagttgattctggggatgcaattcgatttgttcaagaacatataatctaccgatttggtattcctcaaactattacaacaaatcaaggttcaatcttcgtgtccgatgagtttgttcagtttgccgatagcgtgggtatcaaattgttgaattcttcacgatattatgcacaagctaatgggcaggctgaggcatctaacaagagcttgatcaaattaattaagcggaagatttctgattatcctcggcaatggcatacctggttggcggaagcattgtggtcttatcgtatggcttgtcatggatcaattcaagttcctccttataagtttgtttatggacatgaagctgttttgccatgggaagttagaatcggctctagaaggatagagttgcaagacagtttgacagccgatgagtattataaccttatggccgatgaaagggaggacttggttcaatcgcgtttacgagcccttgctaaggttaccaaagataaggaacgagttgctaggcattataacaagaaagtagtgcctaaggatttttcggaaggtgaacttgtatggaggttgattttgccgattggaactcgggataacaagttcggcaagtggtcaccaaattgggaaggaccgtttcaaatctataaggttgtgtctaaagggacatatatgttgcaagggcttgatggtgaggtttatggacgagcgctcaatggcaaatacttaaagaagtattacccaagtgtttgggttgacgcatgatcggctagtgttgctgatgcatgacagccgatgtgttttacatcgtcttgagatggccgatattgttatatcacccttagtcatttttctaattgtaatcggttatggtttgccgatatatataatggccgatattgttatatcgcccttagttgtttttctaattttatcaatgttgttgacattataaaattggggggcacatatatacaaaaaatgaaaaataatgaaaaattagaagttatgttaatcggcacaaaggattgttcaaacagcagggttttaaggtatcttagccgattacaagaatttctaagtcctattacacaaaagttattgagacaagtactgctggatagccgaaatagctctttgcctaatttgttcgacttcttcaatggcttgggcatcctgagcatcagtcctaggaatgatcttcagggacttggttaggtcagcaacattattgatagctgatttgagccttgctttttgctcttcgacagattttgggagatcggctagctttttgtgctccatatccaattcagcattgcattcttcaagctgtgccaagagatcgatcttgcgggcttcaagccggtcgatattggatttgatcggaccttcggatagctgatcgagtttgatttttcttcatgcacaagctgccgattgacttggattgtggcttcaatctctttacgctcacggcgttcggctaatcttagcttggctttttctagtttaaattgatgttgctcaagataagcggctggagttaggacatcggccagttcttcaggaattagagcttgaacttcgtgcaatcgtatcctaatcgatccatagtcgaccactaagctatccagagaagaggcctctagccgacgcgagatatcttcaagtgttctctttgcatcgtcagataagggagctacagctttgcttgaagtatcttattctgcctcatcaagataatctttgatatcaaaagaaaagagatcggctagaacctgcaggtataagttcagaaagtttgagagctaagtcaatatagtcgatctaaattcttgcatcaaaggaaaacttactgggatagcaggagcagccggttgttcttcttccacaatatgatgactccccacggccgatggagttcggtcactcgatgatttttgtacaggagaagaaggagtaggaggaggctataaaaagacaagtgttagacaaaatcggctgaaatcaactagtaaaattgggagtgtcttactggtggagctggtttgagaattggtgctgccgatttcttctttatagcagttttcttcttctgcaactacaaaacctatgagtagtcggctgaaaaataatgattacaaaagggtttgcaaggaaatatgttttactctgaagaagtgagtgggggcagaaggagttgaaggtatctgcttaggcgaagccgatggtgttttttcagtatcacttacttcggctgcagcctgatcaacgtcatcctcaatatcttcttcatccagagcttgttcaatggatggatccaaagcaggcaggtcgtcggttggcttggttttcttagacttggcctttttctttggagctagagtcaaggtgctcacagctgatgatctagtttttcttttcttggttacatcggttggtttcctgatggcgccttggaggagggttgagaccttgggggcgtgatagccgatgacagggggagacaatccgcctccattaggaatcagacctggggcatattcaatgttcctaccactattgctctgatatttaggggaggattctgttgtctaaaaaaaaggaacaaaagattagtcaagtaatgaatcggctaaccgttatgaaatttagtgatggcaaagtttacctggggtatgacgtcagggaatagatctgtcatgtacattgtggccaattgacgaaatagatgcaacttccattcaccctaccatctgtcaaagttcctgctcctgaatccagctaactcaatattgtcgatactgcctaagggaggtccttggaggttaagctgtcgatccatcattagagttgaagaaatttctcctcagcattggatcttgtcagcaaagaataagccgattgggagttggcctaatccaagttgtctagctgaactcatagggtgatagaattcataggagacttggatatttcttccttggtgaataccgacaggtaggatgcatgggctgattgcagctgtaaagacttccttggacgtttgatatctttcatgattgatgtcttcaaatctgaagtctaatgggagttcaaggtctgctgagtcttcataaagaaaccaaactcgggcatctttctggaagccttcataaaagctgcagaaccaatctttgagcagctcagccgatagttttgccccagcattggctagtgtggatgcatattcaacatatgacatgcatctgcgatgggtgcgttcttctccatcgtcttctacaattggcttcaaccttgggaattcagcttctgttacagatggccgattgacaactttcatgactaccaggtttagccaggtctgcagtagccaccatggtccacctgctccaactattgagccgacggctatcttagccgatgcatgcattgttcaacatttggtatagatagccgagaaggattttgcccaagggaaattgtttctttgattctaaggcttcggctacaaattgccaattggttgtgggaccacagctggatccacagaagagaaacttttctagccacattagcaagaaagctacgtgctcccgaggagtgacaggccctttgcccatgtatgccactacataatcagaccaccctcctatgcttttggtcttgaagtcaaattggttcttggtgttcatactcatagggttagccgatgaagttatatccaatccagtaatcatgatgatgtcgatcaaagttggagtcattggcccttggttaaataagaaggcattaatggtgttggaccagaaataggtggcggcagccatcagaggttcatccttagcagaattggctatggtgagagcaagcgcttggccgatcccaatctcatcccaatgggttttcttactagccgatatgcgttggtaccaggtggtccagctcttatcaggggtaggcttttcgagagatggccaagacttgaaggtattcttccagtgacccaagttagggttggctagtctaaaggggattctgttggtttcaccaatgatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaagaaaagggatctagccgatgagaacttacctcagcgtactcggccgatgccgcagtagacaggctagcggaagacgacatcgccacaggcggagatcttatcaaaagcgaaatcgcctggggatcgcttttccgtcagaggaatcaccggagagagaaaggacaaagtttcgcttaggcggtgaaaacggaagtcatagcgtgagattttttgagggcaacggttggtatttaaagtgatagaataacggtcgaaaaatggcagagtgcgaaacttgcacggagtcggtacacgacaaatccgaaacattatcaaatatcccggacttggggggcaagtgttaacgaccaaatttggtaatatcagcatcgaaaaaggagattagatcaaggtggagtcgaaggcggagattgatccgagaacagagcaagaatcggctgaagtccaaaccggctacgattaggatcggctgggtctgagtcggactaggtgagccgatgtagccgattctgacagtataatttggtgtatgacattgggttgaattgaggtgcttcaagatgattgccgcatatggatagagtcctgagaaggcaattgtatctattaattaggatgttttatgtaacttccttagagatatgtttggacaaaagtctgccgcaaagacttatggtatcttagagtttgttagagatagtggtcgtgtccggtatggacagatcttgtaattcttgggtataaatagaccccaagccctatgtaatttttaacacacatgttcaatacaatttcgacgcatcgccacctttttgctttagttttgttttgacgagttcttgctttcgggttgagctgcatcggtttcgatcttcaacaagaggtaaaacttgttatgacgacttgtgttctcgagattagtgcttccatctttatgacactctaatcttgtccatataattcgtcaagttatcatatatcttacataatctttggcaatatcgtcatctaacctacaatcggctaacatctgttaatagaaggcagccgattaggttaaatagcgacgttgtcctagattatataggatatctaccactttatgaaacacccagcggcttgattgtctagatattgttcttcttttcatacttaatgctgcatcagttgagtttgatctattaagtcgtgcttagaatatcaatctctagcctgtcctctggttgctgattagggtagcatcggagtttcagccgatcttatttgatttaaccatattcgatctttgtgcttcaatgacatgttaaatccgccctttatgtcaagatcttattgcatttaagtatattaagcttttgtttggtatattatatttgttttgatatctttatataaagtagtatcggagtattagccgatacatgctagatctatctgatcggctatgctataaacatatataatcctgttattaatatgtatttcgatctaagtgatttatactgtctcggcattgtgaccgatctatcccaatcacttaatttaagtatatattaatataagaactatatattgttaatatctacagccaatcgaatagatttagctccttactatctatttataaccaccgtcgattcatatatgacatcggcccaaagataaatgatatgtcatcggcacctagccgatcggctatcatttatagatttaaccacgaattctttgtctctatttcttgttgattacagcatcaaatcaactggcacgctcatacattcgaaggcgagctttggacctgcactggtgttaagcagatctcccaggcctcgtgttttctatcaacacctactaattccgttaatctcactctcattttgtgtttcccactgtcatttgctgagttgctaatgtaacacaccgatgctttgcgaatttgcgattactctcctctctcaatgctctgctggtaatctcaaaaagattaaacataattggtaggagcagagcctggagttcattttcagggaggcttatctcagattgatcactgatgaaatggaagcaaaagtgtcttagtatgtcacagttgagcaggactaccgttaaaaaaaataatacatagcacacaaaaacaaaagatagctttttttgtatacaagcacaaaaaaatccaagaaaattgtggtctccctgtatagagtgaccactgaaatggactgattaactcaaaccctctgtgcacaaaatggatctgacaatgctgagggacaaaaggtaagagcatttgtagggatttaatgaaaatattggttagttgttgagctcgaattgctaccaaatccctaaacccctttctaaaatgctacggcacagaggtcatcactggcctacaggataaaacgactaaatctagagcaaaaccatgtgtgtgcctaacaaatgaagttagggagaaaaataattagggagaaaaaaccaggcagaggcacagcccacctcccgctgattatatcatacacgatgtgcagtaaaaaccctaaaaaaaattccccaactacaccggacaaaacatcaaagcacacacatcatgtgggtttcagatccagggatgctttgctcaacattggtccccccccccatcccgccctgctactcacgccctgcaccaactacggcgcacacgggttgatctgttgggtcggatcgtgggttttgttggcgacaaaaaaaggcccacggtctccatgtcttttttaatttgaacaagtatatatattggctatatgaaatattttgatttcacatgatgacttaattgttcaaaaatctgagtagtaaaaatatgtgtaaaattatcaagacgctgcaattgcatacaaatctatcgatttcttcatttgcaattatcaaagatattggaaattgttgacctaacttgttctgaattgtgctcccaggtaatcatgaaacatgaaactattgtctaacaaaaaaaatcataataacttcaaatttcaggagacgtgcaggagtctaaagttgccagatggctggagaatggcatggtaaataatccttaacatatgtttgacctccttaacatatgtttcatgaagaaaaaaattctgtaaatgatttaagctaatatctatttgacctcctctagccatagcttggtgttaatgttactactcagatatatagtcttgtttaggttcacaactagtttcaggaaactgggtgttcaggtattaaatgacaaaaaatataatctgttgtgctgaattaaattttcctctagtctcaggagaggcactcgcgtgtgggtttggcaaaaaggaaagctgaaaggagttgatattactcaaggtatttgagaaaaaaactaaacacaattgtacttacatttgactgatgtgaggcatttaatcttgcccctgcatattaactagagtaacagaagtaatatgaattggcacacaaatatattgacctctgaatcttgtacctctgctacgtgaggttttaacaaagtacacagatctgaatctgagaactgtaccttgcagctacaaagcaaactgctacaaaattgctgctagagttcagacaaaattaactattgacaactatctctgtctccaatgacagaactgcttataactatttctaaaaaaaaatgacaaaacctatttctctatacattatgtttcaggttgggagcaaaaactgaagtaagcatgttattcctctaattccagctcgggtggtctgtctgatgagtactccataatgagaatgacccaatggtaagcatgtaaatccagttattcttcacagatggggaaatgatttacattaaaagaaaataattagtgagaaaatgaagttaggagaaaataattagtggcaaggtttagaaccaggcagaggtgcagcccacctcttgcccactatatcatacgcgatgtgcagtaaaaccctaaaaaaaatttccccaactacaacgaacaaaacttcaaagcacacacatcatgtggtttcagatccatgatgctttactcgacattgggcaaaatcaactcaaaaacatatacccagtaaactccaaagcatcaaggaatgaaaaaaactccgcgggattcccccctccctcccccctcccttgaaatggtagccaaccagccctaaacaactcacaaaatccacatgatagaaatctggagctgaggggaacatgccgtcgcggcgtgagatttgaacaaaaaagagcgatgaaaaacctgcagtgcctcaactcaagcgcgctcgccttcgacggcacactcgcggtgccttctccggcaccgtccacgggcgctcgcggtgcacaggccacctccccccccccctcgcctccccttccacctcctgccttggaagaatctccggcaccttctgctcacaggactccgcctccctgctcgagaaaacacaaacgctatctactcgaggagcagaagcgctttttagaggagtcacgggtgcgggcggatttttccagagctatttgtgggttgtgggctatgggctgtgggctgcggactctgggcttattagcaagggaaagatgatggcgcgcacaaaatcaagacacataatcgatggtcgatgcgatcgactgatcgattaaaattttgcaggcgactgcaaaatagcaaaagcgttgctaatttgtttaggagtaaattgcgttgacggaaaaaataacttggcaggtgggtgcgattaggtgtaaaaacttgaaaatcgagcgtagcggtacaataacttggctaggtgggtgcgctcatggtgcaaaagttgccacaccattgttccacctcagcgaaagtgccacattagcattgaccatctcattttacagaaaagtccatagtaacttttatattacaatcacttcttcagatgtatctgtttgcccattgtttggtagaaagattggaaagataggccctgccgccggccgccgcagcgtcgacggagcagcccgaggtcaccgagcaggcgacctcgacatcctacaggctcggcaacaccggcggcgccatgaccagtgccgcgtctgctgctggctccttccttccacattcgctgggcgcagatcgagtctccgacagcatcaagtccatgttcccctcctcatccacagccagcggcgccgcctcggccggacacgacgagtataggggatccccgccggacctcctgtcgcgacgacaagcaaccagcaggcgcagtcacgcaggagctatgcctcaatctggtgagcaattttgggactgacgaagtgacatttctctgtgttggctgcctctacaggggtttggatgttctgcaatatatttttttagataatggaatagaatatcccaacctttgctcaacgagctacaaccaattattacaaagtagcacacaaaataaaaagtttctcgcacaaaaaagaagacacttaccaacacaagataagaagtacacaattattaaattctgtttgtgaatctacatccaaaattggtaaacagttgcataaccattgcctcaagattacgacatgcaacttttaaacgctcgccctcttcatcacacttttgtagcagtgcccaagacctgagccagtgtgttgcctcgaaaattacctgcatatatgaaacagatggtgatttgtcaaaaatcatatcattcctactcaaccatagagcccaacatatagaagaagctcctatgagaataagtttcctatttttcttatccacccctagaagccaatcatcaaaaatatgagatatgctattaggagggtaaagaccaaaagagaactgtacagctctccaaataaactttgcaaaatggcattccataaaaagatgctgaatagtttcattcttcatacagaaacaacatctcaaacttccattccagttcctccttgccaaattatctttagttaacactacccctttaagcaagtaccacataaagatcttaatcttgatagtcatgttaagcttccaaagaatcttatttctctcaatataaccattgtttattaaagccagatacattgatcggacagaaaattggccattctgatgatagttccatctaacacaatcactctgttgattcaactgaatatgtacaatagaagcacacaattcatgccactttgctagattctgaccaactaaagccctcctaaaagaaacatttagcgaaacagatctcataacattagcaattgaagaacttttccttcgaacaataacatagagagatggatacctatctttaaacgccaagttacctagccatttatcttcccagaatctgacttgttccccattattcagaatccaggaacccatgtttaagaaagtattcttaactttcataagacctgaccaaaaatgagaatcacctagtttcctatcaacttgggtaatagactgattataaagatactttcttttcaataagtcttgccaaaccccttgctcatttattaatttaaacaaccatttactcaaaaggcatttattttgtatttctaaattatggacacccaaaccaccctgatctttgggttgtcaaaaaatatcccatcttgtaagtctgtactttttcttatgatcatccccttgccaaaagactcttgatctataataatcaattttttgaagaaccccttttggaatctcaaaaaaagatatcataaacatagctaaactagaaagaacagaattaatcaaaaccagtctacccccaacagatatatgttttcccttccaactactaagtttcttctcaattctttgttcaataactttccaatctttgtaactaacctttctaaaatgcattggaataccaagatatctgacaggaaaagtacctaacttacaaccaaagatagtagaatattgttcataaaagtcctttgcctggccaaaacaaaataattcacttttatgaaaatttattttcaagccagacaacttttcaaacacagataaaatcaattttagattcttggcttgttgtaaatcgtgctccaaaaagatgatagtatcatcagcatattgcaaaatagataaaccatcatccaccaaatgtggaattaccccattaatggtaccaacatctttagccctcttaattagtagagctagcatatcagccactatgttaaagagaataggagacaaaggatacccttgcctgaggcctttgtaagtttgaaaattattcccaatttgatcatttactttaataccaacatgaccaccctgaaaaaaagaagctatccattgacaccatttaggagaaaagcccttcattctcaacgtttgttgaacaaaagaccatttaaccttatcataggctttctaaaaatcaatcttaaatattaccccacttttatttttatgatgcatttcataaatagtttcatgaagaataacaaccccttccataatatttatcctaggaataaaagcagtttgagtaggactaattactttttgagcaacgccaattattctatttgtagcaaccttggtaaaaattttaaaactaacattaagtaagcatataggcctatactgttgaattttcatggcctccacacacttaggcaaaagaataatagtaccaaagttaagagagaataaaggcaaagtaccattatgaaaatctttaaaaagatctaacaagtcggctttaataccattccaaaacacttggtaaaactcagctggaaatccatcagcacccggagccttgttgtgttccatttggaaaattgcctctttaatctcattttcggtaaattcttgagttaaagcctcattctctaattgagatacttgagggatatcatcaattttactctcatcaagctgaagatcataatcatctggaggaccaaataaacctttataataagtggtaatatgcgattttaaattcgcatcaccccttattaattgatcaccatcctgtaattgaaaaattcctgtttttctatgcttaccatttgcaaccaaatgaaagtacttagtattagaatcaccctccaagatatctttagtcttagccctttgataccacttaatttcctcttctctcagaagcgtagataatctatttctataatacactctaatatcaatttcctcctgagtcaaaagaatggtttccgcttttttatctagcaaatccaacttatctaataactcttttttctcttttttgtagatgccgcttgtatgtttagcccatcccttcaaatgttgtcttaaacgatgaattttagcctaccaatgctccatgggagtattaccttcatcaacactagaccaaatctcttttaccatatcaacaaaaccatcccgtaatagccaacctaattcaaacttaaaactatgttgagcattacccggagacgaagaatttgtttttaaaagtaaaggagtatgatcagaaatatatgtaactagaagtatatatgcaagtgatgtatagttcctgtaggttcttttgtaagtactctgggagtgaattcattatgtacggaattatgatgaaagtgatctaaagttcctctgtgcttttattaagtactctgtaagtgatttccaaatgcaatcaaaagctgcctcacataatttgtttccaaattggtacgaaaaaaatcagaattgtatgcttctgtctgaatgagacatttggtacactttatgcccaacagcccaagcgataatctgtcataattttgccagcttgtattgaccaccacttgcaatgtagggaatttctatatgcatatatgatgtgggacattttcttgtccataaataaatccaggtagaaattttcatactgaaattcaggaagaaatcaacatgcccataacaaaataaaaggtgcaaaataaacacggttcaagaacagggaaatcagactaatgtagcttatgaaacatgtctatctggttggtatgaaactaaataaaactctctgactgaaacatatgctaatgttttccacataaaattgattactagctgttttcattttttctttgtctccttccttttcttcggttctgcttcattatttggcatcgatttcttattaggtggtgcatttctcttccttggctctgccatcctcttcctaattgttgccctgccctctttggttgcggtcgacattggtggctccactccagcccttctgtttgtggcaataaaatttgattccagcaatggaccaggggcaactctagaagagctgttgtttgtgttctgcacaaagtacttggaattgtggaaaaatgtttcacaaagttacaaaatggagaattgagaaagcattgcctaacctctctaatcaaggaagacaatatggtattgtctaactggttgtagtttggctgactagttagaatactagtctgactattcagaataccaggcatgacctgcaaaggcacaacatcttcttgaacaggctgtagagaaggagcactggcctgctgctttccactttttatatcttccttcctcttcttgcggtcccttcttattgtgattaactccttggcagtagctacagtgtatttgcacaccatgtttcgatatttttgttcctccttcaagctcttgaggctgctttcttctacatctactaggctttcgactttcttttcataaactggtgggttgaccttcactccattcatcttcgcccaagtagttttgtctctaacaggcattatattaaatccatatgcttccataaatttctctgttgagtaacaaaaagacaccacatcttcaggcttgatcctctcactcctcaagcaagaaattgcatggtttcatggtatccctgttagttgccatctcctacattcacaatgttttgctatgatgtcaacaatatattggtgttctttctcagtaacatggaacacccctttaccagcaggcaagacatagcatgtatttgctatttctgcatttttctcaacctttttctttatttttgggcatatatttcccgaccacttctttgcgcactcctcctgcttattatgtatcctattcatgatctggctcctaatcttctcaagcatggacaagattggaagctctctagcttcaagaatatacttgttgaacacctcagaattgttgttcagcaaaatatcacacttgggaaaaccactaaagaatgctctgcaccactgatttggtggtatttcctccaagtatccataagcatcagtactaagatacttcatcttttccatgttggattcccattccggtattgaactggaccttgcaattgcccacaattggttctttagagtctcccctttatgcaaaacatggaagttttggtatagatgcctaacacaaaatctttgttttgaatctggaaatttatccctcacagctggcaccaatccctacaatttaattaaaaataaggtgaattctagtccatcatcaagtttaaaaataaaataaaatatgatgaaatagagatgtaaggaatacattttgcctatctgtcataatagtatacggtgtcgtgttgtcaataaggagatcttctttcaaagtattcaagaaccaaccccaactagctctactctccacttcaacaattgccatggctataggatagatgcaactctccacttcaacaattgccatggctataggatagatgcagtcattggggtcaatgcctactgcagtcaataaatgtcccccaaacttggttttgatgtggcatccatcaagaaaaatgataggtctacaaccacttaagaagcctcttttgcaagcatcaaatgatacattgcatgtatggaagcacatattctgtagattcaagaaaaatttgctacctgaattagatgtcctaagctcttgtccataatcccataacatatcatactgagctatttcatcaccgtgtatagcctccatagctaaccttctcgctcgtcctagtttgtatcttgatggtgttacatttaggtctttttgaactactttagcaaaactcttgagtgtcatcttatcattatctctaaagctttcaatgtacctatttgcaagatatctagcagttacataattcagctcccactctttttgacatttgtgaccatccacatattgttttatcataaaacattttgtcctgctgtcctcagaggcatttaacatccatgggcattcttcagcacatttggcctctattcgtttcttggtgtttcttgcaaatttgattgcaactctatttttcacactatattgttttattgcccgcctaacttcaatagcatcattaaacaacatcccaaccttaaagataggtgactccatgtccacatcagccacaaagttcttaaatttcaacttgatgccccatcatcttcatcagatgactctggtagcaacaaaccttcatcatctggatcacatccaggaagctcaactactagcttgctagcctcagcattttcggtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtatgtacaaaagcaatgatctgaaccttggtactaatgcaaccatgctgttagtgcttgcatcagaatttattctccttagcccatcactaaatgttttcccaggcaataaccaataaaccttaaccttcctctcagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatacaaaataattggtgatgtgttatacccgcataaggaaaataatacactaagattatttgcagattattgaactaattatattatgctcataagggtacaaaatacatatagcaagaatttatcattgccaatgttactcttatatcgtatacagctacaggaaacaccaataattacagtacaaccaatctcgtggctagtaccattatatcacttcattgcattgtaataatgttgggatacgcgtaggctacgatagcataaaacaaaattttctatcgcgtaaaccaggaaccatgcaagtattagatcatagatcgttaccactcgacgcgctgcacagcggaagaagacgctgagaagtcgaaggaactctcgcgaagtagcgcacgtcgatgtagaggaagtagtcgatcgcaccggctcgaccttctcctcctcgtgcgttctcctcaccgtactcccacgccgatcagcaccgcaaaccagcggcgcctctaccggtatccacacgtacagggacggaacaccacgcgcagatgtgcaagcacccgcgcgcggctagggttttgctcgggaggaagtgatggctaggatttctcacgtgatgcaatgcctccgccggtcacacccctcacgaatatataggatccatcactcgggcctccaaggcccgtaggattcctatttggatccctatccgaattaagctcatattggatctccatccaatcctcttattccggcccattaagtgtgcgaccctgtaggttcatatatactcggctgtaacccgaaaactccttttcggtccacgcgtcaacagcggccccttgcagaacgtattgacccaccgggcatacataaagatcatatcggctgaacctctagtgtatacttgtaagaacccctttgccccacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggctcagagatatctctccataggaggggcaaatcccatcttgattattcatatcccactacatatttcatagcataaccgaaaactacttttataactacccaattacagagtagcgtttagcagtccctaaataagttactacacatgttaggaaccatgataatctcaggtctaaggatttaacaccaacactaaatgagatcactgatgacacaacacatatggctcttgcagtgtctcatgttgggtctatccaacaacatgttcactaagatgtgtccacattattaatttggtatctctatatcatgatccatgagacatgatcatcaattaatacatgtgctgatcatctaaacatatttgttccacatatgatatttgatcagggatcctttagaaatagcaacaaacaacataaagagtctcatgaaagaatcacatattcattaaccaataaggagttatctatttcaaggaacaatgtcggacaaatatgtaaacatagtatgtgatacaatcatctctatgattgcctttagggtatatcactaacaaataacaaataacaggatattcaagtgaaagaccaaaataatgcagccatcgtacaaatcaatgagaccttaactttgcaatcatccatcaattgaacaaaaaatagaaatctacaaccatcagcaagtgatttaccataacaaggagcagaagctcaaagaactcgccgagtcagagccatcccaaagattgcggcaatcacgtcgacagcagtagtttgtggacttgaattggtttggttatggtttagnnnnnnnnnnnnnnnnnnnnnnnnnnnnctcgtcgccgccgcgacgtagttgcacggtttccctcgtcgttgtcgccgccgccgccgttgcgtcgccaccagcacaaccacctctcaatcaggatcacttaagaaagatgaagggagatatttgtacgtcaagaaatcatattatggggttttctataaaatgagataggtctttcgtgtcaatgctaatgtggcactttcgctgaggtggaacaatggcgtggcaacttttgcaccatgagcgcacccacctatccaagttattgtaccgctacgctcggttttcaagtttttgcacctaatcgcacccacctgccaagttattgtaccatcaacgcaatttactctttgtctagactagtaaaaaagttgttacggaacttagaaaatcacattggcacttggcaaaaaaaataattagggaatttagagcttaattttaaattaaattatattttttatcattttatatttgacgtaaaatatttcaatattgcatcattactgcgtaataactctatcctttaaaaaatagaacggctcgaaaacggtaccccgttcagacggatactttaagtaatggcgtcatattcatgtcaaaactgacgtcactctatacttatgtggtatcatgtatgatatttattggtaccgaacatgatacccgactaccaggtgtgacacactatatctaccacatcaatgatgatgtcaatgttatggggatgctatacaatggaatcctgtttgaacgggattataccggttaggtatcaggacatgatacttctgaggtatcatgtgtcctgatatctaaccggtatcaggtgatacctattagatatcaggcgatttctactacatatcaaatgatacttgtgaggtatcaaacgattcctataaggtactatgtgatacttacaagatatcatgtgatacttataggtattggctgattcccgctgataccatcggatactcatcaatagtagagcgatacctaccagatatcaggtgatttctactaggtaggcatcatcgtcagtggccgtgtcctccgcgtttgagcatgtccttcaccgtcactccacatgctggagctcggtggtggcggccctacatcccatgaccgagatcatcaccggtgcagccacatcctccgccatccacattccacgccagagctcgtcaccagcagccgcgtcctcctccaccacgctccatgccaggctcgtcgccggtggccgcgtcctccgctgtccatgccccacgccggagctcgtcgctgaggctgcatcctccgccgtacacaccccacatcatcgagtgttcgcatcagcacggtcataggcggtagcgacgagcaagccacaaccgcgaccatgaagccatcatcatatcgtcttgtcaccgactcgccatgcgcatactcattctcttgccgtctcgccccgctgggcatcgtcgacgctcttcatcgtcttgccggagcagagcagcagcaacaacaggagtcatgcatcatcaacagctctcaccgaagcaaagcaacaacaggaggcacagcatcagcagtggcgcacgcggaggagaagacatggctcaaggagatggtgcgggaggaggcgataccatcccactcgctcgagacggtatcccgtggtataacatacaagtatgtcacatcatcacccacaagcaattactattgtatagtatattaaatctcatacaaacataacacatatctagaatacctcgtggtatctaaatttttcactaaacattatgatatctaccaaatttcacagtaaaaaatgtagtatttttgggtaatttcttaatgatgataaaattgcttatgctataagttttgtagcaacaaaattataaccatatgaaagtaaaatgtcaattcaatgatattattttcagcaaacaaaattcaattcatattatgatagttgttggttaaatattttaaaaagttgagacttaaaatgtgtgtgtgctttatatgattgggtgtagggagtagctatttgtattctgcctttgttgcaacgctagttgcctgttaaatgaggctggctcggtcggatgtgctactataataataataaattaactagaataataatgttcatagattgcacatataaatggtataataatttcggattttcccaaaaaaatttatttgaaacacaaacaatctatcccaatataacgataacatatcggttttgaatttgaagtactaactccagccgttcactaaaattgttcatacaatacaatatgtattcgcctcttctatttagttgccgattgacatttccccgaatctgaaattttggaatgccatattagccccttgtgatcgaaataacaaccttttctacctagtctcgtatataaatccttgctcccccattgcatgtctcgagacgtttttgctgcatgcattagttcgatttttcttttgcgtcaatttgggcaaagaagatgatgttaaccaataaaatttggggaagtcgttgatatatgactctaccggtaagagttcaattcttggcgaagtcgttgttatatgactctaccaataataatttaaattttgatacgtacatataaaggacgtaactacacagctaccactaagtttgtctaaaccagctaccactctatctatagagacaccatccacatgtacttcaaatacaattttctcttaaactactcatccgatctacgatccgactacaccgttgtgtttgtaacaattaaatctttacaacaagatcttacatgattatattttgatgaaaaatcataaattacttttataatatgtctaaattacttttagattttactaagttacttcttagatatataaaagtaaattcagtaaagcctaaaagtaatttacatatattatataagtaacttagaacaaaacgaaggtaactttgccatgtcatttaaagtaaatctgttggagagataaaaacatgactctatctagaaattgaattaatcagcacaaattatggaattaactaaaaacaataataaaagtaatcacctcagagcattatgaatatataggaagtattttaatcaaaagtaacctatatatatgataattatatatatgataatttgttcaatgaaaaaaggaattaattaaagttactttctttttgttataagttagttctataatatatgtaaattacgtttaggctttactgaatttacttttatatttctaagaagtaacttagtgaaatctaaatgtaatttagacaaatcataaaattaatttgtgatttttcatcaaaatataatcatgtgagatcttgttgtaaagattttaattattacgaacataatggtgtaatcggatgagtaatttaagagaaaattttatttgaagcttagatgataggaatattttctcaacttacttcatggattagtgctatagtaaagtaagattcttcaagttagcacatatctaaataggggtcactcgttatgactaaatcgagagtgctctcgatttagattttgcgacataaaaatattactccgtacgtgaatttgccatttagtaactaataacaacaattgggctgggccatcttgggccagagggaaaggccgagaggtagaccaaagcccatcaatcatagaggaggccacaaaaacatagccatgagatcgaatggtgtcacgcatggtgtacgtaaccctaagcgccggcgcggtcgcggacaatgtcgcggccgatccttcgccggcctgcgcagccctctcctctcccatctccggcgccccgtccgccgccacgacgccaccgacgtcccagcatttcttcgtccccgccacctgatcataggcccacgatcaggcaactcctcggatgccacaaacggcgccgccggcgagatcgcggcgaagaagcacctgtacctggcgatcgatgaccggaagaacgcgtacaacaggacatctctacgacggcggcgacgccgtcgacccatggtgttggcggagctcagagccgaacacgcagatgtcatggagtcccgtgcgagaaaagcacgccgtacgtgcaccccgggggacgcgcctagcttcttcctctccgcgatgaaccagtttcggtcgggcggcgtcgacgtcgaggtcaccttcttctacagcaaggacagcgacgtctgctggacgcgccgcggcgactggctgctgccgttcagaggccacggccactacgacggcgagctcggctcgtgggtcggcctccacactactccgacaccaacaggctacgcaccgacgggcgcctctgcgcctgccacgtcgtgtccgcctccgccgaagcgagcggcgagccggcgccagaggtgaaggtcgggaaggataaggtgttcgtccaggtccctgcaggctgggtgcacgaagaggccgagctcgtgtacatgggtaagcgagtactgcctcgttgcgtggctgcgccccgagggcgacgacgaggaaaagtgcctgtgcgacggggacaagtgcgtgctccacctgaccagggttaaacatatcggtttagccgatttgatcggtgctcacaaaaatgctgaaatttaaaacaaaatttagttgaatttgaaataatattaccaaaattcaaacaaaaaaaatatggccaaaataatatcgtaacggagggatccgaaatgaccgaaatttctaaaattttgttctggaatttgcaatcctacgcctgaccacgttgcaggtggcgtacgacggcgacggcgagctcaccgccactgatcgccggctcgctggctgctacaaattctccaagtatgagatgaactcccatacgagcgttctggatataacggacagctacgagcctacgacagttcactaaagaatttagtagctcatggtgaatctgagggttcaaaattccgaaacgaaatttcggtctattggatccctgatatgatattataatggacaaaaaaatattttttttaatttggcgatatttattcaaatttaactaatttttttataaaaaatcaaacaatttctgatcaaaatttttgaaatttcacgatatcggcacccacaatacatatgccgaaaaccagagattgaaccctaatggccatacgtgtatgccttatttgaagagtcattttagtgtcaattaatttgtagcagtgatccagtcaaaaggaacaaaaatttgcatagaaaaacaccattatggatccttattcctcagatcaaaattgctctcaggggcccaccattttagcaccctgctgcctgctggacctaggccacccaggctaatgttgcttgagttgcttgcttcctcgttagcttccctggagtttgtgtttttcctcagtagctctcttcgtcttcgcacgcagccacgcaccgtgtgtattcgttcctctttttttttttagccggcagctggctggttgtaaactagtactccctctgtttcaaaatgtttgacaccgttgactttttagcacatatttgaccattcgtcttgttaaaaaaaatggtacatgaaagtatatatttaacaatgaatcaaatgatatgaaaagaataaataattacttaaattttttgaataagacgaatcgtcaaacacgtactaaaaagttaacggtgtcaaacattttgaaacagagggagtatttgcttccttctaatatgtcgacacgcaagctttttgcacgttaaaaaaatcaaagttactctagaacaattaatttatatttcatcatttgttactaatatttattgacaaaacaatgagtgccagcctcctaccatttaggtgattcctaaacgcattctacagctctttccggctcctctccactgaattgccccctattgtccttctaggttcccacatgcctctctttcatcgaatggcatagccaggaatatagaggccctagcaatagatgggtgcatatgtctctcctttgtttagtggcaaagcctacgcatagagcccccgactagagagggacacctagagagggagtactccttccgtcccaaatataacaaattttggtcggatgtgacatattctagtattacaaatctagacatgacgcatatccagattcgtagtactaggaattgttacctccaatcaaaatcccttatattttagaacggggaaagtataacggaaggtgatacctgctcatatatgttagtgcctcaaagacaccttatcattatgacaaaggacgtgctcctacaagcacaaccaaaacccataaaagctagccgccaaaagcgaattcctattggttatcaatacttttcactgcaattgtaatgcataaccatttgggtggccaaattctttaaacgaatgaaggaaattttataaattttaggctcctaaaataactttgagcgtaccgtggccatggcactaaagttaaaagtaagttgtagatgtgaaataaaatcttaattataaagatttgatttgaaggataaaagtaaaccataaatagacaaagaatcccccggagatcaaaatacatagaagaactgatctccaaaaataagaaaattgagattatgccaacgtaaaaaataggctttgccaaaatgccatcctgcaaataggattggataaaatgttgtgaacagggtgatttcaccaccattccaccatttcatacaaattaataaaatgattttgctttttttttacatgagaactgacaaaagtgcccctctctccctatctattgtttactctcattgtggccgagaaataagctagactattgacgccacgtagcagcgccaatgctgagtcgccgccaccactcagcaactagctcgtgcagaatgtagacgagcacatcatcctgcagtaggttgagcttgtcaatccgtcactcctcggcttcttccatatgaggcttaaaatcatcagatgacaagtctgataaggagctagggttagggtttgcgactacaaattaagtagtgtcagcattaaggttgttggggttaccggtacggtggtggtgaagctgaaggagaatgtgatcaacggtcacgtccgatgagcttgttggtacaaggcagaggtacgcggttcctagcttcactacgtacaaggtcttgcggtctcagttgatgtcattgcgtcacaaacctagaaaatgatctgcttggaggtcccataaaaaaattgaccatgatgaaggggcaataggaatgggacggcccacgtttatgtggcatcctcacaagatttccacatgttttgaccttgatgacaatgatataagcccatggcgagctcatgcctccctcccgaagctcatactcaagctctgccggggagcttagacctagttgaaaaaccattttaattggaaagaaatggctttctagcgtagatgtctagccgtttaggttgttaatactaacattttatccaactctatttatggaatgatatttacgtgaaactcaatttttctaggcaaaatttgccacagggcatccaaaaaaccctgtaattagctggtggacaccacaaaaacacgaaattgctgtcgggcaaaaaaaactggtaattagctctcggacacttatggccttattttattattttcggggaaaacggagagagaaactgaggtgagagtacgattctgcccctgtgctacttcgctgaagctggtcgtcacaatccatcgccgccctcaccgaagctggtcggcagtccctccgtggcggcggaggtggcagcaccgaggccgtgagcgcgaggatggtgtggcggtgagcggcgccgcgggtgggaaggccttggtggcggcgcaccggaaggcctgcggagctcgtcggcgaggtgcggcatctccctctctttctccagctcctcctgcgcccctctgggcctcccgcctcacctcctcctcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgcctcctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagttttttttcgtgcctgacagcaaattcgtgtttttccggtgtccactagctaattacaagttttttttggatgccccgtagcaaattttgccattttttatgtggcgtaattctaaataggattatcttaaaaaaactgctgcaagtttttttaaggaaaaaccttttcaatctaactatagtattatagtataattgtaatataattccactataattgtaatatgacttatatataagtgttataataatatatacaactttatatctaacttatataaagataacaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatggagatggccgcccccgtctcccccgcgccgcgcaccgtcgaggacatcttcaaggacttctccggccgccgcgccggcctcgtccgcgccctcaccgtcggtaagtaataacgacgaacacctcgcccgcctctctctctatctctcttcggttgtctcctcttctggatctaacgagctcgccgcccgtgcggggggtttttgtttgtgccgcgcagatgtggatgagttctacggattctgcgacccaggtaagaccgaaccggatcggatctgatgagggtagagagagttcgggtggtggttttgtgtgtggggtttgatttggggttttggggatgtgagcagagaaggagaatttgtgcctgtacgggcacccgaacgggcggtgggaggtggcgctgccggcggaggaggtgccgccggagctgccggagccggcgctcgggatcaacttcgccagggacgggatgcaccgccgcgactggctctcgctcgtcgccgtccactccgactcgtggctgctctccgtcgcctttttcttcggcgcgcgcctcaacggcaacgagaggtaccagccacacgcttttcctccattagatctcgtgaaaattgaccatctatgaagaagaaaagatcacttacttggagcgtataattcgatgggtgcaagtgcaatcgaactctgttcttgccttgtgggttgtgggtgcagtgtaatgccgttcttgtgcttgccccgtgggggtttatggatttgcatattttatttcagctcaactggtccatgtgtgcgcttgtgctgtgttgcacatgtttattgtgctttatttcaccattcttttttctctttgctgtgaatgggggccatgtttctcactgtgtttgctttattttctctctttcttttcttcgtttgctgaattgattttattttttgccataaaattgcaaaacagtgctgtgtgtacttggtgatgattattactcctaccagtagtaattgcctttgaaataagttcccgggctgtctgaaaatttgatctttcacttggaacatgttttgacagatttcttttcagttttcacatccttgtcagaagttggggggctgacggtgataggctctgtgtacttcacagtacattgaaactttgaaaggtctcagtgtctgcacaaatttttgtttcgtgttacaattcgagtgttgtgctatatggatgacctttcatcataatgctttttagtcatttgggttttggataccttaattcatgtttttcaagagtacctattttatggaccatggcagtaaaagtgttcgcaaattaggatacaactaataaacaatcaaatgggcaagtaccattcttattcaacttaacatgccataaattgaattctttctttctattgagcttcagttgtgtttgctctgttccttcgttcttccttaagaaactttgggattacaatttgctttgtgtccttaattttcaagttctgcaaatactcgttgaatatttttctcgctacattttaattcctaaaatgcaatgtgtcatatggagtcttttgatggataaccaaagggtagatgaagttttatgtgcctaaattattagtactgttaggttgaatcattaattggcctctggtccttttttaatgttttatgcaggaagttttgtgttttttgctttggtctacttgagtacttgactgccatgcaaaccataagtcgtaattctgtgatattgcaatttttttcttagcaaaagttatcttgtttattctgtttttcagtttgattttttttttggttcagttaatcttgctagtttcctggttgaactttgcatttctattccagccatttttctcttctcttttctccctgagatgaggctttgacgctttgtgagcttaagtttctatcattttggcatagtaattctgcctgctttcattgtactctagtatctattttcctgcacactttccacttctatttgaatttatttttcttctgtttcatcttactatctgttactgtatcagggcagtagagtgctaaactgtgaagtgctgccatctgttctttcatgtgcttcgtttgtgttgcacaaggagctaaatcagtcacaaaatttgtattatcattatgtaatgggaagcattatctgttccttatctgtttgtttatgttgctttcatgtttgtttatagtgtttcgttgcttatctgttgtctttcgaaggattcatattgtacgctggattattttttaactcccaaggaaatattgggtcatgcctcacaagtgttttctttctttatgtacaaattctattttatttgttgcattacttcatggatatcttgtttccatatttttgtctatcctgcccagggctaacctgttgaaacataaaacttgtgccatgtgtattggtgtcttggattcatattctgatttgaacatccctttgcatcaaccattatctctgttaagaacccaaagtatcatatcatggttaacaaaatccttttcctggatccaatgtgttgctctcttgattgtcaggaagcgcttattcagcttgatcaatgaccatccaaccgtgcttgaagcactgtctgataggaagcatggaagggataataaatctggtgccgacaatggcagcaaatccaggcactcaggaaaggtgccgtaccagtgctcttagtttttattttcatcatgaaccatttctgaactgtgcccatttgagtttttacgaactgaaagctggctttgttatgcagcgagcaaatgacgtgcagacaaaaacctcgaggccagcagttgttgacgatgggtacgatgaagaagaacacagtgaaaccctatgtggaacctgcggtggccgctacaacgccaacgagttttggattgggtgcgacatttgcgagcggtggttccacggcaaatgcgttaggataacaccagcgaaagcggaacacataaagcactacaagtgccctgattgcagcagctccaagaagagtaggcaataaaaaccatggagctgctgctgtggctctctactgctgactaagctgatcaatcaaatgatacttgccatccctcttccagtcccaagttggcggcagatgtgaagaatttgctctagaacattgcgcactgttgtggtagatgctggaaaacaaaaaagaagaaactttacaggatagtttgtttcataaactggtcggttactgttgtggttgttcatttgagatatggatactgttacattgtagcctttagaggaaatttgttcatgccttgtttctaatttggtatgtccttcccttgctgcatgacattgatttctctctacaagtttctgtctgtcactgtgcatatatactgtggtttgtctcggtgtgtactgtggaacagtcctgtctgctgggatatttggtccttggttcgtctactctgtggtgcatcagggagggattcagggtttctagtttttggagggaatctgcaggcagggatatgctcgttttcagagcagaagcaattatcaagatcacgggaatgctattcccaatctgatactccctcctgataatctcataataagttcacttttagcttttccatttgttataagttcatttttagagcaatattatatcggagtttatgaacgttgggaatataattgtattgaaatataattgtatcgagagtagttaaattgaagaatagttacattagcatttgataaagtaggggtatagtctttttagttttgtattatatattagtattagtatgtgtgggatggatgaaaaatgaatgggagtgcctagcaatcattcgaatgattttttcattcatctcactcggatttttcaacatatggatgtgcgccacgttgcagagggaaacaggctagcttaatagtaagttcgtaacaacagacccaatatgacagttataagtccaaagatgtttaataaaaaaaaataaaaatgtcatcaacatatgcatcagcaagcgtcaagcgaatacatataatctttcccaaaaaaatgtttttggtttcctaaactgaaaatatgaagcaaagtaactgaacgtataatctttcccaaaaatttgttttggttttctaaactgaaaatatgaagcaaaataacttattaaaagcctaaattttatcctcaaaaattaaaagtggaccattatgttaaactaccaacatgatttccgttttcctccgtcagcgcactacctcctagcactccccctaagggcatctacaatcactaactgagggtactctaggtgtactcacatctacaatgcaggccatgtctggtagcccaatgagtgtcccaacccaaaatagcccatttctctcatcctcctctctttcctattctacccctctcttccctctctctctctccctccgcacgaccgcatgcgcattcctctctccctccacccgttgttccactcacagcctgcttccctctctcccgccgctgctcccgccgccgcctgccacctccgctcgtctccctctccctttctctctctctctctctctcactaccaccaccgtctcccgccgccgcccccgaatcgagctcatgggacggaggcggcagtcatcatcgtcatcgtctggtagctggagcagcagatccggggcggaggcgaccgacggcgagcggcgcacggggcggaggtggcagtcgtcatcgtccggtggccggaggcggcagatctggccgctctctccctctctctctctcccgtggaaggtggcggcggcgaccccggaggcggcagatccggcgccgccgtggccggatctggccccccggcggatggagtggcgccggccgcgccgcatcgagacggtggtggtgccggtggtggccgcatcgacgatggcaccgtcattcttcaccggactcgccgacgcccgccccctcctcacccttcctttttctctctgacagcgagcagccgcatcgagcagacggtggtggcatcagcggtggctgcatcgatgatggcgccgtcggctttttcaccgcgctcgcccacctcgctcctcgccctccctttttctttccggcggcaagcggcacctttcgctcgcccttgacgcgcgggccggtgacataggggagaagggtggaagaggaaatcaaagctctggggtgcgtcgcctcaagaacctacctacgcaatgggtttcttcgccccgtccccctggaaaaagcgagcgagcgacgcgtcccccagctagggcgcgcgtttcatcccaggggacgacgcagacgaaaagcctaatggacagcgctagggagacggaccgaagcactacattggtgattgcctaaagccgcgccgatctcccacgtgcgggaaaagcgctcccccctaaagccatgccgttcgcccacacgtgggaaggagaggaggaagtacaaggtgggagcgacgatattgggagtgggcaagggcgccgttttctctgacatatcaacataactccaaaaatcatgtaggggagtaggggatctgttggagtgctttttttttcactaaaatacctgaaaattggttttggagatgaaataggaggaccattagtgatgctgtaagaactttaaaaaaattacgatggtcaaggaaaatatagtttatcttaaatatagtttatcttatggcaataaaatatttaaattaagttgagttgtctctacgtatagcttaaaatgatactccctccattcttaaatatttgacgtcgttgacttttttaaacatgtttgaccgttcatcttattcaaaaaaacttatgtgaatattattcaaaaacttgagtagtagtagtataatatttaacaatgaatcaaatgataggaaaagaattagtaattacttaattcttttgataagacgaacggtcaaacatgtttaaaaaagtcaactgcgtcaaatatctagagacggaatgtgtacataggaatagtatttttgcatatcccaccaaaataaaatgaccaaatgacccaatttgtcgggggtacctttagcgcatgttgctagattgtgcaaatttatcccctttttttcaaataatgaaataatggattaattcgtacgctccctgaatttataaacagtgtttaaaaaactttctatacattaatttctaagaatattgttttaaatctattttctatcttcataacgtttaattcatttatatcctcaaataattataataaatcattcgactattcggtcattcagcataaaagaatagagccgtggacatgcgaacccacatgctgacatgcatgaacaataatctttcatcaatttgtgttatttgcgaaatcaattaaattttatccataagatgactagtggcagctgtagatacgtggtatggtctactctcttgcagattgcgaatagtttatcattaggtattaagcttaataaagggctgtttagattatagccaaaataaagtttaccaaattttgtcattaccaaaagtttgataatattactaagttttggcaggatttcttacgtgtttaccaaagtttggtaaaaaaaataaatagttgcatatttttggtaactttattacaaattgatatagttaatctgaacaacctctaagtcaatgcttgcttcacgtgttttacctgcaagttcacacacacacacaaaatgcatatttgtatctcaagttcagtaggcatgcaagtcaaaactgaatccctccatggtttaaactttaaaatggcatttataattttactgctgtaggttggcatttgttatttgcaatcgctttcatacggtcagagatgcttgtcatattctaccctttggcctccatctgtttctcgttttgctttcgttacggataatatgggaatattttagaggacaaagtggccatccggtgagccaagtttcataattgtttaacccgttttatggtgtggagtgtacccttagcattgcgacatgaatggctgaaaaatcatagttagatttttctaaaatgcagtttagtcatattttaagcaaacagccaacagaaaagacatgtgaaaatggaaattttaatatccactcttcgaaaaataacatgtaaatagcatgggggttgagctgtcaacagcagagagagcactcccctgttacacccataaaaaattctatgaaaaaaagtaaatattattgttacatccgtcccataataattataactgtaagattcaaattaattctaaaatagttattacaatagagtagtaattatcccatcaatcactctcattcaaaattttcactattttaccatcattcatcctcccagtcctacctatatatattattaaaccttaatatatattaaacaacctagaattaaaattattttgggatggagataatattatacgcgtgtaaaacctcaaatttaaatttaacaattttaagagtataaatctatcataattttatcttttttctttctattacgataaatttcaagatgagacttagatgcatgttacttgtaaaaacaaatataatttttattgatatctgttaattggtgtaaagtttgtgcattcatgatacattccaattttgtaaaagcttactattttactcatgaactttaagcagcatatatgaagggtgtgtttagttcacgttaaaattagaagtttggttgaaattggaacaatgtgacagaaaagttaaaagtttgtgtgtttaggaaagttttgatgtgataaaaaagttggaagtttgttgaaaaaagtttggaactaaactcagccgaattttagggaacatttggtttggtatgaactttggaattcatgatccgacccgtttgttgccaattcaggtgaccaaatttcagtacgccaaccatttgcagttgtttttgacgaacctaacttcaaacaaatgcaatttggagcaacaatactattattatagccactatcagagcaaaaacaactactaccttagatgaggaattaataaataatccaaactggtcccctactgctaggttgctgattaagatgagtgattaagcatcaattaaatcaagacgactagctccccactcactgccaggtgggcccaccttgtcggattagaggaaagtccctcactgccatacacaaccattgccggattagctgtccatcgattacaaaaatcccaaatcttttggcgccgccgtcgctgtcgccgacgacaccaccgccgccgccgtcctcgtcatctccagatcgccctctccttgatccccacttgcatcgccccggaggcgcggtggacgagacgacggcgatggccggaaaggatgaggcggaagggctcgaggcgaggctgctgctgctgccgcctgaggcggcggcggaggagccgacgaggtgtggcggcggcgacggcggcggcggcgggaggaagcggaagaagacgtaccttgatgtccttggcgtgtgctgctccgcggaggtcgcgctggtggagcggctgctcgcgccgctcgacggcgtccgcgtggtgtccgtcgtcgtggcgtcccgcaccgtcgtcgtcgagcacgaccccgccgccgccccggagtccgccatcggtaagccaccgcgcgcgcgcgcgccattaatcctccacgcgattctcgcgcgagattctcactgaatcgagtcgtcgtcgtcgtctttgtcttggagtgcagtgaaggcgctgaacaaggccggcctcgaggcgtcggtgcgagcctacggcagcagcggcgtggtcagccggtggccgagcccgtacatcgtcgcctccggcgtcctcctcacggcgtccttcttcgagtggctcttccctcccctgcagtgcctggccgtggcggccgtcgtcgccggcgcgccgccgatggtgcgccgtgggttcgccgcggcgagccggctgtcgctcgacatcaacgtcctcatgctcatcgccgtcgccggcgcgctctgcctcggcgactacacggaggccggcgccatcgtcttcctcttcaccaccgcagaatggctcgagacgctggcctgcacaaaggtaggagtacatgtcaatgtcctcttcaccaaatccatggcgatcttggcacgaacccggacgaacactcacgttgcgaggtgtgcaggcgagcgccgggatgtcgtcgttgatgggcatgctgccggtgaaggcggtcatcgcgacgacgggcgaggttgtcagcgtgcgcgacgtccgcgtgggcgacgtcgtcgcggtcagggccggcgagatcgtccccgtcgacggcgtggtggtcgacggccagagcgaggtcgacgagaggagcctcaccggcgagtccttcccggtgccgaagcagccgcactccgaggtctgggccggcacaatgaactttgacggtaaacaaacaaacaatcaaaaaaatctctcatctcttagtttcagagttcccaaatgtacggaactctgaaacgtccgtgtcgttgaattgtccgtcttttctcatcagcttaagttctggtaaactgattgacgcatccaactcaatagtcacaatagcacacatttgttcatgtcatgatcaatgggattgagaggctgtcacgtttcaggttacattgctgtgagaactacggctctcgccgagaactcgacggtggcgaaaatggagaggctggtggaggcggcgcaaaacagcaggtcgaagacgcagcggctgatcgattcgtgcgcaaagtactacacgccgggtgcgcaatcggcatcgcctaaactctcaacatctccaattttacaacacaaaattcatcagtaacaaagacatttctgttcttggtgcgttgcagccgtggtggttgttgcagcaggagtggccctgatcccggctctgctcggagcagatggccttgagcaatggtggaagctggctctggtgatgcttgtgagcgcgtgcccctgcgcattagtgctgtcgacaccggtggcatccttctgcgcaatgctgcgcgctgcgaggatggggatcttcatcaagggtggagatgttcttgaatcacttggggagatcagggccgtcgcgttcgacaagaccgggacgatcaccagaggagagttcagcatcgactcgttccatctggttggggatcacaaggttgagatggatcatcttctttactggtaagactgagaaagaagatttcatttcagctcttggaatgcagctgctacactgaacaaatttgacagattttcaactgttgtcggtttacgacttgtcgaaaaatccttagtacttgtgatggtttgaattgacttgaacagtgaaatgcttggcacaaattatgtctttggttattgcaggattgcaagcattgagagcaagtcaagccacccaatggcagctgcacttgtggagtatgctcaatccaaatccatccaaccaaacccggaaaatgtgggcgattttcggatatatcccggggaggggatctatggagagatccatggaaagcacatctacattgggaacagaaggacattggcaagagcgtcatcacctcagtcaagtgagcaaaacacatcatttgtagtagtagtacagttcctgacaattaagcttcagaattagctgatcagctgaagctgagctgactgaactgaaatctgtgacgtttacagctcaagaaatgggtgagatgatcaagggcgtgtcgatcggctacgtgatctgcgacggcgagctcgccggcgtcttctcgctctccgacgactgccggaccggcgcggcggaggcgatccgggagcttggatcgctgggcatcaagtcggttatgctgaccggggacagcagcgcggcggcgacgcacgcgcagggccagctcggcggcgtcatggaggagctccactccgagctcctcccggaggacaaggtccggctcgtcagcggcctcaaggcgaggttcggcccgacgatgatggtcggggacgggatgaacgacgcggcggcgctggcggcggcggacgtgggcgtgtccatgggcatctccgggtcggcggcggcgatggagaccagccacgcgacgctcatgtcgagcgacgtgctcagggtccccgaggccgtcaggctcggcgggtgcgcccgccggaccatcgccgtcaacgtggccggctcggtggccgtgaaggccgccgtgctcgcgctggccgcggcgtggcgccccgtgctctgggccgccgtgctcgccgacgtcgggacgtgcctcctcgtcgtgctcaacagcatgacgctgctcagggaggagtggaagggcggcgccaaggaggacggcgcgtgccgcgccacggcgaggtcgctggtgatgaggtcccagctcgccgccgactcccaagcacccaacgccgcagacgctggcgccgccggccgtgagcaaacgaacggctgccgttgctgtccgaagccgggcatgtcgcccgagcactcggttgtcatcgacatccgagccgacggcgagcgtcaagaagagcggccggccgaggcggccgtcgttgccaaatgttgcggcgaaggcgccggcgagggcatccgctgcggagcctccaagaagccaactgcaacggtcgttgttgccaaatgttgcgggcggcgccggcgagggcaccaggtgcgccgcgtccaagaagccggcaacggcggccgtcgttgccaaatgttgcggtggcgatgccggcgagggcaccggatgtggtgcctccaagaggtcgccgccggctgagggaagctgcagcggcggtgaaggcggtaccaatggtgttggtcgttgctgcacgagcgtgaagaggccaacctgttgcgacatgggagcggcggaggtgtccgattcttcgccggagacggcgaaagactgcagaaatgggaggtgttgcgcgaagacgatgaactccggtgaagtgaaaggatgatgttgcaagattgaccagtaattcactctacgaaatgttaagttttaactgatcattattgtgtcattttccttgggctgaaatcatcttgtaatgcatcaatgattgttgtacagtactagtatcattgaaaactgccaaataacatgtaacattcgaaatcctttttttcaatgttgatacgtagttcacgattgcataccaaccctcgtacatgtacatcgcactcaatagccacaagcgtgtcccatttgagatagattattgacagaattattggtttggagtatctaatttactagatgatgtcccgcgtcttgctacgggatatatgttagatatctattatctatctattctattctattctattatatactaaaagtccattaaacttcctacaaacgctcctaagccaccacgtggcactcctacaaacgctcctaagtcgccacgtggcacaatctaatctcaccgtcgatttttactaaagttggtggacccattattttacaccattagattagatctattattgacaaatacttcctccattttttattagatgacgccgttgactttttctcacatgtttgaccattcgtcttattaaaaaattttatgcaaatgcataagatataaattacacttaaagtaatatgagtgataaaacaactcataacaaaatatattataattacgtaaatttttttaataagacaaatggtcaagcatatgagaaaaagttgacggcgtcattgttaacagtgaaatttggtaagcccggagtaatcatcggcttagagtcaacatcggcttcgaagtcctgagattagccgatgagagttgtcaagatgtcagttgtcggattcttgctatattcggttaagggaattgattaaggaagcttgtccagaagagaccaagttcaaataggatacggcatggcaagttatctattaattaggaatagtttgttagtttccttttatctttaggaaagtgtgtttagtgtcctataaggactttatcttttccttttatctttaggaaagtttctgtcttgtccgacaaggacttgtatcaacccatgggtataaatatgtacacccggggtctatgtaatctatcctcacgattaatacaattcggcgcatcgccaccttttaccttttctactttattttatcgtccggcgggacttggcacctgacgcagggctgcatcagtgttcgatctccggcgaagggataagtccaatgttccgtcggttcaggcaattgtatcgtctacgtcggcgtcgttcaaggctgcatcagtacattcaacctcttggattgctctggtttgaatgatatatttgcctacccatttatcatatgtctctgttaatctagtcttagcatatcaatttagctctatcggttgcttctcgttttagggtttctaccgatatcggctaaatcgcgttgctagattagattagcttagacatctaccaccctgaaaatcagtcaacggtttgattgtctggatattggtttcttttcatacttagtgctgcatcagttaagtttgatctactaagtcgtgcttagaaccgtaatctctagcatgctttttgactgccaataagggtttcatcgaggtttcagccggtgagttatctggacgttgtgtatgttcccccgccctcttctagactttatacatttgtaaaaatatgttcggctcataaggattgcatatacatataagttggatttagctgatgacaacaaaggtttcactgtttaatctaatctcgtggatttcatgacatcggaccaccagccgatgtgtgctttaatcttcggatcaatgcttattctatcatatcaatgctagccgattggtttatactagactatattattgttatattttattatcagtagccgattgcctatatatcattatttactaaagtgttagaatctacattggatgtatagccgattgcttaaactctatcgttatcggctggtatcggcatcggctattatcggctatcggctggaactactccatcggcttgtcagccgatcagctggtttatctgctgtttacatattttgtcagttgcaggatcaaactgactggcacgcccgcatctcatcaagatttggacctgcacaggagctaagcagatctcccaggccgatgtgttcgattttttcgtcaacagtcatctattaaaaaacggaggtagtaactacctcgtgtttataacgtacaagcgctactactgtccgtacatatttgtacgatgcaaatgttactgttgttctttccatacgtacaaacgtacatgattgtgaaaacaaaacgataaagctttcctaatcttcacttgaagaaaaaaaaatacacatgtacattaaagacaggaaaaacatacattcataaaaatcaatggtctttaaaatatgattttctacaatataaagataaaatatattacttcataaatataaatatgtttagttaaattaacatgtataataaatattcaatgaattttcttccaaatctatatattatatactaaaagtatattaaactttgtacacacgcctttacaccgctacgtggctcttacataaattacagaaatcttagaaatctattatatactaaaaatctgttaaatgtcctgtaaacgctcctacattgtcacgtgacgctctaataatgatagagaaatcctagaaatttagagtaaaaaaagaaaagcatccaacctttaattttctattaaattagtggatccgttattttaaacattggattagagctcttagaattcccatgctgctaatatctatccaaaaaaaaacataacttgcttacgtcgtacgatcgtctcccacctgaaaaaaaaacttaaatacctacaccatatacgatcgagaaaaagataaagccaaaaaataaaaaaaaacatgcacacatatataggggtgaaaacgggtcgggttcgatcgaatgtcacccttcccacatcctaacccatattttataattggaatcgggtcggacacggatagtgccgaatacggatagaaactcggataatgtcgggcaaaaatacggaacttatacataccaaaatagatatgtacactatcggttacggatatttattccgatatcaagtcgaagcaacaatcttatatatcatataggcaatcactatttaacaatttcatatatcatataataagattatattaggtcattaggaccttaggaaataaatagggtacaatacatcatagtataaccaatacatagtaccaaaaagtacctcacaaaaacgtaatacgtgtaatatccgtataattatccgggtaacacccggattttttaccggataatctgtatccgtcggatactatattcccgaacccgatctcatatccgccaaaaaagtctcaggtacttgaatttgtcccgaaagtaatgtgaccgggcgggtgagtgggacatacccacgccattttcacccctacacgtatataatagaatgggaaaaaaatactaataaggaaaaatcatcagtgccagcactgatttgtggtcaacaacctttaatctatgattttattaaaaataatactatatagatatgcatagttaaacttaatcgtaaacttattgtagtgataaatatatcatgacaaatgacgccaacatgtaatagcaaatgagatcataatgtttcaaataatttcatatcaaattttatggtgtcaaatatcacttgacaaatatacaccgttaatttgaatctacatatgtaaaaatcaaaataacaaaacctagcattgttttttaagtacatcgatctattcaggtttatttaattttgggagagaatgagattctcaaagtatttggaattttcaaaatttttcttatttgagctgtgagaagcacaattaatagatttatgagaaaataaattaaagtttatccagtgataataaaataacagaatttagatttggttaatttttaagtggatctttttaagtttattttgggtgagattgagattctaaaagtatctgaaatttttcaaaacttttttattgctatttgaggagtgagatgcatacatgatagatagatatttcttatatgccactaaaagttcaccggtttccttatatgccatcgtaaattagctattcccgtatatgccatcaaacgaaattttcgctcacctatatgccatccacgtcacccaagagtagaaatagtgttagtttttttgaaaaatgacaaaattgcccctggactccctttcctgctatgtaaagaacaaatcaggatgtgttgcagttaaaactatgactataactttagcaatcattattgattcaacacacaaccaatttaccaaacaaatcaggatgtgttgcatttaaaactatgactataactttagcaatcattattgattcaacacacaaccaatttaccaatgactggatgcaaagttttatttctcttccatttttatagtttatttatagattatagaaagaaatagtttgtattcttttttaaatggcactaagaacaataatttaattagtcctaatttaatgtatctaactggatgtaagcattcagtttagaaaaaaaaatctctcggcttagcaaactgattgtgtgcctaatttgttcacaaaaatagttatgctcaactaaaaaggttaagtgcttaatttagtctcaccatggaagtaagtaacttcatgataccgacatcagttgaataacatcaaaatatgcatcaccttttttaattcgtggtaagaaaactaagacaaaagaaaggaaaagaaagctaagggtaatttcttactttcaatgccacctaaaatagtcagatgacgtggataacatatgaggaattgaaaaaaaaatcatttagtgggatatacgggaatagcaaattttcaatggaatatgaggaaactggtgaacattcaatggcatataaggatttttttaataaataaataagattttagatagttattttgctacaatacaacccttaattcatcacgagaattacgtatttgccaagtagcattggcaaaacatgaataatacaataaaataagcataaaactacttatgttatattttttatggttgataaaaattctaatataccgggtataattgatggacaaatgctatacaccactaaacctaactgtaagtgcactctagagaattagttggtgtaaataagtttgtgaaaataagtacattcttagaattagtaaatgagtctcatatagttgaaaacaacatatgatggaaacaaatctaccgctaaagtataaatctttatcgaaatataattaatgataaggtgttttgcagattttcatggtctctttagctatagtttttattaagtactgttgaatgattaaccccactcatttgaaaaacataatattgtatgtattctattataatttaagaagtacttattactaacttcatatacacattttgcctattctctaccacaaatcgactcaaaacttaaaaaaaaaccatttttatcacctcctttatgtccctctttatccttcaatgcagggtgcagtacttgctataccattgtaaatattgcatgggcatgtacatggttgtgttaaggtggtgtccatgaaaggccaccataggcaatgtaactaaagtgacataattaccatataatcatttgtgattgtaccgatattgaactaagtgttaaaattgtactctaggatggtttttaggggtatggctacatcgacgcgggacccatatgtttcaaggcattacatacgaaagcgttggttggcagatacagtcgacttcatccattaaagaggcattcatgtttattttaacggtgttatcgcattattcggtagatatataaggtatatttagactatttatacatagatgtgaaaataagttatgaacaccgggttatgtaggtagatgaatttttttagtatattaataatgtgtcatttgttttagtgatactaatacagtttcatttattaaaaagtgcacctaactcgatcttaaaacaataacaatgatagtaagtagtggtgacaaacgatcggtttatatattaccaggacaaagggacttttttttttaaatgtaagagatattcttatcacattagtagtatactaaaatctatcatctattttacggtaaatatatttctttttctattgtaggataatctaaattctcttacagtatatacatatatagtgatgtataattccttttagcattttttaataacaaataagatgcccgtgcatctgtacgaaattcctttccgatttatgttttggaaacacaaactataatacatgcccgcgcattcgcgggggctaccttcctagttggagaaatgatacaatgatttggtttgaaatattatgaatatgatttagcatgtttatgtttagtttaagaatgaaataaattatagatataattactatatgcttgcatgttgtgttttgtgtgtttaatgggttgatgtggcagcttgcatgtatgttttagaagtgtcaataaatactaagtttgcatgttgaactttagatgtttagtggatattaactttatagaaagaagggataatatgaatagattaaatattttaaaaataagccaagcaaataacttataagcggtctaaataatagagtgatttttttagtaaaacatattttagataaatagagaaaataatcaataataataggccccgaaaagaacaaggcatatgacaagtacatgacacagcaaagacacatattagaaaagtacaagtcatatgacaaatgcatgacacacgattaatgcaaacacatagagtacaaagggaaagggtaaaaaggtgctatatttataacatatatttttcaccaaaacaattatattttttaactccataaattacctacacttacattaactatattgtaaatttaaaaacttacattacaagtttcaatttttacattgtaattttctaatacatagagtaaaaagaataggattaaaaataatttattatgtacttaaaagagtacatagaaaatatagacatatacttattatgtagaagagaaaatcacatagaaaaaaaggactcaaattaagtgaaaaataagtgaatcaaattttagggcttgtccactttgatgtcattttcaaccttaccaaattttagtaaagttgccaaaaaagtggctacatttagtttgctaccaaattttggtaactatataggagatcctgccaaaattttgataagttgtcaaaatttggtaaggatttttttacatcaaagtggacatgcccatagttttagcaatcccgaaggggaaaacaaacaagatttcattgtgggaataggttccatgtttatttacaacggattttcggcatgtcatcagttgatttaccggttatgagattctccttgggatccatgctcaaaatggatattgaactgaaattccaaacaatcccacgtggatgggctgttattcaggcccatccaaacaataccttaatgggctcattagcaaaccccaacaggccaacactgctacatcaactcagcccagatacgaaaacaaagtccagaacagaaggcccaacaaggctctgcactctgaatcttacacatctcctttggtcagagtcaagctctgaatcttagcagccatgtcgtccatgaatttctcatcactgtcctgttgcaggatcttccatctttctgttgcttcctggacgggtcaaaagatatacatctccatcagattcagcaggcgcggatctcgtggactgcaaagcatggcgacacaatgtcgacattgcttgataaccatgcacacattcttcagactttcagagttccagattcaacagagtctgctatctcgtttcaaacccacaaaggtaggcaggtgcaccctcgatcacaatcagtacccccagttttagtcacacaccaccaaaaaaagaaaaaaaaaactacacacacctctacacattaacaatatataagttcaattagaatgctacaaatactacaaaattgcgacggcgagtacattcacttccattttttcttctcgacctataatttaatttcctctacattagtccctgagtgacgcttgtctaggcccatttggcgagcatggacatgaggccggcgccggcgagcatggcgaggttgatgccgagctggagcttgcctttgctctgcaccctggggttcatgaagtcctcggcgaggaggtcgacgagggccatgtagatgaggatccccgccgcgacggagttgaggatgccctccaccaccagcgccgtcgggctgctctcgttgtacaccgacgagatgcccacgccgacggcgatccccaccggcgtcgtcaggcagaagaagaggaccatcgtcacgatcgacctcaccttgaacttcgcctgcatacattttcaggagaattaaattaactcatgctgtgttattaaatacatttttcaggagtagtatgcaaaaggttgatattgccggaactaggcaacttgtaaattaagccattccatttgtatacttcttcgggccgttctaaacagaggttggaaaccgctgattagccgcattgtatatataattaagtattaattattaaaaattttaaaaaataaatttatttgattgcataagcacattctatataaaaagttttcgtacgaaacatatcgtttgtagtttaaaaaatgtgataacagaaatcgagaagtaactaattaattaaccgatctctgatttgaaacaggcccttaagccctattcatcaggttacatttcagcttttctgttctttgtcttatacatataccagtccgaaatactatcaaatcatgtaaagtttcaatgctttagatgatcactactttgactcaatctcgagccagttagtcacatagccttccttggtcaaatcatcaaagtaatatagctcccttttccctctttacatatatattgtttttcaagaataaagtgccctatcttttccatagaatcaagcaagtggattagtagcttagtcttttttttgcctcttttgatggagaccatacaatacaagaccaaatttccagcttccagtgcgcgaaacataaaagattagcacgaaaacactaaatcatgctacgacaagtttagtgtaaataagtttcattcatcggattatctactttatagtacaaataaattaaatattttaaaatataaaaaaataaatacttctaaaaacaagtggtgtaaataatatagtactagaagattttttttagaaaaaacatattttgaagacgctgaggaaataatttatgacaataatccggtgaaacagctgaactacatgaatgatttgagccaacaaggctatatcttttaagatgccgtgcaagataccatttttacatatatgaattttgggtaaaaaaaaaacaccatgtagtaaaagaaaaagagagtagaaatatacctgcacgatgcagccaccgagtcccatgccctcgaacatttggtggaagctgagggcgaccaccagcggcttgatggtttccggattctgtgacgcgccgagggagatgccaatgatcaccgagtgcaccacgatccctagctctagaacctaattaaaatcaatcaattgtataagtcaataatgatacacaatatatattattctgaatattgcactcgtttgttaaattctgcacgcatttttctttgcattttacatcaccgaaaatgatatatgtacgacacacattgaatttgaaacctttgggcgcatgtgccctcgtttttccgcgattcggctctttcttctatcactccataatacgccgaaaatttgatctttggtataaatgctattttcgagaacgccaatttataatatatggtgggatctcttataaaaaaaatatatgtgcaaaagaaatgaatacacttaaattccattttaattctgcaatatttatttgaaacgtacatactactccctctatccctaaatataagggattttgattagatgtgacttatcctagtacaatgaacttggacatgatttatatctagattcgctgtcttagaatgtatcacattcaaccaaaatctcttatatttaaggacggagagagagagtagtaatgaaagtgtggaaaatgacagtaaaaaaaacagaaggttactgagactgctgtttcttacctatgggttaattaaaccaggctggcgtcatgaatgaatgcatggtaattagctaggtgttacgttaattaaaggaggtggcctctcacctgagagatgacacgatgccggagagttgtctccttgtcgtcctcgccgacgcccgcgacgagcgccgacgagccgtgcgcgtggccgtgcgtcgcgtgggtgtgcacgtgcacctgtccctcgtgctcctcgccgccgccgccggcatcgccgacgacgtggtgattgtggtggtggttgtgctgctgcgtcgcggcggcgctctgcttctcctcgtccgcgacggcggcggcggtggcggcgtccttcttggacagcgcacgcgtgaagtagccggtggcgagggtgtcgacgacgagcgtgccgatggcgccgaccatggcgccgaagccggcgaaggggaactccttccacggcccgccggcggggaggcagtcgtcggtgaggttgtcgaacgcgtcggggaggatgtggatgaaccccgtggcgaggatgacgcccgccgcgaacgccttgacgaggaagaacacgtcgccgtcggggcgcagcgcagggacgtggcgccccagcgaggggaggccgcaccccagcgcgccgcacaccaggatggagaagaaggccgcgatcttgagccccctcgcccgcgcccggtcccgccccgccgccgcatcctccttcccgcacccgccgtcgccgccgtcgccgcgcgccgccgtggcgagcagcagcgccacggccgcggcgaggagcacggtggcggtggtgttcgtcctcatggccgctcttctgctcctgctgctatcgcggattcgcgggttttatagattcggatggtgaaggtgaagggagtaattagggttttaatcaccttggattagtcgctcggtttaaatggggggattaaaaggtgaatggtagtagtaacacagagtgacgacacttgacagtaactcggggtgaaatttttggttgagggagatattttagtttttgttttggcaagtaattacggcgtagaattactaattacgcaaggatgacgacactatttgtcacgaagtgttgacatgctgagtaggagagagaagtgtagcattcgagggtacgcgtgtgagaatttcaggccatgaaacgcgtaacgaccggaagtgtagcattccaccgccgtcgccgtcttctcccattccacatggatgaaggtactcgatctattcaatgacaaatgggttcgaggagtcttatgtatcgttaagtactcccctccatttttatttttttttttacgcttcccacaggcccgattaaactaaggaagctgtgaattaacttgtttgcccttcactcttgcccctttgcactaatgcgtttcgtccatacaggggtgaaaagggcaagggtggaaattctcgtatgggaggagggcgtctgaactgcaagcgtcaaaaaaaaaaaaacgccttcagagcatctccagcaggaaccttaaatccagcccctattcaatttttgagagttaagataaaaaaactagatccagcagggaccctattacagccccaaaataagaagggcctcaaatcctcccctaaggcctcagtcctaggggctccgagcacggccccatcattctttttttttggcgtggataacaattttgcttcgcgctttttcgtgttattcctgcgcggctgcgacgagggatcttctccggcgaccaccggcgaactcccagcatctccgccaagcctgccccaaaaggtaagacttttccacacatttgttcgcccgtcgtccacaaggccggcggcggtggtccatgcgtacgcctggtcaccgacctccccccatccgcctggccatacgccggccgtcgcgtgccctctgagactgcccgcacgcacatcacccacttgcatggtgtttgcccccacgctggcctctgcccgatcatattttcagatttcactggccggagcctgtacaccgccgctgccccattgatttttctggaaaaaacttgaagttggtcatgtggtgtggtggttgagtagtagaggagatctcagtagtagagtaccagtcaatttttctgaataaactcgttcttgactacctgtggacgtggtgacagatggttatggtggtgaatgatttgtttttaatatttttttgaagaattgtagtggactgtcggccaggacaatctaaattctcaactagtatatatcactgtacttatagtagcactgcattgtgtagcactgtacaattgttgcaatggatcgattataaccatatatatatgcactgcttttcatagattgaatgttgcgtactgtatatgtgtagttggatacgtgtgtgtatatgctctaaattttcttattaattttatgatcttgtgatggcagtgttttttacatggacttctacgacggtgacgacgacgacgacgacgatcttattaccgaatggtgggatcaagaggagttgtttgacgatgatgactactacattgcagctgctcttcttacggacatagagcataagaggaccaaaagaaagcgtcgtggttcagtcccaggtcgtgagataatttatagggataggtttgctggcaatttgcgcatagtggctgattattttgcagatcctcctgtatataatgcaaaattatttaggagaaggttcagaatgtcaagggagctcttcttgcgcatcgtggctagtgtggaggctcatgatgactacttcaggtggagaccgaatgcagtgggtcttctcggtgctactgcattgcagaaggtgtatggtgcaattcgcatgcttgcatatgatattccaaccgatagtcttgatgaagttgtgaggatttcagagagcaccatgatagaagctttcaagcactttgtcaaggctgtggtagatgtgcttgctgatcaatacttgagggcaccaactgctgaggacactgcaaggttgatggctataaacactccaagggggttcccagggatgttaggttgtattggctgtatgcattggaggtggaagaattgcccaacaggctagaaaggacaatactcagggcatgtggatgggccaaccatgattcttgaagctgttgcatcgaaagatttatggatttggcattccttctttggactaccaggttctcttaatgatatcaatgtactacagagatcaccactctttcaaaggcttacatcaaggacagctcctgagctggagtttatagtgaatggaaagaaatacactatgggttactatcttgctgatggcatatacccttcttgggccacttttgtgaagaccatttccaatccacaaggtaacaagagaatacatta

SEQ ID NO: 30453 - DNA, 290 bp, Oryza sativa
ttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgtggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgac

SEQ ID NO: 30454 - DNA, 3107 bp, Oryza sativa
  unsure (1)..(3107): unsure at all n locations
attagtctcacacctctcacataattatgaatgtaanacctgataataatttgctagcctcctggttgaagattagatctgtacagccgggtatggttgtccagaatggttgggcctgtcaagcatgggtgtgctgttcagtgttattanaatttctgattaattactccactgttttacttctcttaaatgttttgctgaatgctgcttttgcaaatgagcctatattaggccatcctttggtattcttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccaaaaacatgttttgttaaaattttcctttcttccttctccagaattctttgcaaatcattttatcatcctctcccctcctgctttcaacttgagtagctctaagacattggaacttgaagacgccaatgaggtctacttatggaggtcagtcaagtggatcaaggaaggactgaagtgcccagatgtcaagatggaatgaagtttggatcctaccttagaacctatgccgccaaagtgtctttgaagaatagttagtagggtagaacgcttgttgtttgctttgtgtgtaggtatggttgcattcccatcattggagtagttcaatgatgagtgtgtaactatactaggttgcttgcttaatcaacttgaacaatataatggtctacacacaccagatcagtggtaacatggttaaggtcttaactttagcgtaacccctctccttctatcttctctaatctgcaacggatggtgaacactcgcgccaataaaagtggaaataataacaatgaagggaacccaactcttgctcaagttctggctcaacagactcagttaatgaatatgatgatacagcagatgcagaaccagctcaaccaagggaacaacaatgctccaccgccgcagaacaagttagctgattttcttcgtgtgaggccacctacattttctagcactaccaacccagtggaagcaggtgattggctgcacgctattgagaagaagttggaactgctccagtgcacggatcaggagaaagtcgttttcgcttcacatcagttgcaaggacctgcatcagaatggtgggatcatttccggatgaacagagcagaaggacaaccaatcacttgggcggagttcactgaagcattcaagaagacacacatacctgcaggtgttgttgctttgaagaagcgtgagttccgggcacttaagcaaaaggatcgtaccgtgacggaatatcttcatgagttcaatcgtctggcacgctatgctccagaagatgtgtgtactgacgaggaaaggcaagagaagttcttggaaggtctgaaggatgaactgtcagttacgttgatctctcatgactatgttgattttcagcagctggttgacaaagcaattcgacttgaagacaagaagaacaggatggataaccgtaaaaggaaaatgactgtattccaggaggcacaaggtagtagccagaggcagtgtatcaagccactccaaattggtgaatcttcttccgctggtcaaggacagtcgcagcagttgaacatcggtggtgagatcaaatcagagactaatgaaagcaaagaagttaacatcgagcaagctaatcagccggtgccagttcagcagggtcagtttcaagagaataacagtagtggaagggagcagcaggtatgtttcaactgttacaagccaggccactttgcaagagagtgtccgaagccgaagcatcagcagccgcaaggtcaggtcaacaacattgttgtcacaggagccaatgcagtgccagttgcgtcttcaagagtcgtgtcttcaagtgttacagctcagccaccagtttcaaagcggcagtagtttctttaaagccttagaataattatcggagttatggaataagatagactgcagtttacctattccctttttctttctagccgttccgaatctcgggacgagattctttgtaaggggggtagtttgtcacatcctgatttttatttcagggtttataaattatttaataaattaataatagaatttatattaagtgttctttaatttacaagtgaagtaaaatgtggaaaataaaattttctaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaatgtttttaaaagtcttcttttggctttgggccgaaagtcggcccaaaacctctctctttccttttctccctccccggccagttggcccaagtcggcccagtccgcgccgccgtcttctttttttttaaccggtgacaggtgggtcccggctgtcaagcttgtttttctcctccggccggcgccgcccgaaaccctaacgcaagc

SEQ ID NO: 30455 - DNA, 5683 bp, Oryza sativa
ggcccccttccgcccctccgcgagggcgattttgtactgtgcgggggcccgcctgcaaatgggcggcgagggggcatggaattttgcagggggcccccttgccgccctccgctagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaaaatatgaagaggttgccttcagattgtcaattatatagcgtcgttttcactgcaatatatgtgaactcaatgagatacattattcattagatgtgacaagacaatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagaatcccgctgcaaatcctgctggacaaggaccatcagtttcatacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgcttgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccaaagctaggggcgctcgaaggcaaacgaggtcctgcgaggatggatcatcaagttacgacggggtgatgtgttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccggacgcatcttctcctgcatccggtcgaaggtcaccctctactcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcatcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcaatcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactatagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctataagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcaaattactaacacatattaaacaagagtccaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggtcttgcgcgcctgcttgttgttccttcaccaggtggtcgcctaccatcacttgcctgtccagatggactagcatctgcgccgcttggaacttctgcattcttcgggcatttcttgtaagtatggccgagcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcctgaactcatatatctcctcactccatgtatgaaagattgcttctttcctgaaataatttgagacgtacacattgggagatatgccacaatcaccggcagcagcaagaacgtgtgagcaaggaacgtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccttaaagtacgcttgcgtgccgtgaaggatgaattcaacaataccaaccaatggaagtaccggaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgttagtctcgtcaccttcaactagtggtctgcgagattgctcatctgtttgcttcgttgtcaactcatccaacttgtcccacaactcattaaatttcttctcttggttctgcgcacagagcctcttaaagagctccataagatgcttgttcttgaattgcttgtagaaatttgcacccatgtgacgcatgcaccaccgactccgaacatcaggccacttagctggaagtcccttctcatcccaaccattctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattatt

SEQ ID NO: 30456 - DNA, 3173 bp, Oryza sativa
caccggcgccggaggcaagattgataatttgttatgtgtctctatccatgagagattgatcgagccttgcagctttcttgtattcctctttcaggctttttataaggcatactagctaattttgaattttgaaacttattttactttgggtggcggcttatcagctgcaacgaaatttaatttgagttttgaatctaatttttagagcctattttaaagctattcatcgcggtgtattttccaacattgatttttaaatcggaaagaacatgtataagaaaagtctaatcatatattatgtctttatgcttcgcccatttttttcgtagcttattaattagccatagaagaaacgatgagaggcttagtcacctttattatttagcttttacgctttttactattttacataccaggcaactgacttaagacatcgtactctttgcggtttatggtcgttcagagtgcgtccccaaattttggtggacctcctatgtcactagaccaaaaacaatattagccacatgttacacagtgcaaactccacgagaccacaatacacaagtagcgtatagtgggtcccaccaataccaccttttcactttacactttcccctatcccgtctcttcctttccccaccgcagagagtcgggcagaaccgacacgacgccggcaccgagcagcccaatcggcagcggagcggctcgaagcagccggtaggggtgggcattcggtctaaccgaaaaattcggttcggtacatcggtctttttgaaaattcggtctttataatctcaagaccgatcggtctccaacaaatctcaggaccgagcaaatcggtcttcggttagttcagttcggtctcggtcatagaccgaactaaccttaaaaacagcaaaaacaaagcaaatcaacaaaactatctgtaaaaacagcaaaagcaaagcaaatcaacaattagtggaggcggcgccgggccagctggaggtggcgccaggcggtggaggcgaaggcgcgccggctggaggcgacgcccggcggtggaggcggcgcgccggctggaggcggaagctgcgcccggcgatggagcgaaggaggatgtggatgggatggagacgggagttgggacaacaccgctccacgatggatggggatgaaacgatgcgtcaatgcttgtgacacacctgcccctagggtttcttattagtgggcttattgggccaactagatctgttgggcctaattaggttatttcggtcaattcggttaattgaggcccatgaccgaataaaccgaatatatttcggtctttcaatagttgagaatgaatttttcggtctcggtcttttcggtctcggttcttcggttcggtcttattctgcccacccctagtagcggggcggctcggcacaccacccctcctctctccctcgagcaacgctgagcggcggggcggcaggatctagtggcgggggaccacgacaagcggcggcgcagaatgggcacggcaacgaggcgacgcagttgcggcgggcggaggtagctccgagcgacggcgcacgatgccagtgctgggcgcagccctagcggtgacggcacgcgacacaggtgctagccagccctagcggcgacggcgccgactctgaatcgacgtcggcctcgaccttgagcgcctccacttctctgacgcctccctgtccccttctcatctcctccgccgcgctttccccctcctcctctggcagctgctgcagcgtagaatggggtagtccggttcggcgtcgagcggcctctcccgagcggagtagcgagctcagcggcgtggagtgcggggatgctgacgaggtctctttcctctctttcctttcgctgatagcgcggaggtcaagcatgggtccctccttcaaacctgacgaggaacccgtagccaactttagctacgcgaacttgagaatgctatgtagattgagtacgtggcagcgaatattctccttttgctggtgaggctggataccacggaggcccacaatgaatggcctaagatgtgatcactggacacgcatgcatcttttccacttctacttccaatgggcgtacgattttctttgcttggtacgtgtttgctggcgaaacatttcccttggtaagcatgttcaccaagagacataatcaataattcagtaaagtttttatcagatcaacggtcgctagcctttaattgtaatagctcaagagtactcccactgtcttaaaaaaaatgaggcatttgcaaatttgcaactagttttttcaattttgcaaggatgacactcgaatgatagttccagtggtatttttgtaattttctagtggcagttttaaaataacaattcaaagcattggtaaatttacaattgcccgtaaaaaaatataatactgagtttatatttgaatatacactacgagcctgtttggcatagctctaactcccgctccacgcctccacctgtccaggagctagaactcagctaaacagttttagctctatccaaaataagagcgaagctaggtgaaacgctctcacaaaataaactacagaggtggaacagtttaagctgctccacaacttcactccaaacccaacttctgaagctaaatttaggagttggagctctactaaacagactatatgtccatatttaaattcttttttaaaaaaaaactccaaatttaaattcagaattgggttcttttcgaaacatagggaataatattctacgttaattttgtactaccttcttgtaacctgggtacagcagtgtagcggagtccaatattaaactttggaaactttcgaactgtttgtcacttgtcacccgtacagtactccctccatcccacaaaatatcaactcctagacttccaagaagaaaatagtgggaagtaaaaatgatgaaaatactcctcattattagaaaaagtagtaaaagtaataggtaggtaaaaggtatttaaggataaaacttatcgttttatatgctggagtaggtagagtgatagaagttgatttttgaaaaaattccctatctagcataaaaaaaattgttcttccctctatagcacctaaacttcaaaagtttcctatctaggcacttctaaaatttttcttccctatgtagcacttccgttagttt

SEQ ID NO: 30457 - DNA, 8921 bp, Oryza sativa
ttcttttgatttaatgtaacacggtaaatataacatgccgatccactcttttgaaaaaaataataattaccctcttgtggtttcacttgtcattaattaacttaagtaattaataaccaatatcatgtacaggcaagtctggaaactaaagaggacagaaccgtcttttctcctgctagttaacactgttaagtgcaaaaactaacggaagtgctacataggctacacagggaaggaaaattttagaaatgtcttgggaacttttgaagtttaggtgttatagagggaagagcaacttttttttttttgctagatagggaattttctcttgattttttgtgagataaaatttaaacttcagaaattaagttttttgggatcgagggagtacgtacgtgtagctttacatcaggcaacatcaggttcattatgaatgttttcaggtggatctgaagcgtatccgacattgtctatcattccattgaaattgttgtcttcagccgtaccatctaatacggatgtgtttaattctttgggtgtaaagttttggaagtatacggatatatatttgaattactaaactgtagactaataacaaaataaattataaattccgcctgtaaactgcgatacgaatttattaagtctaattaatccgtcattagcaattgtttactgtagcatcacattgtcaaatcatagcataattaggctcaaaagattcgtctcgcaatttatatataaactgtgtaattgatttttttccccacatttaataccctatacatgtgtctaaatatttgatgtgatgttcttggcaaaatatttaaatctaaacatacatcaatattctcctcttcttcatgctcagtccaactaacgaattctcgttaggcataaaaccccttaaaattaacggactgtagatcaatcttttgttatggaactgtaccgattctgattcctacggtccaatgagagacgatcttctttcatgcttggaattaatttggaacgttgatcatctaacgctccatgataaaagatccatggaaggacaacaaatgcattccacgctctcttgttcgaaccacgtatattcagctccgattcatttgatctgctgcctgcatacaaagcgttaaaaagaccatccaaaatcaaatggatttgaaaccggcggctcacacagaaatgaaccgacggtaatctgacggttccgataggaagttttgtggtagttagtaaaaatataaagtcttatcttaatatgggcctgtttagttcgcaaaatgaaaatttttgggtgtcacatcggacgtttgaccgaatatcggaaagagtttttggacacgaatgaaaaaataatttcataacttacttggaaaccgcgagacgaatctttttagcctaattaatccaccattagcacatgtaggttactgtagcacttatgactaatcatggactaattagactcaaaatattcgtctcgcgatttcctccctaactgtgcaattagttttccttttaatctatatttaatatttcatgcatgtgtccaaagattcgatgtgatgttttttggaaaaactttttggaactaaaccgggccaatatttctcgctgcttcaacgttatgagttaaatgctcccataacctcgagtatttttatttatgttttcttgactcagtagtcgtattcttattggggcatagatcggagatgtaaatcatttctattattaaaaaatgagttaaatgagaatgctccttttttaacaaaggaagtttacagtatttttttaaaaaaatattttaattcttgtgcaatacattcatctaaaaatccttcgttccaaagaggccaactttgagagagagaaaaaaatcagaaccacacaggaaataaattaaatcacatagtgaggaggactgagttttgttacaatgttaaataaataaaaataaaaataattgtattggagttgcaaacaagaagattttcactttggctagtcttcttaacatgaattgtgcgcagagtttgacacttgatgactgaggaaattcgagaatcgagaccgacagagctgatttgggcctagataggtccacgaaccacgatggcccaaattatagcccaaccatacccagaagagggagccagcgcacaagcctagatagacccgagccgaggaaatcagccagctcgcgcggcagccgacgcgcgacgacggcggcgccccggcgagcgcgcgcgcagcacacacggcggtcgcaggccatcccatcaccgaggctggcatcagcggcggcgcgcgctcgcggcccggtgctgatctcttgcggcgaccgatgttttggttcgctggcgcgcgagctgcggcgccgaggcatggcggctggtgtggtgtgattggccggcggccggggacgccctattgcggggcacgctgccggagatacggcgaggtccatgtggcgcggcgcggtagctagggttccgagagtagccgggacacaaaggcagctatgatatgaggtgcgccccctttggccctaacctttgcaatttgtgcctatctgtctgctttgatctatcatcttgtttggtgcgaatcaggcggtgtgagattgatgcgtgcgtccgtctctactcttatttgcccttgattgtgctaattttgtactattgggttcatgtccaaacttgaggttttgcaatctgacacaaatctagctttgacgattgcctagcttcgatcggaatactagtgcaaattagttgaggtcctaccatttaattggtcctaccatagatgtattcaacttcttttggaagaacttgacatgaccgctgcctaaaactttaatagatgtacaagatgcaaatgaaaatggaaaaggtagtagctctgtataaccattgtcatttaaatacaacactagctaccatcctgctgatgctttatttcatacaccatgtatgcttgagaatatatgcttgatcttaaggatttcggcagaaacttgccccatttcccatcggtccttaggagatgcagcagagcagcatagacctattctgaccaatggaatgatgcaattctgcatcactgttgttatgttcatttcaccttgtagcatcctgggatcaacaatctcataggtattcttgggaaaagctcttgcaacatgttcatgaaggcttgtaccattattgattttttcatcagtaggactactccctgttatcatttccaataaaatcacaccgaagctgtagacatcacccttggttgatatcacttcactcatgccatactctgcatttaatttatgaatgtaataaattagatattttatatgtcctgtctccacaattctatgaagaacaaaaagagttggccattatgaatatggttatctcacctggtgggatgtatcctatagatccctttaggcaagccaaagattttgaacttccttcatatgcatttgaggtattgtttagacatcttgctaggccaaagtcactgacataagcaatcatgtcaaggtccaaaaggatattgcttggcttcaagtcacaatgtactagcggagatgcacattggttatgcagatagtccaaagcaaatgctacatccaaggctatattgattctttggttaaaagtcagagttttcctctcactgtgttcatgagcccttggatgtagccaagtgtccaagttcccgttggccatatattggaacacaagggctttgaagtctgccccattggaatccactgaagagcacagagtgatgatttttacaagatttcgatggcgaatgtttcttagagcttcacactccacactaaagctcctttggcccccataaattccaaggttaaatactttgatggcaacctcatcttgctgacggtctagattacctttgtaaaccgtcccaaacgatcctgtgccaattaaattggcagaactgaacctatctgtagcctttacaatgtcttgatatgttatgtttttcacatggtcattaatttgttggcaatgtgggtttgcttgcatctccttcattccataaattctcacaacataggatagaatgattataacagcaatgatagctggtatcagtatctctaggactagaaccaagatcttgagtttccttttcctctcagccaaaacagaacaagaaggaataccaacttttggaacgcttgtacacaaatgattatttccttcaattgatactgcattgtcaatgtcgaaaacgccacccgttggaatgactccatcaaaattgttgaaggataaattgaggtcatgtagggaactcagcaagttgaggaactgtgggattttcccagacaaattattccgagatatatccatctcttttatacttactaatttcataaaagattgcggaatacctcctacaaagaagttgctttgtatctcaagatactccagagtcacacactggccaagggaggatgggatctctccagacaacatgttgtttgagattccaagtttgttcaaattaatgagatttccaacttcgtctggcattcctccagtcaagtaattgtgtgacaagttcatctcttgagaaagcgaagtaattttgaatattatacttggtatattcccatctaatgagttgtgagcaaggttgagtatctggagttgagtacattgccctatacttgaaggtattcttccactgaagttgttcccatccaattttatatctgtcaactgaactaggttgccaaaaacgtcagggatatggcctgagagcttattttgtgcaaatgatagaacagttaagttgttcagatttccaattgtttgtggtatagtaccagtgaaaagattgtaatccataaacaatatactgagactctttagattacctatttctggcggtatcggtccatagattttgttatttcttagccataatccctcaagattgctagaaagattgccgattgaacttggcaaaattccttggaagctgttcccatctaacatcagttgagtcaatttagagcaattcgagagtgatgtcataaagctccaatcgcccggttctagcatgttgtatgacacatcaagttcttccaaattcggtaatgatccaaagaatggcacgagtccagtgaaactgttattacctaggtagagcatctctaggtggtaggcattgagaagtgaagctggaattgggccaacaaacttgtttgccgggaggatcaagccctgaatttttgtaagtgtgtagccaatatcagagggtaatcttcccacgagcgagttgtttcccatagcaagaaatgtcagggatgaaatgttgaagagagatggtggaactagaccagacaagttgttcacactcatggtcagtatctctagtgttcggatatgacctaagctctctggaatgctaccaactaaattgttcttagaaaggcgaagttcaagtagggaagaaaggttacctagtgagggcggtattgttcctgagatgcaattgtcccttaaggaaatatatttaatgggggaggacatggccgcaatagcgggtatagaaccaacaaagctgttttgttgtaggaaaatggcggtaagtgatgaagtattgaatagagactttgggacttctccactaagattattgctcatgagcctaagtacttggagagatgagctgtttgccaaggactctggtatgcttcctgtgatatcattattcccaagatcaacatatctgagagaaaagctgctgcctagagatggtggtatttcatctgtgagcctgttgctagtgaggaccagtgcttgcagcttagaaagattcccaaaagcagaggagattctaccttgcaaattgtttctgctgagattaatatcctgaagatgtatgcatttgcctaggctagctgggattgcaccttggaaggaattgcttgacaaatctaggatttcaatttgggaatatgaagaaagttgagatggaatgttaccttctaaagagttcatgctgaggttgaggttcctgagttttctcaggaggccaagcttgggtggtatgctgccatggaggctgttgtttgacagttgaagtgtcataagagaggtcaggttggcaatgcaaggtgatatggtgcccgtgatgccttctgatgagagatctattgcaatgacccggggaggacttcgtgagctgcaggtgactccatcccagttgcagaaattcaaggatgtgttgctccatgaggatagaactctagatggaccagagagctgagacttgaagcaaaggagagcctgtctatcgtcagtttcattgcagatggctaacgatatgctgcaaaagatgaagtgacaaagaacccatgcgatgtttggagacaggacactcgaagaggccattgctgttaattccaactatcaacaagagaccttctccgcaaatggctgatcaaatgttttgttggtagtccaagatatagtggcaaggaacaaggaagatgcacaaccagatttgctacctggtgtttgttcaaaacagaaaacctctatccaacactgtcagcaaagcaccttgtaattgagttgcttggaaagggtctagaaaactggaaagtgaaatgtggcatgcaatggaattactagactggtcgttcttggtaggccttttggcactcacacaatcccccatttagttattctgaaactacaagctgatgcccaagatttttgactcttcaggttgccacttaccttcctacatctgctagcctcctagtcctaaagaaaaactaaccccgactagctatgattctcgaatactggtgccatgtgaacgcacaccttattcctgaagagaaatatcgatagatgtgattcttcttgagttcccagggaatataatggatctctgatgatctatctgtctagccaacaaagaaataacctttacaatggctatatattctggagacattgggtagctgaactgaacagccttgtgccttgccggactagctacaacgaatggcattcgccgacagctccgccgcctccgctttcccggcgtccgcttcagccggcgatcctccagctgcaccggtggccgttccaggcggcaaccttccagctgctccggtcgtcaatcctcctgctgcaaagtctccagcagccgctccaggtaaagctaagctactgccccacacaaattgcttccatattttctctctgtatacacatattcattattctcttggtgtttttgttattgatttgtgatatgattaatattggtttggcacttaacggtgatgtgctgcagatccgccgatggatccgagtgacgagggtcgttacttccctacacaccggcttcctgagtatctgaagaatcatccctgagagactacagggacgtgctgggagaaccgtcctccattaccagaagattgtcgagtcgtcgtcaagctgcaagcattgctaactgctagagcagttacctacctactggatactgcgttacatctacgtgtaccgcaggatagattgtaatgttgttttcagatactccggatactgtgaccagtgaataaatcccaggcattagcccggtttctgctagggtttgtgcaattgtagacaacagtcttgtacaataaagcacagcaggaaggctgccaaaatataatatgtacatggttcattgtccatcagtctttgttattgagtgtttttgttgtcttggacgtgattttttcaggcttcagctagctctgagccgctgatgtgcggctgcccgcgcgccaaccctatacgtatataactatatacttatacgtataaaatctaaacgtattagcatacatataaattttatatgtatatacatatacgtgtgtatatatatatatatatatatatatatatatatatatatatatatatatatatatatatatatataggacactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatacttaatttcaacaatggtgcccgggcaccatggagcaccaaacaaatttactatatatatatatatatatatatatatatatatatatatatatatatatatatatatatatatatatatatatatataaagatacatgtactgtataaatgttttggtacaaacataaactttgtataaatacggctaaagggaaaaaagcctgctaaaaaagaaaaacaaaatgcccaatttggcctgtgaaaataaattgggtcggcccgcttaaaaaacaaaagccatccatggaaaaaaaaaaaccaaaaatggaaaaggctaaatcccataggccgaaagaggaatgggccaactgaccgcgtggatcagatcgcgctttatcagccggtgattgcaacaaatatactttgaatccctcaaataaaggtctaatctaattcgtatctctcaaccgcaaaaccaaatatctcgaacctccacctattaaaaccggtgtaaactgacgggacaggtggcagtgacgacctcggtctcctcctcatggatgctcaccacag

SEQ ID NO: 30458 - DNA, 14160 bp, Oryza sativa
  unsure (1)..(14160): unsure at all n locations
tttctcctccactcttctttccctcctccatcatctcttcacctacatctccccctggtatggcattcatctcctcacataagtggcgccgcacgatggagactgcgtccaccttcgtaatgcctcctgcctcctagccccctcgagctccttcatcactgttgtcctactgtcacccgcctttgttctcttctcgaactcctgccgccttgccaccgctgagatacgggggcaatacaacttcctcaagctcctccgtcactgtcgccttctcctcaacctcccgtcgccatggcaccatgccacccactcttgctgctgctgaatccataagattagggacgaaggagagagagagagtggggagaaagaaagggagagaggatgatatgtgggacctatatgccgactcagccggttagcaaaaccaccgagatagtaattttgtactggttttaatagttgggatttaagatttctggtattatggttaaaggatactaattagattgacgtacgagggagtcacgtggaattactccactgctgattagcgtttcgcctgaggtagtaaggttgggctgggcacttcagagctgagaatatgacaccgggccttcactgctgcacagcttacgtgggcctagagaggtccacgagatacgggcccaaccactagagcgcaccgcacgcaagcccggatagagcccaccgaggaagtcagccagctagagcggcagccggcgacggcggcgcctcagcgagcacggagcccacggcggcagcaggccatcccctcaccgtgggctggcacacagcagtggcgcacgctcgtcgccggtgctgctctctgcggcgaccaatgcttgctctgctggggcgagcgccggtgaggacatgccggctggtgtagtaggccggcggggatgccctctatgccggcgacagcgaggcccatgcgagtatgtggcggccgcgctcgagagggagcggcgcggcagctaggaggtgcgcccctatcctatcctatgaatgtttgatctataatctaattttgtgcgatttacccggtgtgagattgatctggatgcctccgtctccaatcttatttaccttccattgggctaattttgttcatgcccgaggttttgcaatctgacccaaaactaagcttctgcaaataccaaattggacttgatccgagagtagttgtgcaaatcggttgaggtcttaccatttgcttgatgctcatggaaatactcaacttttttagtttttgatgaagaacttggctggagcgctacctaaagttttaatagatgtacaagaataaccataaattagcaataaaaaaaacttccccaacgcccgcgtcgctcgccccagggcgacacaagcggcgacaccgcgcacgccgccacaaacttctcctcctcccctccgcctcgccgccggccgagcagctgccggcaaagccgcgcggcggcaaggacggcggcggcggggccttctccctctctcgagaagcgcggccggggcaccggcgggacccgagcgaagcggacggcggcgacagtgtccggcgccatctgggccggatgcggcggatccggctccgccggaggtggatttggccttatcgcggccagatcgggaggggcgtgccgctcctgacaggaggcggcgaccgcgaccgttggtggggggggggggggacgacagatccggccactctggcggcggatccagtccccctggatgcctgcggccggcgggcggaggtggccgacgccgaggaggtttgcggcggaaggcagtggcgacggcgaccgacggagtcgagagggcggcgacagcagccgacggagacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcaatctcaccgaatttatttctgcgacgatgacgacgcgttgctgctgcggccgattctccgcgacgtgcgctgctgctccttccccggcggcgtcgacgacgaggccaatcagatcgatactccgatccgaaaaatcacaccggtggatgtgtgattagtagatcgatctccaatgctctgatagcacttgttatgaaaatagatgcacaatggagacacaaattttacgtggaaaacccttacgggaaaaaccacgggcgccgatcactataaaggaattggatacaaatgcaagggatacattgggctatcgcaccctctctgtgcggcttacaaaggatatatatataggagaaatctaggagtcctaatagaaaactaatcctataaagtagagtcctgttagataactaatccgaatatattgtgggcccaaaatttgaatcacatatttaacaattggtttgtgatataccccctccatctatttttgatagtcatatttccaaatctggaaaatttatttttgataggtatatttcaattcaacaacctataatcttaatgactttctcggatttaatacatgacccttcattcttccacacttgattggttatatggacattgagaaatgtaaatattaatgaatcacttgattacgagaaatgactagtaacatgtttaaatggatgataagtagaattacttatccttggtctatgtgccaagatgaaatatgactataaaaaaaatagatggaaggagtaattaatattggtttggcatttaacggtgatgtgctgcagatccaccaatggatccgagcgacgaggatcgttacttccctacacaccggcttcctgagtatctgaagaatcatccctgagagactacagggacgtgctgggagaaccgtcctccattaccagaagattgttgagtcgtcgtcaagctgcaagcattgctaactgctagagcagctacctactggctactgcgttacgtgtacgtgtaccgcaggatagatttgtaatgttgttttcagatactccggattatttgacaggaaggattaatagcttattactgcataataccgcaccgaagatgttataaaattaaagctgacaccgaaatcaagtaggtgtagtggctaatccacatattcacttataggtgaaaatttcaagacttattttgatctataaatgagtttcgtggatgagtcacttacacggttacatctatttgttgacaaattttcttaatttgataaatgtaattatggtacaatactacaatcacgataaatataattatagtataattgtattataacttacatgtaacttgtatgtaacttttgaaaactccttcgtagcatgctattttcatgaaatcgaagttgtgggactgaattctctcacatgtatgtacgctgcgtttcttttttccttctttgcctacctgaatattgaaagaaatctagttggttcaaaattttgtgaaatttacgtatgagtatgagttatattatagttacatgtaacttacactataattatatctatcaaattttttatagaaaatttatcgataaatatatagcaaaattttactatattgtagccgaaagcacaaaggttaggcacttccgaattgagaatttgagaccggcctacactgcgacacagcttacatgggcccagagaggtccacgagaggccggcccaagtccattttctcctgtggtaacaatagcccatgaaattcattcatagcccaataccgaggaagtcagccatctcaggccagcggcagccggcgacggcggcgcctcggcgagcacgtagcagccacacggcggcagcaggccatcccctcgccgcggctggcatcagcattcagcagtggcgcacggccgccgccggtgctgctctctgcggcgaccaatgcttggtctgctggcgcgagcggcggcgaggacatggcggctggtgtagtaggtcggtgtggggatgcgccggcgacggcgaggcccatgtggcggccgcgctcgagagggagcggcgcggcagctaggaggtgcgcccctatcctatcctatgtatgtatatctatctgcttgatctatcatctgattttgtatcggggtcatgtccaaactcgagattttgcaatctgacccaaatccagcttctgcaaatacctaattggccttgatcggagactagctgtgcaaaccgattgaggtcttaccatttgctaggccaactttttttttctttttcgaaaaacatggctagagcgctgcgtaaaatcttaatggatgtacaagaataaacttacaggatccaaatgaaatggaaaaaggtagctcggtacaaccagtatcatttaagtagaacactagctatatcgtcttgctgatgctttgtttcacgcaccatgtatgcttgacaattcatgcttgatcttaaggatttcggcagaaacttgtcccatttcccaccggtcattaggagatgccacggagcagcaaagacctatcctaaccaatggaatgatgcaattctgcatcactgttgttaccttgatttctccttgtagcatcgtgggatcaacaatctcactggtattcttggggaaagctcttgcaacatgttcatgaaggcttgtaccgttattgaatttttcatccgtaggactgctccctgttaccatttctaatagaagaacaccgaagctgtagacatcacccttggttgatatcacttcactcatgccatactctgcatttaatttatgaatgcaataaattagagaatatatatatgtccagtctcagaattatatgaagaacaaatgagttggccattatgaatatggttatctcacctggtgggatgtaccctatagatccttttaggcaagtcaaactttttgaacttccttcatattcatttgcagtaatgtttagacatcttgctaggccaaagtcgctcacatacgcaatcatgtcaaggtctaaaaggatattgcttggcttcaagtcacaatgtactatcggagatgcacattggttatgcagatagtccaaagcaaatgctacatccaatgctatattgattctttggctaaaagtcagagttttcctcttgctgtgttcatgggcccttggatgtagccatgtgtccaagttcccattggccttgtagtggaacacaagggctttaaagtcagccccactagaatccactgaacagcagagtgtgatgattttgacaagatttcgatggcgaatgtttcttagggcttcacactccacactaaagctcctttgtgccccacatgtaccaagattaaatactttgatggcaacttcatcttgctgaggttctagattacctttataaaccgtcccaaacgatcctgtgccaattaaattagtagaactgaacctatctgtagcctttacaatgtcttgatatgttatgttcttcatgtgctcactaattagttggcaatgtgggtttgcttgcatctccttccttcgataaattctcacaacataagatagaatgattatagcaacaacaatagctggtattagtatctctaggactagaaccaagatcttgagtttccttttccggtcagtcaaaacagaacaaaaaggaatacctccttttggaactcttgtacacaaatgatcatttccttcaagcgacactgcagcattaatgtcgaatacaccaccccttggaactactccatcaaaattattataagataaattgagggaatgtagggagctcaatgatgtaaggaactctggaatatttccagacaaattgttctgagatatgtccatcctttttatgcttactaagttcacgaaagattgtggtatacttcctacaaagaagttgttttgaatctcgagatactccagaaccacacactggccaagggaggatgggattttgccggacaacatgttgtttgagattacaagtctgttcaaatgaatgagatttccaacttcgtttggtatttctccagacaagtaattgtgtgataagtccatctcttcagaaagggaagaaatttcaaatattttacttggtatattcccatctaatgagttgtgagcaatattgagtatctggagttgagtacactggcttatacttgcaggtatttttccactgaagttattcccatccaatttcagatctgtcaactgacttaagttgccaaaaatatcagggatatgacctgagagcttattttgtgcaaatgatagaacgaccaaactgttcatgtttccaattgttggtggtatattaccggtgaaaacattgtaatccataaacaatctattgaggctcttcaaattacctatttctgatggtatgggcccaaagaatttgttattttttagccataacgcctcaagattgctagaaagattgccaattgaacttggcaaatttccttgtaagttgttcccatctaacatcagtttagtcaatctagagcaattcgaaagtgatgtcatgaagccccaatcacctggttctagcatgttgtatgacacatcaagttcgtttaaatttggcaatgatccgaagaacgggatgagcccagtgaaactgtttttaccaaggtaaagcatctctaggtggtaggcattgagaagagaagctggaattgggccaacaaacttgtttgttgagaggatcaagccctgaattttcggaagtgtgtagcctatatcggagggtaatcttcccgtaagtgagttgtttgccatggcaagaaatatcagggacgacatgttaaagatagatggtggaactaggccagacaagttgttcacattcaaggccaacatttctagtgtttgaatatgacctaagctctctgggatgttgccaactaaattgttctcattaaggcgaaggctaagtagggaagaaaggttagctagtgaggaaggtattgctcctgagatatagttgttccttaaattgagatatttaattggggaagacttggcagtaacagcgggtatagaaccaacaaagctattctgttggaggcaaatggcaataagcgatgaagtattcaatagagacttcgggagttgtccactaagactattgctcattagtctaagtacttggagagatgaactgtttgccaaggattctggtatgcttcctgtgagagcattattgccaagatcaacatatctgagagaaacgctactgcctagaaatggtggtatgtcaccggtgagcctgtttctagcgaggaccagtgttttcagcttaggaagattcccaaaagtagagggaatgctaccctgcaacttgtttctgctgagattaatctcctgaagatgtatgcatttacttaggctagctgggatctcaccttggattgaattgttccacaaacctaggatttctagttgggaacatgaagaaagttcagatgggatgttaccttctaaagagttcatgctgaggttgaggttgttgagttcactcagtaggccaagcctggatggtatgcttccatggaagctgttgtttgacagttgtagcgttgtaagggaggtaaggttggcgatgcaacgtgatatggtacctgtgatgccttcagatgcgaggtctattgcaatgacacggtgaggacgtcgcacactgcaggtgactccatcccagctgcagaaattcaaggatgtgttgctccatgaggataaagctctagatggaccagatagctgagacttgaagcaaaggagggcctgtctatcatattcagtttcattgcagatggctaacaatatggaacaaaagaaggtacagagataaagaacccatgcaacattttgagataaggcactaaaagaggccattgctgtcgattacaaccgtctgagaagagatcttctgtgcgaatggttgttcaaaaatggtactgttaattgttagtccaatatatggtggcaaggaactaggaagataaacagatgtactacctagtgtttgttcaaagttgaaaaccttttgtgaacgcttattacaacatggatggacatcttcttgtcaggaaagcaccttgcaattgagttggtcacttggttggatggaagggcatggaccaaactgaaagcgaggtgcgagaagtgagatgcactggaactagactggtcgctttttatatttggaaagttgcagttgctgaaccttttttttttttatccaaagttgctgaaccttttagcagagcactcgcagaacatatgcattcattcaggcttcccaattttttttcccaaaaacgtcacatcaaatctttggacacatgtatagagcattaaatatagataaaaacaaaaactaattgtacagtttacatgaaaatcgcgagacgaatgacgaatcttttgagtataattagtctatgattagccataagtactacagtaaccgacatgtgctaatgatggcttaattaggctcaaaagattagtctcgcggtttccaggcgagttatgaaattagttttttcattcatgtccgaaaatcccttccgacatcatgtccgaaaatcccttccgacatctggtcaaacatccgatgtgacatctaaaaattttcttttcgcgaactaaccacacccttagtttagagtttctgaagctacatctttcacacaatggttttttttgactcttcaggttcgccacaaccatcttgccaagaaaattcaaccacgactattattccgtgtacaggtgtaaacgcacaccttatttcctgaagaaaaatatcagcgcacgtgattcttcgacatccattggacgggtgcttgaaggcttgaagcataaatagatactcccttctacatcccatcatagtatgtgtcacatctaaccaaaacttcttatatttttattatttatctatttgtcttattaaaagaactaatacaagtatcgtttatttttgttataacttgttttaatcaaacatcgtgctgaaagtcaacggtaccatctatttaaaaaaaaaatgagggagtatcctctctatatcgaaccatgcaaagacacactcacgcacccttgggctatatattctggatgcactcatcgctgaacagcgtatgctctccagtttccaccggcctacctagatcgggagaatggctgacagctccgccgcctcccccattccggtggcctattcatccggtgatcctccgtctgcgacgccggtgcccgttccaggcagtgatcttccagctgctccggccgccaagtctcaagaagcctctccagctggtatctaacaacaccccatacaaaactgtttctacattttctgcaaatatatggagtacatgtgtattgctgctcttggtctatttttgttattgatttctgctagtcagtagttcaccactacatgcttatgtgatgcagttccggtgatcgatcctagcaaagaggagcgtatgggttctgggcatccacttcccgggggtaaagattaaatacactgggcacagggacgtgttaaaaccgttctcctacatcgaatgtccggaactgccttacgtgtactgtgcaccgtgagattgtgatgttgtttcagataatttcagacactatgatcagggaataaatccccactggcgttaggctagttactgctagggataatgcagatcaggctgtgcaattgtagacaattgtcttgtatcaataaagtgcagccagttggtgccaaagtatacctctctacatgcctcagattgttcagcacttcttctgtattgatttttatgtgatatcttcagctagcgctgatgtagcgagtcggcgaccagcgaccactactttcgtaccgcatcagcagcaaagtacgacctccgccggttacaaatatatggcatttgatttttctttttacgatctttgagttgtaactttatccataatgattttttacaataacttcatatacatatagtaataagattgtgacattataaaagttactatcgagggagttgataaatatcgattttagaggtcgatattgtagctgaggagcacaaataaaactcagcccatagcaactgagtagcacaaatactagtagtacagcttaacccgtactacttgattccattccaacatgttacaacttttttcgccgggaaggctgaaggaggccatccaagtatattaagaaggaataaagttacaaaaaaattctggacagagactgtcgaggtcggaggtgcattgaaatgcataaccaaagccacatgctaatcacacaagcacagcccactgagagaaaaacctagcaccgagatgacccccgctatttgtggccgaatcgccgcgggccaacgacaacaccacaaagacgagactctaaaagcgatgcctccaaggaggtcacgacatcaaggatgccgccatcgcccatctaaggagatgtggttttcacctagagaaaactagccaagggagaaaggtatccttgccagcgccctcaagggggttacgacgcccaaaagcgtagacgctgccagcccgatgaatcatcaggcgaggctttcacccggaaacccttcaaccttgcttgagatccatcgcccatcaactcagaaaccatctgacaagcagatcagcacgaggcctccaccacaccgcgccggcgcccctccaccggccgaccaccacaacatgttacaactacaacgagatttaatccatcctaagataaacagatctggatagaacctcatcctagttatacattttgggaactgaggaagcagtcgagaaggtggacttctttccattatttgactggatgatagcccctgatttaatcaagcccagatagagccaagccgagagacagagacgaccccacgccggcggaccgggctccctccgcaggaacgccggcgctcggtggcagctcgaactccgagagtagcaggtacgcgcaaccccacgtatgcctgtcaatccatccggacgtgtggcgagatcgatccatgtagggttccgctgtcgcagcctcttccgattaagcgaatttcatgtctggattcgaggtttagtccccaaatccagattctgtagacatctgattaattagctttgtctggataccaattgcatagatggattgcgctctaaccgcttggaattgttcttttaggaatatcccactcacgataattaaagaaaaatgagacattgctaatctttaagataatagattaaataacccggcctctacatccacttggatgtacacagcacatgagacatgctaatgcccaaatgaatgcttccttctgcaaatgtcacaaacggaaatggactgaaaaaagggggaaaacataagatggtacattggtattcttctttacatccatctctgttgctagctacaatcctggcaaatctcttccttcttctagtatagccgtcatcctaggctgtgctcgctcctgagtcacctttccccttgcgctcacagctgttgtagcagggactggtgctcgcgccaacaatgcaaatgtttctcttctcttcattcaccatctatctttgataacgcatgcttgattccaaggatctcagtacaaacttgtcccatttcgcatcggtgtttgggtgaagtcatggagcaagagagtcctattctgaccaacagaataacgcaactctgcagcacctcagttgcatcgatctcatcttgtagcatggtgggatcaacaaccttgaatgtatctttgggaaagttactagcgacaagatcacgcaggcttgtaccgtcattaaatatttcttctgtcggactaatatttgtgaccatttccagaagaagcactccaaaactatagacgtcaccctttgttgatctctcttcgctcatgccatactctgcagttaaattaaaaataagtataaaattagataataggcacagcaaattgttttgcatgggtctaagaaaaacaaaaaaagaacaactttattttaaaaaagctatctcacctggtgggatgtatccgattgatccttttaggcaatacaaacttgttaaactatcttgatctgaatttgatcttgtgcatatgaatcttgctagaccgaaatcactgacatatgcaaccatgtcagggcctaaaagaatgttgcttggcttcaagtcgcaatgtacgagtggagttgcacaacggttgtgaagataatccagagcaaatgctatgtctaaagctatattgatcctctggcataatgtcagaaaatttctttgactatgctcatgttcctttggatgtaaccacatttgaaggttcccgttttggatgtattcaaataccaaggccctaaattctgcccctgtagaatccactgaagagcacacagtgatgactttgacaagatttctatggcggacattttttagggcttcacactctgcagcaaagctcctatgtgctccgtatgtgctaaggttaaaaatcttgatggctacttgatcttgtcggaattccagattgcccttgtaaaccgttccaaatgatcctgatccaatcaaattagcggaggaaaacccatttgtggccttcacaatgtcttgatatgtaatcttctccatgtccccattgaatagtcgcaagtgcggctcttgttgcattgacttcctcgaattttgaggcactctcttccttgaacgaatcattagaaaacacaaaatggtgataacaacaacaacaactggtgtaactattttgaaagctagaaccaataacctgtgcacccttcccctgtccaccaatgcagaacaaaaaggtatacctttcaatggtgcccttgcacataaacgatcatttccttcaattgagatcacactagtgtccagaaaaacaccaaaacttggaagtggtccataaaaattgttgaaggataaattaagattaattagagacttgaaggacgcaaggaactctgggatttttccagacaacttgttatgagaaatatctaatttattgatgctttgcaattttgcaaaagattctggaattatcccttcaaggaaattactttgcagctcaagagattcaagaatcacacactgaccaagagcggatgggatgttaccagacaacctattgtttgagatgctaagtttgttaagattaataagattgccaacttcttgtggtattcctccagacaagtaattgtgtgacaaatccaaatgttcagaaagagaaaagattttgaagatatgaactggtatagtcccatgaagtgaattgtgagcaaggttgagtgttttgagttgagcgcagtgatgtatactctcaggtatacttccactcaagttatttccatcaagattcagttcattcagctgaacaaggttacctatagtaccagggatttgcccagacagtctgttttgtgcaaaggacaggaatacgaggttgtgtaaatatccaattgttggtggtatattaccagttaaataattgtaatccatgtacaacatattcaaactcttaaggttgccgatccctggtggtataagccaggaaatttggttatttcttagccacaagtactcaagactactcgaaaggttaccaatcgaacttggtaggttcccttgaagattattcccatccagcatcagttcagtcaatctggagcaatttgagagtgatgagacaaagctccagtcatttgcttctagcatgttgtatgccatgtcaagtttggtcagattctgcaatgatccaaataatggaatgggcccacataagctattatttgcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30459 - DNA, 9215 bp, Oryza sativa
  unsure (1)..(9215): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttatctcttactccttcgaggagcttcactgacatcctcctcagagacaagttcatgtgtatgttcagtttgttctggtggtgtgattgaactgggaattatttcagagggttggttcgaaccactatgtatatccttcattgggaaaaagctctcaaagaaggtagcatcatgacactccataattgtaccaacatgcatgtccggtacctcggatttaactattaaaaatctataggcaatgctatgatgagcatatcccagaaaaacacagtccacagtcttaggttcaagtttgcgctttttcgttattggtacattggacttcgccaagcacccccatgtgcgcaaataagaaagtgatggttttctaccaatccatatctcatatggtgttttgtccttatttctgttaggaattctgtttaacacatgatttgaggtcaacaatgcctccccccaccatgccttagcagtcccgcggtgtccaacatggcattcaccaagtcagtcagtgtgcggttcttcctttcagcaatcccattagactcgggagaatagggaggcgtcctctcatgtatgatgccatgtttctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccctgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacagtgccataaatatggttcacagacttattgcagaaatcagaaagggaaaagcggaacaggcctccgcactcataacctttaccaataaaatatccatgtttagacacgactattttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacactttctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagttttctcctcaacatcaagagacgcaatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttctatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggtctcagtgcatcggcaaaaccagccatagtaaaatcacagtgcctataataaggtttttggattgttgagattatagacatataatgatttaatctattccataaataaatcatgatattacagatgaaaactagaatgaacgcatcattagatctatacatgtaaactacacagtataacatgaacagatcaaatatgcgcaacatattgaacacataccgaggtgacggaaagaccggttgcttggtcgaaacttttcgcaggtgtctacgaagacatgaaacacgcgagcgaagaggaaggcgagccgtcgcgaacaaacagggagcagtcgcgcgaagcgcttcctaaaaaaccttattgccgccttctcccggtgcaggacgtcaaaggcagaggttccggagacctgctctcccgatcgccggtgcacgccggcgagcgggatggagtagtctacgagcgacggcgcagtacagagtaggaggcaaaccctagattgatttcgcaatcgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacaaatccgaatttgcagcaaaacaaaactgcaaaaggaggctgcatctgcgcaagggtgaggagtcaatttttcggaccattcgacgcgtacgtcgtgcacgcgcgccgcctgccctacccgggcgaggcgagcgagcgcgcgcgtgtgtttcccctcttctctccaccacacatgcttcaagtggttaggaggacatcctcccttttaaggaggtccccctctcctagaataagtaaggtggtactaaactccacatgcatgccatcccatgaggtgggcttttgtgattttccaaagaattaatcttcgagtgggctaaggcccattcattaattccaacaccaaattgttactgatgtccatatgttactacggtgcataatggcataggctttcatatcctttagcttcacaggaatttgttttccttcgagaactatttgcatgtagtgaaatctgtttagctatcaatttgggtttatcgtgtaatagaagtggtaagcaattaagcatatcctggaataaaaatcaccattagaaattctctatccggctaagcttagttgtctatatgttctaattgatgcgtgtttgatacagatttttttgtctctttttcacatggcttcaaacacaagatgccagttttattttgtttgctggttagagaaaatcccaaatagcaagctgtaatcgaactgagccaaaatctagagcaaacttaacatgtgtagaaacagggcaggggaaaaattgcaacatgagagatgattcactgaccatatatatcatcgagggatgccctaaatccccatttgaagccagtaccgcgccgcccgcaacgccctcgctggattcctctggccgatggaggaagggagaggcaggaggaggttgggagcagccaatggtgaggcgtacggatgaaccaaaaatcataaacaagccgccggccattgcccagtctgtctgcgagagcatttgaaaaaaataaaaaggattatcgctttgtgtgtttctgagatgggcctgacgtcaatagcaaccccgatctggctcgtaaaaaaccagcccaacactggtggagaaaccctttttactcccggtcggtaaccctctatagtcctggttttccaaccggcagtaagaatccgagactaaagatcactatctttagtcccggttcaaatacccgggattaaagattgatctttagtttagtcctgactggaggttttttttttcttttctctctttctttttcactgttctttgtccaaatatatcagatcaaacattcacaacaaatcatttacatcattcaccgcaatagtttatcccaaatcattcgcataatagttcatccccaaatcattcacaacaacaacacagatcgaatcacacattcaacacagaacgaatcatacattaaggaaaaaagaaaaaaaatccacgcagcagtgccggcctccatcgcgtgccgccgcaccggcctccgcgccggcccttcacgcgaggccgccgcccggccgcctcccccttcggatccggcggtggccggtcgcctccccttccggatccaccgccacccagccgccgccgcaatggggaggagaggagatgaagagaatgaggagaggaggaagaggaagagatggggtgaagaggaggaagagataaggtgagagaggaggagatagaacttattaattgatgtcgcctccacctcctcgatctctcgcacgcctcattctctccgccgcgcatgctgatctttttgccggttggtattaccaaccgggactaaaaatagatctttagtctcggttggtaacaccaaccgggactaaagataatagaggggtctaacatctcctgttgttctttgaaccgggactaaagataaaaaagtagctctaaccttttgaactgggactaaaaataatttttagtccggtttttattacaaccgggactattgtgaaatttggtcaaccgaccaaagatggtttctccaccagtgcaacaaaataaaatttgatgtttcgacgctctatacgtgttggaggtacaccacgaagggccttcggccggacctaccgaaaccaaaaagcttaggcaacaagctcagaccggaggcaagcggcgaaggtcgaagagagaaccgtatgggctggaagagacctcgtcggatgggcacccgggcgaaagcggtacgtgcgaaggctttggggcgaagacataggcttcgccaagcatcaaaccacacatgagaaggcccagcgggccatcgcactctcggagggcttcaccaagatgaatgggccaagctacctaggccaataggggcccaaacatgtaaaggacactgtgtacccctaataatgtccctatcataagggtaaccatgtaaattcccctgtaaaacctaaaccctaagagggagaacctgtaatggggctataaatagccccctagggtcatgtaatagggggatccaaaaaattttcactaagtaatacaatcgtttccctttccaaccacagttgagataaccacgtctttcgacgtgacgtagttgtccattcaataacaatacgttactaattgttacttccattaaaattaacacttgtgacgatgacaagtagggccatctcagtctatgactgggccattgtataaaattatcaaaactcattttctagagtgtcaaaatataaaatatctcgctcaacaaatctggaccacacccacgctacaatgctgagaagcttaagatagggcctgtttggggggagcttaagattttgagaagcagctgctgagaagctagctggtgagaatctggagaagctggaaaacccagcttctggcttctagttcatttttcagattctacaactacagattctcagaatctgggtaaaaagctggactgtttgggggagcttctgacaactggagattctagtagaagctgcagctgctagaagctcccccaaacaggcccatatgacaacctactctcctctttgggctgcagttaaatattgtttaatctgcaacccaaaatcaaccatagcaccaaggtttttggtacagaacacctaaaatttatgtaatttgttggtagatatcaaaaaacgggtaatgattaaaagacactttaaaaaaagtaaattggtgccgactggtaaaccgccatgtataggtgttggatttcctagccgatacctagtaggatgcactgatgaggagaaacaaaggtgccagttttagaactggcacctttgaggttccatggataaaaaaaaaaggctagctcgattcaagtcgatgcttcgagcagctcccgatcaccactgagatcaccatcatcccatcaccccggtaacacaatcacaaaatcaacattgaaaaacaaaatcaacattcaatgctatcctagagtctacagaaagagagaagatcaaaatcacacatagaagaacaccaccgtcgccgttgctgccgtcgttgagcgggtcgcctgtggtcgcagcgatgaatcctccagccaccgtgctcatgatggatctgaccagccccaagagaggaggaggagatgcgggttgtcagtggctgcagtggtgaagaggaggagacgccatggatgaacaggaccatcgacggctacagctgcatcggcggagaggagcgccgtgggtgaagaggaccggtgcgcggctacaacaaagaagaggaggcgtgttggtcgaggcgagcaaggatgagggttgaagaagaggcagacgccgcctgcgctggagagatcgttggcgggcccctcctccccctctcccaacccacgccgtagaggtcttcgagacggagaggtgatgagacttggagtggataatgatggggagaggagggtactcagtggaaacggcgacttaaacaaaaaaagatgatctctcctctcatggtcgcactcacacccacgccattcaaaaacaccaatactaataattattgatgccggttttctattaatcgacaattatagcagagttataggtgttgatttttattagtgctggttttttaatgaaccggcacttatgagggatcaaagatgttggcttttaattgtagacacgttcgaggggtgggaagggatcataagtgtcggttttagataaaccagtaccattaagttgtcccgtatgagggtttaggtagtagtggcatcctaggaaattagtaatttgctagaggatactttcatctcaattgtagagagaaattattcaaatagatgagaatgcccccgggccatatgctttaaacatagcgttggagtaaaaaaaaatttgaaaattgtgcaactcgaaatctgccatcataccaagtaaatcgctagcttatattaaattgcatcttctctccagcctcaagcttttgtccctaggggcattctcatcttgaagagtttctctctgattgattcgagagtgttctctagcaaattactaggttttaagggtgttctagccatgacacatttttacggtttctaccagtaaaatgcacaaatttgaaatatcctgtagcaaaatttaccttagtggtatgcttgattcgggtcacaaaataaacaatatttattaccttggtttgggtcgcaaaccaagataaattagaagacgggtattaacaacaaataatcttacagggaggatctcaagtttggggtgacatttagaattttgcgatttttctttggatcaaagaataagaacacgtcaaggtagtagatataaacttgttatttctctttattcgtataaaatggtggagtatgaaggatccccgtatttaaagataccttgaaaaactaggagatatctatctattatctatctatcttctatttctattattatatactaaaagtccattaaacttcctacaaaccctcctaagccgctacataggacccctaaaaacgctcctagaccgccatgtggcgttctaataattatagaatgtctaaaaaaacatctagccatcgattttcatttaatatggtggaccgattaaatttatctccaattaaattgccgtacgtgcacataagtacgttagtaggtatttaaaaaaacgtacgtacgtacgtatgcacaccgggcgaattactgacattatttttcttttctttttttttcttttctttctcacttggaactggaaactgcccatattaactatgcctttattacgtgtacaaatatacgtaattttgagtttctaattaggcgcatgtcgtcgaaacaccaatgaaaaacaaaaataaattaactatatatattatataatagttaaattatacttgcatttttaaaaataaaaacaactctaattgtgatactagcaattctcaaaagttatccactccctacgtaaaaagtaatgatatgtcaaaatgatatcattaaatttatcatgaatctattttcatgtattatgtgttttctctattagtataatttttaaaaattaaggatcgtatatattcttttcacaccataccgatgtcatatatcttctacttaggctttgtttgatctagttctatgactgagcttatccaggacacatgaaatgacgcaagtcattagtgcaagattaattaaatataaaatattataaagctgaaaatatatttaattgatttgttttaaacttttatataaaatatattttagtaatacgcacgttgcatttaaatatatacgatgtaggttatgattgttaatttaattatagtgaatagaatgactcagatcctactggagaaatgatctttgctcggtcggctgatttctacaatagtcccagatctagtaaaaaccgggactaaaaattgtttttagtctcggttataaaaattt

SEQ ID NO: 30460 - DNA, 3687 bp, Oryza sativa
gacaggtggggtccacgggtcccacctgtcggagagagagggagggagaggccggctggggaggcaaaacagacttgagggagagagagagccgagcgggccgagggagggggccggcccgagagggagagaaagggggcgcgcgggccgcgggagagaaaggaggggttgggccgaaaggggcccaaagagaggaaggaggattttaattgttttctttttattttaattgatacaatgatctttgtgctattaaaactatttctcgagctccgaaaatttgcggaaaaatccggagagtattttagggcacaaagaatattacaaaatattcttggccaatgatttttaattccctcaataattcacttgattaagttgatttaacttttatttaatttctagaaaatgcattattaattgatttttaaacccgaacgaaaatcggggcgttacataggtgttcctaaaaatattataacttcatagcatattagaataaacaaaaatttcggttcaaatcagaactttcggtatgggatcagaagttctggtctcaaccaaaatgttcgatggataaaacataatctatgaaattgtagctcaaatagacaatatgtatatgaaacaaaaggtgacaaacaagatatctaaataagatatatggctaccaactagatcaaataagaatacaaatagaccgtgcaaaaataagcttaagcataatattagtaaaggcaagaaagggcaaaccaaaagagaagacatgtgatttatttcctgatgttcggatctactgttcctacgtttttgttgagggccataaaggctaggtctctttcaaattttacactcctagacttcacttttgatttcttccattgcaaaggtggaatcgaaaccttcacaatctttttgtggtacaccacaaccttgggtgctcaccggtgacacctagccatctaggaggccttagtctccaaaagtaatgaattcaacaattattttttggggacgaatctagagttatttagatttatcgaatattttactaggggtcatgcatggtgatgtaaattttatatatgcatacatgactatctgagaagttcaaacagaggcaatcaagtaaacacgttaggtgaagaaagtaaagctaacaacatggtcacaactcaacctcgccaggaaacgagctcaatcggccggcaacaaatacaaacctatgaaaacagaactacaacgataataatgtttgattttaaaaattctaatgataataaagagtaggggtgacaggtgggctgtaaaggaatagtgtggcataagttgaggtgacttctaaaaactttaaaaacgaactccaatgatgattaggttcgattttttaaattccaatgaaaatgaagatatggaccatgggcggcggtggttgacgcaacttataaaaactataaaaacgtaaaccctaacgagaatcaggttcaatttattctaatgataataaagaggagagacgacaagctgattgtaaagtagtagggcagtgtcgattgacggaatctccagaaactataagacgaaacaagagagaggaaatgtttgatttttaaggtcacaagaacaataaatagaaatggtggcgagccagacaagcagtggagtagcaatggttggtgtgacttcttaaaaactacaaaattataaacataattatgataaggtccaattttttgaatgatgtgacaacgagttgactatttaatacattttaaagaaaatgatgtctaaatagatagataattttgtatcaggtgatataattacgcgggccaccatacttttttccagggcctgcaaggtttacagtgtaaatggcataaatcacgggagctccttcttggatgaagcagatagaccacgaccggagcttccatcctcttctaccggacgagtatgagaaggatcgtccttagagctggtgactttgtcatgtacgtcgccggcgatgccttcattctctgtcacagcggcgtggagattgtgcgagggcgggcctgggggctcaatgggtttctcaggaccttcgtgaatgggctctccaaaaggggaacccccgtgttgaccattcgatgcagctgcaacaccaaagattcactggttaaacatgaaaatcaccaaaagaagtaaaaatatatatatatacggacgctcatgtgggatatcatattagagctccaaaggggacatataagtatttgtcgctttttaagatgcgataattaaggatttgtcactcactgtccatagcatgtgggtccagtggtaaatcctttttcaccacttgtaagggttgtcagtatcccgattcgtatcgtagtatcttacgatacaacgattctaccaagccgaaacgataccgattccacctagtatcctaatttttatagtatcgcgatcctactattcattactacacgatcctaagaaatcttagatggtatcctaattctacgatccctacgatactacaaaatattatttaaaataacatggtttgaaaataatgtaaataaatatactcaaatttgtataaaaatcagttaaatatatcaaaaccaacgtggtttctcttgataaatatctctatttgcatgacatatatcattacgacattttttatatagattggctatatataactaatataaatattaattaaacttaaaaaaaatctcataatatcccgatactacgatacgatactactttgagtaaaacgatactacctggtatcccgatcctaacaaccttgcttgtaaaaagagtggcaaatagttaattatttcctccaaaggtgaagagaaaaaaaatccagttacagtactgaacatccagaaggagtacctacataatctctccattccaaaatataaagtaactttaaaatgatgttaagtcaaatatttttgactttaactattaataacaaaaatataaaaaagatcaatcatgtgagaatgatgttactagaattatcactaaacaaacaacataaatatgttactctatttatttaaaataatatatttttataaatattatcggtcaaagtagtatatcggagacagtgataagtccaaaaatatttgtactctaggacgaaggcactaactatataaatttactagaccgcaccatgatgccacgggaaggtggcatgcaaaattgtattatatgacttctcgtgatgacttcttcttatagttatatagacactaagagtgacatcgatcatatatttataaatatatataccccatccatctcaaaatatatattagcattgattttttataacgttgaaccattcaccctattaaaaaaatataagtataatttattttgttataacttatattttcaaaaagtttggtgtgatggcatgaaatgaggctacagcggcgtgactttttcgaaaacatcacagagtttcactacatatatgcatagatgcatagtttgaggaaaacttcagtgctacaaagaaataaacataaaactattatacagagaaaattatatatgcactcttccttttttttaaacatctcttgtgtacgtaagtacatacgtacatagagaggtattatagttcgtttttagatagtatatatctaatctaat

SEQ ID NO: 30461 - DNA, 860 bp, Oryza sativa
accatccttttatttctgaattgactatgcattatatatgttatttgcatagatggaagaaatgcaacgcattcggcggtccctgattgctaaagcagctggattagttgctgtaatgaatgcttacattctgtttattacaagaagagccatgcgacgtacccctaggatctcctatggcccattgtccgaaagggacatagctagacaatccaatcttagtttcatctatcatacagatgatacaaattacttaaatcagctcagaatgaagagagccccattttttcagttgtgtaacttgttacgagaaagagcgttgttgcgggacagtatacatagctcagtggaagaacaagttgccatgtttcttcttgttgtaggccacaaccacagatttagagctttgcaacccacttttaggaggtcaattgaaactatcagtagatacttcgctgaggtattattctctattggtgagctgcgaaatgagatgataaaaccaccctcatctgagcctcattcaaaaattacatccaatcgaagattcaacccttattttaaggtaaaaatttgttgcagcgttttgactacaaaatatgttctttcaacaatcatgtcctaatatttctcactggtcattaggattgcattggtgcaatagatggaactcatgtgcttgctcgagttccatcaacaatatctgctgcctttaggggtaggaagaaagagaccacccagaatgtaatggctgcagtggactttgatcttagatttacatacgtacttgttgggtgggaaggatctgcacatgatgccctcatacttgcagatgccttggagagggatgatggtcttag

SEQ ID NO: 30462 - DNA, 17520 bp, Oryza sativa
taggggaatggcgcaaattagggatgatttggctggtgctatgtggaacaatagagggtcgtctagggtctgacctgcttagggattaatttgtaactctctatctgtgaacttaggatggggtgcactgttatctattcatgcatgatgattgttgtaccctgttgcactgttatctattaatttgagacctcgagatatttgcaatgatgctgtttattacatctatcgatttatgttaaatttatttgttcatttgcatgtggtaaatataggatggctgaggctggtggcgggaatggtggccatggtggccatggtggacaccatggagccttgcattggacaaccaacatgtctagcttaatgctaaggcgcatggttgagcttatagcaacaggtgttaggactgacaagggtttcaaggaagttcaccttaaccaagttgctagatctttgtctgatcactatggaattgaaattagtagaacccaagtgtataaccatcttcgcaaatggcgtcaaaggtgggtgcgtatcactaggctcaaagaccttagtggggctctttgggatgatcagacctcaacgattatcctagaagaggagcactacatgggacatgtcaaggtttgtgtctaactatcacatacaaaacacactgcattagtacacatcatatctcactttaaatctaatgttctcatataggaacaccctaaggatgctgagtttctcaatgtgcctttagagaactatacacaaatggcaataattttttcaaataggcaagccactgggagatttgctatggggttaaatgaagcacttggaaaccctgctggtgaggctgacagtggtctgggacctcttgatggcactattggggatggtattgctgctggaccaagtggtgtgggtgctgaaggtcctggaattgctgctcgagcaagtggtgttgggcctactggtgaggattctacctcatataagaagaggaagagagcatctgctttgaatgaaggtgaagttgctttcatcagcaacatgacagattcagtgaacaacatggcttcagcaataggcgctactgcacatacttgaggttcaccctgatttgtgcaacacagtgatggattttcaggtttcagtgaggatcagttggaccttgttctagcttatctaactaaggagaagcctgaaagccttgtatacattcagaagaatgaggctcgtcgtgctcgttgggttagaaagttcctgaatgagcatcaccctgagagcatctaattatttaactaactaatatggagaggtggtactggaacaccatattatgtaatattgcttaattcagattaaggtggtagtggacaccacatatatgtcttttgtagaatgttggctacctgttgattaaggtggtagtgaacaccagtagctgaatggcttttgtagtgtaaactgcagggtattgcatgacccatgttgaatctctgccttgcttcttcaatgatgattattgccactgatgaatgcttcacgccactgtttgtgctgcatatgaaaggatgcttctgcacttgctttttttatgttgttatggttccaagatgcttctgatgcatatgaagagatgcaattgtgagagatttccaagatgattaagattaatagtgttgatttgtaatgcataataacatatttcctgcacttagttcttttttgttagggtcaagctggaaaatactgcaattgatgattaatagtactaatctgtgatgcataagaacatactatatgcacttgtcattttaccagattgcatatgtataacaatttattactaatataccaattggtttagttttgtataacatcaatgtaattgtatatactcaaagaccaaaatatttgatctgttccttgtatatactcaaagaccaaccaaataaaatagacgtgcatagcaatattttaagcaatttagctcacaaataatagtaagccaaagagcaaataaaattttaacacgacctcatggagtaacctcaccgcacagaagtagacacttgagaaaattttcacaccacaaacttattagggtaacctcaccactcataggagagggtgtttacacccaagatgcatccatccaaccaaacaacatctcctgcatgcaaccattccaccaatcctttgctgcaaccaaccaaacatcatctcaacagatccaggttcatcagatgcgggcaaccaaacagctgcatgtgtatcctctcaaccaggccagactcagcctggatggaagagatgagccaggctaagggaatacgagcaaccaaacgcaccctaaagggatacaacatatcctaatattgtgaatctggatagactctttattcataattgtggtattaggatgtaaattcgtaggaccagaatgtgtcacatctctctaaaatctcttatattatgagacggatgaaatagatagtgcgtacaggcaagcgtttgttacctcctcgagggtcgtttttaggatcttgaaatgtgtcatgaggatcagactcaggttcgagcggaccaactggcagccaaggaagaaccgatcgatcccatatacatgagagagaatagataattggaaacacacatattagagtactcattcgttacggcgttacctggagaagaatggggttccgttttaggatctttacctgggtcctgcaggctatgcattggaccaatcgacgtcttagtaactggaccatgaggaaggagaatgaaagggtgagagctgggtcattaattagctagggaagggatcctctgacatgatgattttctcttgatttcacgtcggaggatccctttccggtcaccagggccacgtcgtggcttggatcatcaaactcatcgagccaaggcgaaagtgctatagctaagagcgtgttaattaattacctggaggaggcttggactcgcagttgggtgatatgggacggaccacggcgcggatcgtcagctctatgcttaacccgggatgttctactagaacgggtgttagtttcagttgacaagctgcaattaatatgccaaacaacagtgttaacagaaaactagcaatacatcatcattcagaacatacaaattaacacagtgcaacaccagccggtaattaatacatacctggagcggccggaggctcgacggccggcggagcagaagcagcagcagcgtcgccgcctgcagaaacgggagtggctgccacgacgctgctgataacgggcgccatcttcctgctactccttttggctgcctagctagctagatgtacgtagtattgtgtactagtgtgtatactagagatgttcgcttctacagttctactatatatggctatttatatatgcgtttcatatatcgatcagattcccatgacagacctcagtcacacctcttatggttattttttttatatgtggttcataaatagatcagattcccgtgacacaccaaacaccgttgaaccgtgaagaagctagaggcgtgcgtctacaccataaattaaaatagagtgaattagatattaggccacatcttattactagacttgcaagttagactaggggtaaaccaatattgtcactttgcgataaaaaaaaattgtcactttgaaataggtagttttgcacaagtttcatattggactggtgtttcctaattctcctctttctttgcttcattaagttgaggccgatgtctattagctcgagcatggtacaccaatgccactaatattgtcccatgctcgagagtgatcagatggcatcagtagtgggctctttgatttagaggaagaggagagggtggtgttaggtgaaacaaatggcaatattatgtggtctaaagtgaaaatcttggctaagacctcgtccaacccgcaacaagggtcaaaatatatggcctaaactgtaatttactcaataaaatatggcatacaccctctgttataaaatatacaaatttagtatgggatatgaatactacgaatttagacgacatcgaaattgagagttagaaaattactggagaaagaaatgtggcataaggttcagaccaaaactcggtggagaaatgaaatggttcgtctgtcaactatcaagtgctttgctcgtaccgccggctagaactctacatttttagataaatgatcacctactgatatatcaactctcacgaacaatgctatagacccccctcatcactaaaggcaaccgcaatgtataagttgaaagttggtattaacgtgaggcctcaagtagaaataactttgtgagacttaacaatatatattgtttggctaagaaaaataaggtggggtcaacccataaaaaatcatcctctaccttctttgaggtattccacgagtgatatgcttcccatgtgcaatcttttttttttcttttttttttctttgttgcttgcttgttgtaggtagtagtgtaaagacctgtaactattactacctcctcgcacaatgtgtactactagataacaaaggtatattaattgtttactacctggtttctaccacgttgtggttgctccaagggctcaaaatctttatctgtaatgggcaagccagtcaattaaaatttttgccggtgatgtggaggcttatctatagtggctcaaaatgatgagctgttagtgatatgaaaaatccaggcaacaaaatggaaaaaaaaaagaatctgctcttcctacccaagattgtcagtatcccgatttgtatcctagtatcttacgatactacgatcctaccaaaccaaaacgatatcgatcccacctagtatcctaattttcataatatctcgatcctactattcattactacacgatcatatgaaatcttaggtgatatcccgattctacgatccctacgatactacaaaatattatttaaaataacatggtttgaaaataattaaataaatatgcttaaatttatataaaactcagttaaatatatcaaaaccaacatgatttctctcgataaatgtctctatttgcataacatatatcattattaatttttttatatagaatggctatatataactaatataaatattaattaaacttaaaaaaaggaaaatcgcatagtatcccgatactacaatacgatattactttgagcaaaacgatattatctagtatcccgatcctgacaaccttgctcccaccgctatcaaagcactcgctcaaagccgctcttgccagctcaagctcggagtggctgtcatcgctatgcccactcgatgtagtcatcgtcgccgcttttccaccgcaccacccctcttcatgccggcttgagctcagagtggtcggatctagggagaaacggtagtaaggcaagacagggtggcagaagagggttggggcctgggggacaccatgtggttgccgagcatgctcaaggagttcaccatggctgcatcagtcaaaggtcaacatcatctctgtggctgtcgccgtttatcatcgagtagctgacgacgatgacgatagcggcaacagaggtgcggtacatgagtgggaggctggcaatggtgtggcttagggggaggatggacaacaccgccaacatgtgagaagtggatccgatgtagcactaccatgtcactgaatgtggagatggggcaggcagaggtggaaaggcggtgaactagtggagcgagcgatagagagggtggtggactaggaggaatgcggcataaaatcactattaagagcatgcctagctatcacattttgtaacagaatgaatgaagttaagttggacaattgatgtgtaattttgttgaatgaatgaagacattgtttaatcaatcaatgagtgaaatatagttttgtttaatgaatgaacggtcactgtatgtggtttgaataatcttagactgaatgtgggtcagcaatgctaatgcttgcgtcatattgttggtctggaattgttatcgtcggcaaaaatatgttggtcggtaaaaataatgtcggccggcaaatctaaacaactagaatatattgagtggtcagttggcaaaaatatgtcaatcaggaaatgtctttgccgactggtactggtcatctacaacaactcataataaagagttgttttaattagaaggttatttgtaacaacacctatttaggacatattacacacaatactccctctatttcacattatgagacgttttagtctttacatctctcatatagatttactaacatccatatgaatttaaacatgtagataaagcacatacatggatctatatgtatgaaactattcaaatcccaaaacgtcctataatttagaacagatgaagtaattatcactaatgggtctaagtccctgtagatacttttgactgttgatttaaatagccattatatatataatcatatgtaacatgttttttttaaccgccacaagtgacacattaaagatgtgagattctgtagaagtatttatatattttatgattactctctattttaatggaagatatgctttcaaatacacgtggttttactagcgactatccttggtcagttcggtcagagttatataccaccgcatctctgcaaagcatatataatttacttgccagttacgaaaattactccaacaacccatcggtaaaaaagtttagggtaaggcttttcaaaagccaacctagaatcatccatgccaacttaaaagtaaggtcctaactaagggcatgttcactttgatgccattttcaaccttaccaagttttggtaaagttaccaaaaaaagtggcgccctaaaccagcaccggggcaaattccaatcagtgagggctagttatttcagtgtggtagagctgtcctcgttgatgagggaccattagatgatattataattttatatttaattaaaaaaatagcataatgtgcattaggctggttggtaggatattctactccagcaatagactatagaatcggagcggccgcggtaaacattgccgatatagaatattaacaagacggaacagagcgcacaccgttagattatatgttttgggacagccggcctatcaagacttcactacttaaaaattacatatagaggtcagcgctagatgtgtcagaacaactaaaaccagcacccatagtacatttcctatctccacatacaaaaccggcacctttaatatattatttataggtatcagttaattaaaaaccaacacctatgataaggtgccagtttcttttagaaaaccggcatcaatcccaaactgagctgaaccgggcaagccgatcacgtgcccttatccaccactcgttgtccgcctcctctctcttgctctcgccacctcctcctcgtcctcctccccgtatctggcatcggcggcggtggcttttcccgtggcggatacaacggtggcagtgtcagcagcgggtggggcggcgttagcgggttctcccacggcaggtccggcagcggtgaggtctcccacaacagattgggcgttggcggcaggtaggcggcatcgacgggtgttcccacgacgatccggcatcggtggggttcccgcggcggatccggcgtcgccggtgggcgggaggggaaggcggcgggctacaaggcgagagtatgagggggagaaggaggctcaccctcctctccatatggcaacggtggcagaggtggagaaaaatgccggttgcatcgtgttcttgatgttttttatgttaatctttttgatgttcttgatgttttttgtgtttatgtgttctttgatcttgtcaggatgaagtggagctacttgagcattgagccgctttttttttgttcatgtaacctcaaaggtgtcggttcctaaaccgacacctttgagaacatctcagaggtgccaataatgggtgccgttgggaaaactgcactgtcagtttttatccggtaatataccagacagtgctaccaagagcaacactagctgtttagaaaccaatagagttgtcgaatatcactgttggttcatctcataaacctgcaatgatattcatttccagccaaaaaatagattcataacttgatttacatttacatccatttcaaattgcacctcaatttgattggagaaaagaacgaatttgcatacatgcaaatgctccacgtatctacatacttgcatacacacagcaacaacgacaaaacttcacaacttgcagcaatagctttcacaagttgcagtaacaacaaagttttccaacacacaagttgcagtaacagcaaagttttccaacatacttgcagtaacttcaaattccaacttgcaagatttgcttagcaacaagaatctcacaactagttggtttgtgtgttgtatcgacatggcgataacttgttaaatggactctagcaacgatagtctaggctcccttgacatcgcggaatctagggctaccatctttctgatgaaacttaaaaggatttccaaactagttaagcatcattgagtgcctcatgctcaaattaagatgaatcgagtgctcatgctcagactaagatgatagattgatggtagtgtatatggtaagaatgaggaagaatctagttactactcctatatagtaggatagaattagtttatgaaaaatataagcgcacatattatatttattctttaaataagtcacgacattaaatttgtaaactagtagaaccaactcaaatgatctaaacatatatacgagaaagctacacatgaataaatcaaatagaaaacatgaagacgagcatatggatgatatgttgtgtggaggcgatggctcaagaaaatgtacacataaataaattaaacattcaaaacatcaggacgagatctagacatatatataagaaaattacacacgaatacatcaaacatacaaaatatgaagacgagtatacagacaatatgttgtgtgaaggcggtggcttggtactctaaaacgcataaccaaacgagaaaagtcacacctaattttttcggactctatgccaattcatcggagaacccgatgagatttcaaacacaaaattcacacgtatgtcacgtgtgcacgcacgcccctggagcccagccaggcgaagcgaggtgagcatgtacacggatgtttctccagttccctctacaatatatacattgctcaaatggctagaagagtattcactcttttaagaaagtctctcccctataactagctatgtggtactaaagtttcacatgcaactcttttcatgaggttgatctttatgatttttctaagaattattttcttcgagggctaatgcccatactataagtctaacattagtttctttcttttatttagtattgtttggttgatgacttatactttcatcccaacaacccacaagcccatttgcgcagcatatcgtccactattccacttaattagtgcaatttgcatttgcaatctcatttgtatccgtttcacacttgcacttgcaaacagaacgctcattggacagcgttggacagagatagatgattgcctccagatccagatcactcgatttataacgttgttttgttttgtttatgggtttagataccaggctgacagtctcacaccgagagctgctaccttgaccgctaatcatgttcacagattcattgctcaaagaggatgaaggcatgtgttcatatttggtcctattcttcggtcaagttctttgctccgggtttggtcaaaataactcatcatgcattcctacagatggatagatttctcagtctgtactgaagtgtgaataatttaagccaaaaatgcaggttcagaataatgtagtcgtccgtacatatagtttgctgtgagaatcttttaccagttcttggtatattgtaccccctcgttcttggaggaaacttttaatttggattgtgtttcaaatcagtaaaataaaaggatgcagctttctctctaaaagaaaaaagaataatgtactcatacgtacatagtttgctgtaagaatcagaaaaaccctctttgcctatggccaattaatgctggataaatcacatatctattttgggtgtgtttagttcacatcaaaattaaaagtttgattgaaattgaaacgatgtgatgaaaaagttggaagtttgaaaaaaaaaagttgggaactaaaccaggcctttctcagtctatactgaaatgtgagtttaagccaaatgcaggttcagaataatgaagttagtacatagtttgctgcgagagtaaggtacacatgaattcgttaccttaacacacactaaaaagaacaagtattaacggcagttccttgatctcactaaatttctgttaaaaacacacacgcgtgtaatatttgtggtactaatatttgaatcctactggagtccaccacacttatggtgcttgcatcaattccaatgtccaaaactaatattgttcgactaaaaccagttcattttgcggtatgtatttgctaattgtttgtttgattggattttctagaaaacttattcgttggtatacaacttttagaagacatacgtgaatgtagaattgtgaataatataggagtaattgctgacagcttcccaggagtgagagataaattcagctgaggactatataggctgaattctcgattgcccatgacagtatatacacatagcaactggcaactattctagttgcaaatgaaataactagtgagaacgccctcccaagcccccaacatcatactgaaaaacaaccactggtaggtacaaatattcaaatgtggttgaattgcattgcaaaaaacgtgtattcatggatcatacaagttcccaccgtgtcatggattagatcgaccagatgcctggtaccatagagagtatttatgtagcgtagtactcctattacaaagcaagttttcatcaactatagaagcttagccacacagaactaaatggcatgtttgggcgtcttgtcctcaggcattggttggctttgcctatccattatctttatgattctaccaatagccatcagtgatgaacatgaaaatgatcgtcaagctctcctatgcttcaagtcccagctctcaggtccaccgggagtactagcctcatggagcaatgcgtcccaggagttctgcaattggcatggtgtcacttgcagcacaccatctccccgtcgtgtcactgcaatagacttggcatcagaaggcatctctggctccatatcaccttgcattgccaacctcacctctcttacaatgttgcaactatcaaacaatagcttcaatggcagcataccttcagtgctcggtctactcggacaactcaacaacctcaacctcagcatgaactctctagaaggtaacatcccttctgaactttcttcatgttcccaacttgaaatcttagatttgtcgaacaatttcatccaaggtgaaatcccagctagcctaagtcaatgcaatcgtcttaaaaagattcacctcagcaagaacaagctccaggggaggatcccttatgcttttgggaaccttcctaagcttgaaaaagttgttcttgctagcaatagactcaccggcgacataccagcgtctttaggaagcagcctttcgctcacatatgttaatctcgagagcaatgctctcacagggagcataccacagtccttactgaatagttcatccctcaaagtacttgtcctcacgagaaatacccttactggagaaatcccaaagcctttgttcacctcctcaactcttactgatatttaccttgatgagaataactttgttggttctataccacatgttactgccacccctctccctttacagtatctatatttagggggtaacaaactatcaggaacaataccttcctcattaggaaatctttcctccctacttgatctaagtctcacacggaacaatttaaccggtagcataccagatagtttaggccatattccaacactagaactgttgaatttgaatgtaaacaaattaactgggcatgttccatcatccatcttcaacttgtcatccctgaaaagtctagccatggcaaataactcactcacaggggaattaccatcaaacttaggttatacactcccaaatattaaaacattaattctgtccaataataggttcaaaggcccaatcccacctactcttgtcaatgcttccaatctgaaatcgctgtacttgcgcaataatagccttactgggctcattcctttctttggatcattgctaaatttggaggaagttatgttgtcatacaacaagctggaagcagctgactggagttttatttcatcactatcgaattgctccaaattgacaaaactattgatagatgggaacaatctcaaaggtaaactgcctcgttccattggcaatctttccagtagtctcaaatggttgtggctaagagacaacaaaatttctgggcatataccaccagagttgggaaatctaaagggcttggaaatgttgtacatggattacaatcttttgacaggaaacatacccccggcaattggaaatttgaacaacttggtcgttctagccatggcccaaaacaacctgtcaggacaaatccctgatacaattggcaaccttgttaagctaaccgatctgaagttagataggaattactttagtggaggcataccagcaactctagagcattgtactcaactggcaatactcaaccttgcccataactcactagatggaagaataccaaatcagatcttcaaaattttgtcacttcccaagagttggacctgtcacacaattacttgttcggaggaataccagaggaagttggaaatctcattaatctgaaaaaccttagcatctcaaacaacaggttgtctggcaacatcccatcctctcttggcaagtgtgttgctctggagtctcttgagatgcaaagcaacttattagtaggaagcataccaaaatcttttgagaagttggtaggcatctggaatatggatatttcacagaacaacttgactggaaaaataccagattttctttcaaacttcagtttactatatgatctgaatttatcattcaacaattttgaaggagaagttccagcaggtggtatttttcgtaatgctagtgtggtatcaatagaagggaataatggcttgtgtgcaagaacatcaatgggaggtataccactttgctcagtacaggttcacaggaataggagacacaagtctttggttctagtcctaatgatagtaataccaattgtttctatcactatcattctattaagttttgctgcatttttttggaggaagagaatgcaggttactccaaaattgccacaatgtaatgagcatgtgtttaagaatattacatatgaaaacattgccaaggccacaaataagttttcttcagataacttaattggatcaggatcatttgcaatggtttataagggtaatttggagcttcaggaagatgaagttgccatcaagatttttaatcttggtacatatggagcacacagaggtttcattgcagagtgtgaaaccctaagaaatgtccgccatcgaaatcttgtgaaaatcatcactttatgttcttcagtggatgccactggggcagacttcaaggctttggtgttccaatacatgcagaacgggaacttagacacgtggctacatccaaagtcccaagaacttagccaaggaaaggttctaactattagccaaagagttaatattgccttggatgtggcgtttgctttagattatcttcataaccaatgtgcaacgccactaatacattgtgacttgaagccaagcaatattcttttggatcttgatatggttgcatatgtcagtgactttggcctagcaagatttgtgtacaatagattgactgcacatgaagatacctcaacaagtttggcttgcctaaaagggtcaattggatacatcccaccaggtaaataggcttccaaacttttgactcagtttgttctttatatacttgtacagaaattttaaaaaatagagcctagccttatagttttataaaatttaatgcagagtacggcatgaggaaagatatctcaaccaagggtgatgtctacagttttggaatacttttgttagaaattataattgggagcaggccaactgatgaaaaatttaatggcagcacaaccctgcatgaatttgttcatggagcatttcccaataatatctacgaggtagttgatccaaccatgctacaaaatgaccttgttgcaaccgatgtgatggagaattgtatcattccattggtcaaaataggcctatgttgttctgtgccactgcccaacgaacgaccagaaatgggacaagttgcaaccatgattcttgaaatcaagcacgcggcctcaaacaggcatgtcagattaagctaacagctgccaggttctatttcatttatagaagaatataccaatataacatccactggatatttcactgtaaacgtagtatagttaatgacctcattagaagcttgaatggtagccacaatgcttgcacaggcatccctagtttttgaatgttgaaaccttttatggtttatattgtgcgacttacttgttcatcctctaatcactatgaagaaacatcgaattatgagtctttgagattggctcccttccatttttgccatctccggtggctaccggacgctgccgtggtgtatgaaaaacagcatacgcaaaatggtagctagtgttctacttgaatgacactggttgtgtttcagctacctttccatttttcatttgcattctgtatgtttagcgacatgcatgtttctcaatccaccgaaatttacttatcgtggcattagcatttcgtgtcgtttcttttgatataggatgataattcataataaaatgtaaagcagcataaaacatttgtagcctggttaaggacttgaagtaaaagagtagtagagacgtagagcggtaagcatatagaatgtcatgctgtaaacttactccacttctatagatggtttaggtagccaggtaggcaccgttcctgccaagttcttcaaaagcaagggttgaataactatgagcaccaatcaaattgtaaggaactcgaccgatttgcatagccctcgcccaacgggatacatcaagtaagaccgtcaaaatcgattaggtattttggcaaccaatttcgttgggaactaattagtctccgatcaaagccaaattataggtgtttgcagaagctggatttgggtcagattccaaaaccccaagttcaaacatgaccccaacacgaaattagcccaatgaaaggcatagattggagaccggatatatacagatcaatctcacaccgacctaattagcagaaaatcagatgatagatcaagcagataggcattcataggactggatagggggagcacctgctggctgcttgcctgctcgtgttcctgctaggctgctactctcggagtcccagctgccggcgccgctcactccagagtcccgagcggcggccccgcccgtttcggtttcccttgcggactcgccgtcacctgcatagggcgccgccgccgccgtcggctgttgtcgtgggagcccgtcgctaggctacctctggttgtggttgggccatgaatcttgggctatcgttaccatgggaaaacggggagttgggccaggtgtctcgtggacctctcttggcccaagtcagctgtcggtatagaggtcggtcttcaaattcttaaccctgaaggaattcatttcaaaacttgtagccaagtaaaaatattcttctttttttctttcttgaaatatttttaacagaaatactatatgacaggaacctaactatgggacggcatacttaatgatccctacccgatgcgctatccgcttacaccatacattcgtggccctcctcctccttggctccttgcgatctctccatcatcctttttctcttccacctcgcttgtacatgtcgagaatggctcactgctcctcctcctcgttgtcgactcttgctcatcctcctactcaccactctctgttgttgctccatgcccctgctagcctgctcccgtcatacctggtatctaggtacaaacatgacatggcaggctgtggcttgctggttttggttgagaatctgagggcagtggtacaagcagttgcaccgctgtatgggcacggagatggcagtggcagcgctcgaggtttcgatggccgtgggggcgcgatatggtgttcttcctgtgatggggatgtacaaggatcctcttgcccttcctttttcttgatagatctaacggagcaagaggtcaaaatgatcaaatctagagcatcgattgcctcactcgcgttatgtgcagatacatcgtgcggctcatcatcctcggctagcacccgcaattataagccttaggagctgtttagttcacatactaaggtgtgtttagttcacactaaaattgaaagttttgttgaaattggaatgatgtgatggaaaagttggaagtttgtgtatatatgaaagttttgatgtgatggaaaagttgaaagtttggaactaaactcggcctatattgcctaggttagccatactttctttgtcaaacttgtcaaatgcgaggctatcaaaatccaagccacactttagccaacaaaattaaatcatgccacaccttttagagtcactaacatctaagaccaatattataaaagagaaatcttgccacacttatggaagccaaccaaacacctatctaacatggtcaaacttacttaaccacaaatatggcaacttattggcatcaaccaaacagccccttagtaccccagtacccagtacctagctaggtacgaggtaccaagctgctgggagaagcagtgcgctgtcgttgcctagccaaccgacaagctacctgccaccggtggggaatttaactatttgccacttttaggtttgccaattatccaaatgcccctcttaggtttgcacttaataatttgtcaccggagagagataattttttaactatttgccacttttgcctacgtggcgtgccaccgtaccgtgccagcgtgaaaagcaacgtggaccccaccatcagtccctctcctctccttcttatctacctccgatcgtcgccgtgacctcccgccggccccgcgttggccccacaccgtcgtcccctgccggctgcagcggcagcgcgtcgttcggccgtagcaaccacgcgaggtagaaggtccacgaggaggacggcgaaggcggtgaacttcttgcaggtctcgcggtagtgcctctccgcctgtgactcgtacgctggtggcagtggtggcgtccgatgtcccgggcggcgacgacgcctggtggtggtgtcggtgctcg

SEQ ID NO: 30463 - DNA, 6597 bp, Oryza sativa
  unsure (1)..(6597): unsure at all n locations
tccacattgctttccacggtggcacaatacggtggcnccccacgtaggtgaaagtggcaaatagttaagaaattacctctctccagtgataaattattaagtgcaaatctaagaggagcattttgataattggcaaatcttaaagtgacaaatagttaaattccctgccaccggtgattcctctccacttcactgttcctctcctcagctcgtccctttttcctgctgctgttggtgttgccctgctcatactatggatagagtttcctttctgcgctgtggatttaacattttttttttttgggaaagttcaccagttcttctcaagacgtgaaatctccttctctttttttttttgtggggttctgatttttttttttttgatcgtggttctctctcccttttttttttccaggtatcttgagcggagggtgcacgcaaatgagaaaacgggaattcgaaagatcgttttttttttccagcggctaacatatgtgaccgaagcaacaaaaactaattttaagataagggtttaatttgcattgctattcttacctatacaaaacctaaaaccagatgacaaaactgagcaaaaagttataaaattagttacagtttacaagccgaagctaaaacaaatatgaaaacgctgcaagagggctcggtcgatcgatcttgcatatgtactacacgtcgatagacaccagataaatcatttcttgcctccttcccggtgatgcatctcttctccggtgccgagacccagcattgtttacagattacaatcaggaaattaaactggttgtggtgtgttccgcagcaggttcatgttcagagctttgagcgaccttgcagattaacctggacccaaattaattaagaaccggtcatacatagggatacaggtaactaacccacgaatctacttataaatcaacataaatggattattttgatcaataaatagtttcgcgtgttaatcacttactcccttaatcataacatgactgaaaataaaacaattaaacggtacattgtacatacactcattgtgacatattgcaagcgaacctgctggccttaccttgagaagaacgagcaggggggtgttaaggatcaggaaacgagtccacaggtgaatgctgttgatcttgaccaggattacggcttggaggccctggaccaactggcaaccaaacaagatcagaaccaatcacacatgaatatgcaaataattaaacacatcatgtacacacacgaattgtggcacagatgtatgcaatcgcgaattaattaattacccagaggctgatgaggagggtgtttaggatcaggaaatgagtcaacaggtgagtcatgaggaccaaactgcggagcaactggcagccaaacaagaaccgatcgatatatcacacatgagagaaaataaacagtgttgtaacagatactagcatagacaagcgtatatatgttacctcgatgactaggaggagggtttttaggatcaggtattgggtcacgagggccatgtcggcttggatcatcatcggatggcgtaactggcagccaaagcggaaccaaattatgcagtgcatcattagtattcattccgtcttaaaatatactcccctgttcctaaatatttgatgccattaacttttttaaacatatttaaccgttcatcttattcaaaaaaatttaaataattattaattcttttcctatcatttgatttattgttaaatatatacttttatgtatacatatagttttacatattttacaaaaagtttttaaataatacgaaatgttaaacatgttttaaaaaatcaacggcgcgtcaaatatttaggaacggagagagtactagcgtattaaagccgttacctgcaggaggaggctttgactcgctgctgggtggtaggggacggaccacggcgtggatggtcagttctatgcttaaccctggagaggctggaggcgcgacggccgccgccgtaggggtgacggccggaggatcgccggcaggagcggccgccggcggagtggccgccacggcgtcgctgatgacgacgggtgccatcttactctgcattttcttttggttggctgtactgtagtctgtactggagcacacgcgagataactgatcagttgcttataaggctatttatacatgcgttaataactctcatatatatatctccatcggatcagtttcccatgacaccgtcacaccatggaacctagacgagtggcgtgcgtttacaccaggaatgtgatgtggcatagacttcaagctcagagtcagaaagtactccctggagaaaacaaatgtggcatagacttccaattttcaaagttcagagtcagaaactcggtggtgaaaagatatggtttgtcgggggaggtgctgtcctgcggtcaactatcaagtggtttgctcgtgcgtcagcctaaaactcaataaattcagatttcatggcgtcattcaatctcacaaattagccccactagttacgcggtggatcacgagcgttcacatctatattttcagattattctttattttagagaaagaaatgcttgcatatacacaatacgcataactcttatccacgataccctaccaataccggtttagtaaaaaccggcactaataggggtttttttttttttgtcccatggacttgtgcacgcactggcaagagaaaaaagggtattgataatatcacatcattatatatcgctggattgctagtcgaaccgtcactaaatacttctattctagtttttttttaaaaaaaactaacatagtaaaataactattcgtgttggtttttaggaataactgataaaaaaacgagccgagtgacaacggggctaagccgagccgagtgagggaaaaaatcttgaagtgtcaacccatcgctctctccttctctccctcttctcactagtaagtagtagtcccctcatcctctcctccgtgagcagcggccccctccctctctccttatgctgcattggcacccccccctctctccttggatctaccaccacagctgcagatcgatgcctctcccaggtatcttttttttttggtttgtagacgtgaattagtgccggttaaggatttcctttttttgttggtgaacacgaattactaccgattctaggaaccaacactattgggggatggccccgggcatcctccggagcccatagtgagtgacctcactccacctagggagccccaacctacgcgtcggtgacattgggctagctccagcccgaaaggacgaaccaatgtctcctcaagatgataagctaggcaccctccgaaaacccaaaggcttcgaataactatcaatgcttaacaagacaaggagcattcaatacttccacctaccaaccacctagttctaggacttcgagtggttgggttgcaatcaaggacctggaaatcttaggcccatccttgccaagatctgctaggatgctaggatccgcaaagctctattgacccaccaacataatgggccaccaagggcggccccctcaggaattagccccctgccccgaggagggggccacttgtcaatcgcccactagccaaggctacccggagccgtactaagaaccagctttgtaattccccatgtcataaaccctgttatataaacaagtaaccatgcctttgagcggcaggttgttcaataagtctatttcgctcatctcatacacacaagtctatttcgctcaactcatacacagagaactattggatttcgttccaacagcctccccccaacccacccactccccctcccccacccccagcacccccgcggtccacaatgctactccctccatcctaatatatagggcgtacctgccctgaacgcagagaccaaggatgcgtacccgttttgctcgtccaacgtgcaacgcttcgcttcacgcgcagccctcgaccttcacgcgcagttgtgctgggagagagagagaagcctttttaactaaccaaactgataagcaaatattgcatgcgtgtaaacgggagtgtgagtcttgaatgcttgtatgcatatgtatgggaacgaggaaaactttaatgcttgcatgcgtttaaacggctgccgaggaggtgccatacgtcctatattttaggatggagggagtagtgttgtagttccgattagggaaatgatacttatgagggtttctatggttttctaaacattccgaacttgagaccgccacatcatcctcctatgtcaccatggggaggagaatgcatggaagggtgggagggagagaatccagttgggcagtggcttccatgcaagagagataatagagggagaggagccgcggcagaaaagagggagtaacacgggagagggagagaatggagtggaggagaccatatgggggatttggctcgtgcaattgattggccagcttcaaccgatttcactattggtcaggtagaggtagtatcactgtcaatttttaacgtgaaccagcaacaaaattatttttgatggtgattataaataaactggcagtgacgaaaggagttggactgatggctctttactagcgaatgcaatttgcatttgcaaaccgcattgtattagttgcacacttgcacttccagacaaattaaatcacattaggaagcggtcaatcactgcctccagacccagatcgatcacacaatctttgaagttgtgttttatttattcattgctcagaaaggatgaagccgtgtgtccatatttggtttactagcagcctagcaggactgcacgaggtcaagttgtttgctcttggcttggtcaaaataacccagtggatagacttctcactctgtattgaaccgtgaagcttgtaaaagaaagagacaggttcagaataatgaaatcagtacgtagtttcattgtgataatgaccagaaaaaggctattttctatatggccagcgtggatggacgactcaattttgcgttgtctcttttcagttacacggaagacaacacatctgtaatacacatcattacacatggactgatggacacaacatttacttagctgcgagggcacctcttaacatacacacacacacacaaaaacatttattaagaagaaattgtaaatgtgttgggattaaatacaagacctcgggttaaaatcatacacctcttgctactattctatcaagtcacacgctaaataaatgtgacttctagcaaatcactaacatcactaatattggtggctgcaggacttaaacattaatgaccacattacatgactgaagcttttgcatcaattccaacaaaatgtccaaaacttatattgttcaaccaaaatcagtttagtttgcaatatgtatttttttactatttattaattgcattagtagaaaatttatttattattacattatcaatactagtgttagaagacatacatgaacatacaattggaaataatataatttgatcctaggtagtagttgctaactacttcctaaaagaaaaaataataataatttgcggactgcatagtctgacttctccattgttcatggtagcaactggcaactattcaagttgcaaagagaacatatctagtcagaacacccccttagtccccaactacgtaaataactcaattgcaaggcttacttggcaactattgccacttcatattatacaagcttcaacgactacgagccccaagtaacttgtttttgaaagaaaacctccaagtaatttaagcagtacagaaataaataataaatggtaggtaaaatagtccatgggttgaatggaagccaacagacctgaggtgaactacaaaagcgtgtattcatggatcatccaagtccccacagtgtcatggattactagaaacctgatgcaatacagagtatttatgcatcacagtgcagctattgcaaagcaagtttttatctccatagaaacttagccacagagaagcaatggcctgtttgggtgtcctgtcttcaggcattgtatggctttctctgttcaccatctttgtcagtataccattagctaccagtgatgatcatgaaaatgatcgacaaactctcctttgcttcaagtcccagctctcaggtccaacaggagtactagattcatggagcaatgcatccttggagttctgcagttggcatggtgttacttgcagtacacaatctccccgtcgtgtcgcttcaatagacttggcatcagaaggcatctctggcttcatatcaccctgcattgccaacctcaccttccttacaaggttgcaactatcaaacaatagcttccatggcagcataccatctgagctcggcctactcagccaactcaacaccctcaacctcagcacgaacgctctagaaggtaacattccttctgaactttcttcgtgctcccaacttgaaatcctagatttgtcaaacaatttcatccaaggtgaaataccagctagcctaagtcaatgcaatcatcttaaagatattgacctcagcaagaacaagctcaaggggatgatcccttttgattttgggaac

SEQ ID NO: 30464 - DNA, 15524 bp, Oryza sativa
  unsure (1)..(15524): unsure at all n locations
tacacggaacaatttagtcgggaacgtcccagatagtttaggtcttattccaaaactagatctgctgaacttgaatgcaaacaacttaattgggcatgttccatcatctatcttcaacatgtcatccctgacaattctaaccatggcaaacaactcactcataggggaattaccatcaaacttaggttacacactcccaaacattgaaacattagttctgtccaataataggttcaaaggattcatcccacctactcttctgaatgcttccgacctgagtttgctttacatgcgcaataatagtcttactgggctcattccattctttggatcattgaaaaatttgaaggaacttatgctgtcatacaacaagctggaagcagctgactggagctttatttcttcactatcaaattgctccaaattgactaaactattgatagatgggaacaatctcaaaggcaaactgccccactccattggcaatctttccagtagtctcaagtggttgtggataagagacaacaaaatttctgggaatataccaccagagataggcaatctaaagagcttagaaatgttgtacatggattacaatcttttgacgggtgatatacccccaacgattggaaatttgcacaacttggttgttctagccattgcccaaaacaaattatcaggtcaaatccctgatacgattggcaaccttgttaagctaactgacctgaagttggatcggaataactttagtggaggaatacctgtgactctagagcattgtactcaactggaaatactcaaccttgcccataattcactagatgggagaataccaaaccagatcttcaaaatttcctccttttcccaggagttggacctgtcacacaactacttatatggaggaataccagaggaagttggcaatctcattaatctgaaaaaacttagcatctcagacaacaggttgtccggcaacattccatccactctcggccagtgtgttgttctggagtctcttgagatgcaaagcaacttgtttgcaggaagcataccaaattcttttgagaacttggtaggcatccagaagttagatatttcacggaacaacatgtctggaaaaataccagattttcttggaaacttcagtttactatatgatctcaatttatcattcaacaattttgatggagaagttccagcaaacggtatttttcgtaatgctagtgtggtatcaatggaaggtaataatggcttgtgtgcaagaacattaatagaaggtatacctctttgctcaacacaagttcacaggaaaagaagacacaagtctctggttctagtcctagtgatagtaataccaattatttctattgctatcatttgtttaagctttgctgtatttctttggaggaagagaatacaggtgaagccaaatttgccacagtgtaatgagcataagttgaagaatataacatatgaggacattgccaaggcgacgaatatgttttctccagataacttaattggctcaggatcatttgcaatggtttataagggtaatctagagcttcaggaagacgaagttgctatcaagatttttaaccttggtacatatggagcacataagagcttcattgcagagtgtgaaacactaagaaatgtccgccatcgaaatcttgtgaaaatagtgactttatgttcttcagtggatgccactggggcagacttcaaagccctggtgttccaatacatgcgaaatgggaacctagacacatggctacatccaaaggctcatgaacttagtcaaagaaaggctctaaatatttgccaaagagttaatatagccttggatgtggcgtttgcattagattatcttcataaccagtgtgcaactccactaatacattgtgacttaaagccaagcaatattcttttggacctcgacatggttgcatatgtcagtgactttggcctagcaagatttatatgcaatagattgactgccaatcaagatacctcgacaagtttgccttgcctaaaaggatcaatcggatacattccgccaggtagagatgagcttctaaactttttggcttaatttgttctttattatatacttgtatgaaagcagagcctagcatctagttttataacgtctgtaaatctgatgcagagtatggcatgagcaaggatatctcaaccaagggtgatgtctacagttttggaatacttttgttagaaattattactgggagaagcccaactgatgaaatatttaatggaagcacaactctgcatgaatttgttgacagagcatttcccaacaatatcagcaaggtaattgatccaacaatgctacaagatgacctggaagcaactgatgtaatggagaattgtatcattccgttgatcaaaataggcctatcttgttctatgccactgccaaaagaacgaccggaaatgggacaagtttctaccatgattcttgaaatcaagaacgcagcctcacacaggcatgcttgattaagctaagacctggcaggtcctgtttcatgtatagacgaagagtgatttcatagtccttgaagaggtacaggaggtaacatattttctaatgtaaaatttggtacctctcggtaccgtactactaaatattttggtacctcttggtgcctctcaaggactataaaatttctcgtagaacaatgcaccaatataacatcacgtggatatttctttatgaatgcagaatggttagcgacattattggaagatttggtggtagcacgggcatccctactctttgaatgttgaaaccttttatggtttgttctgtgcgacttattccttcatcgtctaatctctatgaaaaaaaaactaggccgttttcgtgaactgatgagaggaattgggagaaaaaagttaagacattgcaacagaggagagaagagtggacgtacagtagcagagaagagaagtgaagattaggaaggcaccagagacaacaagcatccaggtgtgccacaaatagttgcctgtaaatcagagctcaaggacattagggaaaaaattggacagattagagagagcatacagtatatgccaaatatatagacaaaggcgcaatgcatgaatatataaaagcatttataatcaagatttacaaatccgatcccaatagaagtgtggatgcctcgccgcgaaatccgcggtgtcgaccatggcctagtgggcacctgtgcaggaggagaatgcagcaaggaacagtttggtcaggtagttccatggcagggagaatacatggattgagattgggggctcaccgttgtccctgttcgcaattcaccatcgccggctcaccatagcgagctgcagagaaaggggggtaaatccggggggcgaggccccagggggagagggtagccagccgcgggcgtcggcggaagtggagcggaatgcggaagccggaagagctgccggcggcggaggattcatcagccgccgcggtcgtcttcttcttccgtccgctagcctagccatcctgtacggaggggcggcgatgtacgggacgagggagcagcgttggagtagagaaacaggacaaaacggacaatacgacattcctccatccttaagggccctttgaatcgcatggtagaaaaaacagagaaataggaaaaacacatgattctaacagaaattgaagtgtaaaacagagtattgcaagacacagtgaaaatccaggaatggtcgtttgattgaagcgcaggaaaaacgcagaaatcggatgagagagatagactcaaaagaaattttccaaaaggttggagctcttgccaaatttcctccaaaatccacatgcaatgtgccattccataggaatttcataggatttgaaaaacttcaatcttttgaatcaaagggccaaataggaaaatttcctataggatttgaatcctatgaaattcctacataaatcctttgattcaaaggagccctaaaactttgaccatgacagaatacgcaaagctccttaaaacttgtttgcaaggccgatgttatcaaatacatgttatcgactctaatattgaagaggaaaattagaaagtggatttttgacttgacataatttgatctcagaaaatgaatcatctaaggcagtcaaggggcaagctatagccaattttattgttgagcatcgtaatgactaaatcggcttggttgatatagttccttggacattgtttttctatggatcggtttgcactcatggttatggtatcggtttggtaatcatatcgcctagggaggcaagttttgagtttgcctatactattaaaccttatgtaaataataatcaggcttagtatgaatcagttctcaaaatattacaattgttgaaagaggttgaagccgatactgttaaaatcatgggcgattctttgttggtcattagccaattagccggagagtatgagtgcaagaatgacacgttgatgatctacaataagaagtgccgggaattgatggatagttttcggttggtgacaatgaagcatgtttctcgagagcaaaatgctaaagctaatgatttggctcaggaggcatcaggatacaagccgatgacgaaaaatattgagatagaagtcgttacaattgcagccgatgattggaggtataatgtatttcattatttgaagaatccttctcaatctgcttcaaggaaattactgtcaaagtgaggttgttgaaaggctttgccgtggcaagtctcattcgttgggacgtaggctcatgtgttgggaaagtagcggagtacgggtaaagtgtacatccactgcagtgtgagtaaaccaaatctattcgaatagccgtgctcgcggatattgaaccccgagacatgtattacacttggctagactctaaattcttagggcctgtttgggggagctttagattctgagaagcagctgtttggtagccagcttctgagaatctggaaaagctctaaaatccagcttctccagcttctggcttcttagttcatttttcagaatcagtaactacatattctcagaagctgtggactgtttggggcagcttctagcagaagcagcttttgggaaaagctgcagatgggacaagctcccccaaacagggccttaaactaaatgggtgggatgttgcatgatgattttatactagtggatcaacttctcgagaggcgagaaggggtagaccccagaaaaccatgacgaccagtggtaggaagctatccttgggaacacaatggaaggtggacataaccgtcgttgtttaatgaacaatggagttaaagcttgatcagtttatgctaggtcttaggtttgtgcactgatatttgaaaactcagctttacgcaaagtaaccatagccactccttgtattatcctgtacattacggcattttgtgtggtggcttgctgagtacttttgtactcattgttactctatatatcttttagcagagtgttgaagagaagcccttgttagtacgcttgcgtacctaacaagataatcggagtgcggttccattttaggtctcgttccccagtcgactgcttgtagcatgtcaaccgggcccttgtatattattttgtcttccgctgttgttctctgatagatgttggcctgcctggccctaatgtaagcatttaactctcttagcctgaattcattcgtgatatattatgattcggttatgtatgtgtgtactaactactgatttagggattggtactgaagaacacataagatttctgattttcaaaatcgggggtcgacaaagggggatgaaggggaagaaaggggagggtgaaggagatcgagaaaatgagaggagagnaggagaagaagaggagggattaaggacgagcagcgcgcgcggctcgagccagggattttcgtgatttttttaactttggtcctggttggtataaacaaccggactaaagataaaaatgtgcatgtgtgttttcaaatcggtaataaatatatttttagtcccagtttttactcaaatcgggactaatgtgatttttgagtgacccaacaaagatcatttctccagtagtgaaataagggcatgtacaacggtctttattagtggtctctctattgccatgcaagtaaatttaatggcatggaagaaagagaaatgagtatggttgttatgcatgacaacggctcagaatcgactcttaacatttattagagcaaattttctaagaaaaagtattttaatacattaatgattagatatcatattatcttaaactgttttcgtacactagtctctagataacgtagtgatcatatccgactctatctttgtacatgccctaagccctcctctatcagaattctggatccgccacatagaagaatggaaggtgatgacacgccatcgatctctcttctataccaaatagaaagggagaaaggtatggtagagtacaaaatgcaggcattagcgaccatttggtgctgatgttttatttcctgggctaaacgccattagcgttaagcttgtcactaacactaaggcctagttctttttctcaactccaaatttcaactttcttgtttttttgttagtacacttttcaaactattaaatgatatgtttttataaaaaaaagtttctatatagaagttgttttaaaaaatcaaataaatctattttttcaatttttttttaataattagtacttaattaattatgtgctaataaattttctcgtttcacatgcactgaaaaatatcaccaagtttgggcgcagctgcccccgttaggaattccccagctagattcatgttggcctctccaacacccaagtcacaagtaattaataacattactgtccacatatatataaatcggaccaagtttacatatatggcatataaatcacgggagtttcctcatcttggacgaagtggataggccggcgcttccatatccctcttccacggtttctaccagacgcgacgtgggaagtggaaggtcaccttttgtcttcatcagtgacggagctagaaaatcttcacatcaagtgctgaactgataggagtttaaatatttccataaattacatggtatttttaagattataacgagcaattaaggattatggaaccaggcataaggtcagtggcggatccatagtgtaagcattgatttcagctgacaccaataacttctcgctaatctctttgctaatacactctagaaacaagaattatatgtattgacatcactatatttgagtagtgacctcaatgactctattttctggatccgccgctgcataaggctgaaggcctactgccccataattgtttccgcccctggtcgacgacgccggctacgtctttattctctgtcccaaccgcgcagaggcggggttgggattgtcatgggggacctgggggacctgggggaggatgtcgaggatcaggagggttgtgaatcgggtcaatagtaggcgtgtgtggaatacctgatgcagcaccaaggaaggataaataaattcactattaaatgggaaatcaaacaaatgaagaagaaatatatggagccatatatacgtgggaagacaatgatgtactagcattcgaaggaggaatagaaaaattcagttacatttacgtacaagctgcaggagtaataatgacatgtaatccttccgtactcgtaaagaaagttgtttaggataatgtttaagtcaaactttaggattataaattataaatagtacttgttgagtttgaaaatgtaaaaaatacttcctccatctatttttgatagtcatatttcatcttgatacacagactaaggataagtaattctacttatcatctatttaaacatgctactagtcattactcataaacaagtgattcattaatatttacatttctcgatgcgcatagagccaatcttgtgtggaagaatggagagtcacgcattaaatccgagaaagccattaagataataggttgtttaattgaaatatgcctatcgaaaataaatttttcagatttagaaatatgactatcaaaagtagatggagggagtatatgaatatatttgtcttgaaaaatactttcataaaagtatacatatatcactttttaataaatatttttatagaaacaagaagtcaaagttatgttttggagaccgtgtcgttgtccaaaacgatatacgctacagttgcaaaattctagtaattaatacgtatatcaaaagtcataaatctcacttaagaaataattaatgaaaagttcatgtaggttccagctatcctaccccgtggagcacgatcactgtcatgggatggtgcagccggaggaggaggaggattgttgatggcagcggcggcaggacagctgacggcggcaactggaggctgagctgccgatggagagccgcaatcactagcagcggctggatgctcagtgtcccgacgagcaggcggcggatcgccgccggcgccgcagccgttaataagtgacattacggtctgttgctctgggtgagtgacggctgatgagtggctagctgagttatagatggaactttgccgtatcagacgagtcagttgtcaacgcggctagacaagtctcctgtagaaaccacacgcgttcagatcgtgaaaataacatcatgtaacattggccggacaaatgttatagttggccgggccaatgcagtgcatggtggagattggagaatggtgacatctcgttatcaatgtctgaactcacgggtattgaattgtcaaatttgtctgaactcactaccattgaatacatttcgtcacatacttttgattacacttggtttttcagaaaaaaatatatttaaatatttaaaagatgtcatattagtaaagtgtattgcgtcctaagagcacccgcaatggtaaagtaaggtgctatctataaaacatgtgcatctcagcaatatactagattaatagtaaaccacctcaatagtaagtctacatgggtatctatagctctctcatgtattgcctcgtttttctctattgactatctctaagttagtagatagctttgctctctctctcttcatttaagatcttccatgtagaaaaatatgctgacatggatctcttgcagagagcctatagatattgtgggtaccctaagcataaaaataaattttccatgcaccgtagtataatcatttcaatttggaaaaaagtttaaattacgctctaaataattgcagcagtatgaattatatcccctaaactacaaaaccatacatattacatcccaaactttttaaaccggacgaataaccccctaaatcaatccggagtggttttgctcctacctaacacacaaatggcaatccagacagcttaataataataatcatctatttagaaacgaggggagtagtacaagtagccaaagtttgaattggcttatgaaagttattttaaaacataaaaggagtacattctaattctgtcggctcccaattattttttaagaagaaattgtaagcgtgctggggattaaacaatgaacacaggaccttggggttgaaaccacacatcccttgctattgcactatccagtgcatatcacagtgtatctgtataatgaatcttcaatggatggcatgtgtgaaagggaatatcgactcttgttaaccttccaggcaattgaattggtgggagaagacgacgacttgtacagctgatcaaaagcatttactccaactgctttctaaataattcacgcaactgataaaagcatctccagttccagcttgaataaaaactagatcagctttagagcttagaacagcaatggcctatttgagggttgtctctattggttgcctttatctatttgatttcttatgcttcctaccaatagccatgagtgaccaaactgagacagatcgacacgctctcctttgcttcaagtcgcagctctcaggtccaactgtagttctagcctcatggagcaacgcatccttggagcattgcaactggcatggagtcacatgcagcatgagagttcctcgccgtgttatcgccattgatctcccatccgaaggcatcataggcccaatatcaccttgtattgccaacatcacctctcttacaaggctgcaactatcaaacaatagtttccatggtggcataccgtctgagctcggcctcctgaaccaactcagaaaccttaacctcagcaggaattccctagaaggtaacataccatcagaactctcttcatgttcacaacttcagatcctagatctgcagagcaattccctgcaaggagagattccaccaagtctaagtcaatgtgttcatcttgaaagaattttccttgccaacaacaagctccaagggagaatcccctctgcttttggggaccttcctaaactgcgtgtacttttcctggctaacaacagactttcaggtgacataccaccctctttgggtagcagccttacgctcacatatgtctgacggagctcgtggctcctcaccgggagaccgcacaggcccccctttgctagttcggccgggggcttagggtgaaatctcaagctctctcggtatgtggaaagatcgcgagccaggaagaaacgcgagacacgggcgatgtatacaggttcgggccgctgggaagcgtaataccctactcctgtgttttggtggatctgtgtatgaaccagctacaaaagtctcaaacagccccccctccagcccttcaaaattctccttttatatctcaaggggataccacatgcacctctccctttccaaactggactgttcttcttttcataaatggacggagatcggtacggttgctgtccgagtgcccttctgacgggacggcccatacctacccccacttcgccggaaacaggtgcgacgtgggattatggctgtctgtggatgacgcgaccagtgtcagaccggtcacagatcagtcatctttgtccaccacgcgtcagcttagcaacgtgcatgttcgcccttcttcatgtaacattttgcctgtaatggttgggatgaagcctggtatatatctgaccgggggtaacgtgccatctctaagaggcaacacgctagctccggctagagacgagtgcctagaggctctcgtcttgacgggatggggcgaggcgtgcgtcagaccgccagtcgccacctaacccgtgatctgaccggtctgtgactggtcacagaccggataaaggaacgcgctgcactgcgctgcatgcagcgtgacacgcttgaccagaccgcaataaatgcggttagatgagccctgccgtgttcacctaacccatatatgtgacgcaaaaacccacaaggggtcggggcgcctcggccctcggggccgggacaggagtcacccgacccccctcggggaaatcaggaggagggcggacacctcaccctcgggcccgacgtccccgagggtgccaggccacgtgggcgattatgtctgcctcaagcctctggtctcgatactcccggtcccatatcaccgacaatgtcaatcttgggaacaatgctctcaccggaggggtaccaaagcccatgttaaatagttcatctttgcaacaactcattctcaatagcaatagtctcagtggagaactcccaaaggctctactcaacacgttgtcacttatcagcatttacctcaaccagaacaatttttccggttctataccacctgttaaaaccgtgtctccacaagttcaatatcttgatttaggagaaaactgtctcacaggaacaataccttcctctgttgggaacctttcctccctactttatcttcgtctttcacagaattgtttagatgggagcataccagagagcttaggacatattccaacactagaagaattgaacttgaatttaaacaacttttctggagcagttccaccatctctcttcaatatgtcatccctgacatctctggtggcggcaaataactcactcaccggaagattacctctagacatcggctatacactcccaaacattgaaggcttaattctttcagcaaataagtttaagggctcaatcccaacttcccttctcaatttaacccatctacaaatgctatacctagctgacaacaagttaactgggatcatgccatcctttggatcactgacaaacttggaggaccttgacgtggcatacaacatgctagaagcaggcgactggggctttatctcgtcactttcaaattgcacaagattgactaagctgatgttggatgggaacaatcttcaaggaaatctgccaagttctgtaggcaatctgtctagtgatctccaaagattgtggctaacaaataataaaatttccggacctataccacaagagataggcaatcttaagagcctcactgaattgtacatggattacaatcaattgtcagaaaaaatacctctaacaatcggaaatttgcgcaaattaggcaaactgtcctttgctcgaaacagactctctggtcaaatcccagatgacattgggaaacttgttcagctgaataatctaaatttggattggaacaacttgagtggaagcatacctgtgagtatagggtattgtactcaactcgaaatactcaaccttgctcacaattcactagatggaacaataccagagacgatctttaaaatttcttcactttcaatagtgttagacttgtcatacaattacttgtccggaagcatatcagatgaagtaggcaaccttgtcagtctgaataagctcatcatttcatacaacagattgtctggagatatcccatccactcttagtcaatgcgtggttctagagtatcttgagatgcaaagcaatttctttgtaggaagcattccgcaaacatttgtgaacatggtaggcatcaaggtgatggatatatctcataacaatttatcaggagaaattccacagtttctaacgttgttacattctttgcaagttctcaacttatcattcaataattttgatggagcagtgccaaccagtggtatttttgccaatgctagtgtggtatcaattgaaggaaatgattatctgtgcacaaaaactccaatgagaggtgtgcctctttgttcaaaatcggttgacaagaaaaggaaccataggtcattggttctagtcctaacgacagtaataccaattgttgctatcactttcactttgttatgccttgcaaaatatatttggacgaagagaatgcaagcagagccacatgtacaacagctgaatgagcacaggaacataacgtatgaagatgttctaaaggccacaaatagattctcttcaactaacttacttggctcaggatcatttggaacagtttataagggcaatctgcatcttcctttcaaagaaaaggacaatctgcatcttcaggaagaacatatcgccatcaagatttttaaccttgatatccatggatctaataagagctttgttgccgagtgtgaaaccctacaaaatgtccgccaccgaaatctcgtgaaaattattactctatgctcttctgtggattcaactggggcagacttcaaggctatagtgttcccatattttccaaatgggaacctagatatgtggttacatccaaaatcccatgaacatattagtcaaacaaaggtgctgactttaagacaaagaattaatatagccttggatgtagcacttgctttggattatcttcataaccagtgtgaattgccattagtacattgtgatttgaagccaagcaatattctgttggatagtgacatggttgcacacgtcagtgactttggcttagcaagatttgtatacactagatcaaacgcacatcaatatacatcaacaagcttggcttgtctaaaaggatctattggatatattccaccaggtgagataagctaatttttaagttgataattctgtttaatgatacacgtggtgtctggtttctaattttatgacttctgtaaatctaaatgcagagtatggcatgagcaaagatatctcaaccaagggtgatgtctacagcttcggaatccttctcttagaaatggtaacaggtagtagtcctattgatgaaaaatttaatggtggcactaccctgcatgaatttgttgatgcagcattgtccaatagcattcacgaggttgttgatcccacaatgctacaagatgatgtcagtgtagccgatgtaatggagaggtgtgtcattccattggttaaaataggcctctcatgttcaatggcattgcctagagagcggccagaaatggggcaagtttctaacatgattcttcgaatcaagcatgcagcctcaaacatgagcgtcaaatgaggcaaattaagatttggcaatttcatgtatggaagaataatgtaatgtaacatatttgtagcttttgttttgttttctaatccaatgtagttagtgttcaaatgaggcaaattaagatttggcaatttcatgtatggaagaataatataatgtaacatatttgtagcttttgtgttgttttctaatccaatcaatgtagttagtggtgttagcattcgccacattcctcttaattcttcaaattgaatatttctaccagcacagttcaagccaccagagctcagtcgatttgcagaactagcatcagaccaaaccaagtggatttggtgtcagttagtaccaaatcaggcgtgaatccaatccagggcaaaattcgcccaatcaagagcagggtggagaggggatgcacacagattgatctcccgcagcctaatccagcccaaaatcccacaataaaccaatcagagagacgggtgaatgagcacgtacctcctagccgcggaagccctagttgccgcgacggcccgcttccttcccaatcccaagcgccgcccgccttctgccgccgcttggacctcggcaaccccagcactcggctggcactgcgccggtaaccggtcgccgcgctttcaccatgggcggcgattcgccgacgagccatggcgattgccgttgtcgccggcggggtgcgcgggtgggtggatgggcggaccacaggagtaaatcaggaaataagttcacggagatgcgagattttctaagttcccttaaccgcaaaaccagaaatcttcgcccctcaactttacaaaaccgtctaatttggtcccaaggcagtacacatggctagttttgatgatgtggcatcctagtcagcaaaaatatttaaataaatatgtggggcccacatgtcagtgagagaaaatgatgtgggcccaacaactctctttttttttttctttttctcttctcttctcaacttctcagctctcacgtgcaggcgggaagatggcggccgacggcggaacgggcgcggttgccggcgcaacgggcgctgcggcgcgcggtgaaaaagccggaaagggggagag

SEQ ID NO: 30465 - DNA, 8809 bp, Oryza sativa
tgtccagccgacgcatcgcctcgggcgtccgctccttcggcggcaccgtccccagctgcctcgtctgcctccggccgccgccgttgtcgtaatgaaacacccattaattagtttgcacgctgcatgcagctagctagccaaccggattcatggggttgtccaccatgccctgcccgaccatgggctggtccaacacgggaggaggccgtgcttctccagctgcccacgcagcccgacgccgctgaacatcagcagctgcaggccgctcagcatcagcagctgcaggctccccagcgtcccggtgtggtcgcgtgcaccgatgggagcaccgggagagggctcggcggcgagcgggagaatggacagggaaggttcgagctacggcctgcaggtggctgcgaccgccgcccgctgcaggctccgctctccgccgctccgcgtgcctgctcgcccgccgtcgccgctagtagccgcgctcgcccgtcgctgcctgccgcctgcttcgctctccaacgctccatctacctgcttgtccaccgtcggcactcgcagccacgcttgcccgccgctgctcgtcttgcctgcttcgcagccgccgactccgctctccgccgccgcggcgactgctgcagctctcccctctgcggcaagaaaaggaaaagagaagaagaaaggcagcgtttggctaatgggatggggaaatcatttcccacccatcaaaaggcatctttaaattctaaccattcattctctctctttcatttaatcctaacccttcattcatttcccaatctcagtcccaccctccatttcccattatccaaacacacccaaagagaaaggaagaggatgatgctgacaagtgggcccttactatttccttctcacttacacgtgggtcccacattattatttttattttttttgctgactaggatgccacatcagcgaaactggacgtctatactgcctagggactgtttttgaacggttttacataattgaggggtacacatttctggttttgtggttaagggactttaaaaaaatctcgatgttaagttgagggacctcgggtgaacttattccgagtaaatcaccatctttctgcagccaagggcccatttgccgtaaggcctagaaagccacgtcgtttgtggtggaatgggctggaacggcatcaacaactgtaggctatcggtaacgaatccataataaaaattattatagattgatattctaatgatataaattagctagacttatataatctgccctaggtactaggtacagtgaatcaggaaagtgtacataggtacaccactgaaggctactacatatggcggttgacggagagatttcatcacatagcatttattacgatgcgaagaagggaaagataacctaaagggagcggatgcacaaatgatcagcattcgtttgatctccgtattatcttacagagagcataatatcgcaagtatggttgtaatgttaactatagaataattacatgaaactaatacaaataactcaaacaaatattttactatatcatagcgaattcattccaatagttgtgatctaaattattgtttagcctaagccaaaggtggctacgacaaaagatagtaaaagaaaaacatttgcaaaaaggagtaaaggacatgagtgcgcaatatggctcccaagctagcctgccgaaaggggccaccgtagaaaaactggtcaccaacaatagatgtgaaggtgtagatattctcattggtggagaagccaatcaaatcattctctgccgaccaagctcgtccttgcccatcaatgaactgaaggtttttcgtggatactgccatattgccaccgtcaactgccatgtaaccattgcccataggaggtggaagaggtgttggttgaaaagttacattagtaactacaatgcctccaaaccacatattgatggcagagtaagatagacttttgaagaatgacaaagggatgcgcccgacgagttcaggatgcttgttattaaacccatagtgcaccaaccaatcccctgatgccatatcctgcacatcattatcaaagagaaaatagattaaacttttttttcttgttctcgcgtaggagtatcatctactgataaacaggattaatttatggattgatgaaaaccaaccttgaatactttaagtgtgatgtattgcttggctccatttggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaataagtaaaaataacaagaaaattatttttcctctaaacttttccctatccctttcatgcttttgagttttgtcatctctcttgtatgccctggagttctcattttgaaccactctatccattcagttagttgaaaagcttcttataaaataattactaaggcgaaagcttcagtcatagttaattgaatgagagtcgttttacaaatcgaagataaaaattttaaaagaatcgcaatcaaatttaatgaaatttcaaagagcaaaaattcaacaaataataatttgcttttcctatgtttcctctacttagaaaccagaaatttctacttttaaaacaacttcaaccaaaattttaatatatctccatagcgagagatggtcaaataccatttaaaattttatcaattttaaaaataatttcaaaattaaaatttgcagtaatataattatctcctttgtttttaatctaaaattgtttttgccttaagaagtatacctttcaagttagcctctatgtaaggaggtagtcattaaaaaaatctaacgacaactaatggaatggggacagagtagatcaaaacgaaaactcataggtataggcatataaaggagatgataaaacttaggggtatggacagaacagcgcaaagatttcagggcacacaaagaattttctcaaatataacaccgtatggcaggcaatattaattcttgtatgtcaatctatttactagtataacactagaaagagatgactaaaatgaaccaccatatacgctctatcataactacttaaaaaattcgcaactttctgatcgtcacatccatatgtccgtgtcatgcgagcgtcttcccctgtcttcctagcgcagtcagtttccgtggcacatacaccacgcaacaggccgcaagcgatcaagcccataagctgtccgtctgcatcatcctcaaatcttaggttcctccatctcatgcgacgccctatcctattcagtctcatgttcttatcctcgcgacgcacaacatctaaccgaagatccttcaagaagggttctgctgcgtgtatcaatcttcattgcggttatcaaccaagtatgaaaatggaacagctggtaagaaacatgttccgcaagacgtcgtggaaatatgctcaggaaagcaggacatcaacgaacataatttaataaattttaaaaattatctttaaccatatagcaacacacgggccattttcctagtgagcataaatattactacattaatataaaaatagatacacgtagctaattataatgggatcagattataacgggtttgatcaattaatgcaattatatccaaactacaattatgtctatagcaaaacgtgatatgtatgtccaatgcaataatactatttgcaaaaataaatattagtcttgatccatgcaaacgggttcgtttcaagtaaagaactgacctcattacccttctcatgaatgatgtagtatccgttaacgagctctttgcagaccgctgttcctcccattgcaccaacacatttgccctgatgaaccaatcccaagagtatatatgatttgtagatagaaatataaacagatcgatactgcttgcaagccgcttccattgccaaatgcagaggaaagaagcaggaagcaggtcagaagaacgccgacgaagagaactatggccatctcggtggtcaataataataggtggtcgtagtatgattcgaggctttcgatctgtatatataggtgcaacaagcaccggtgttgtgaggaataattgtcgtgtatcttttttacatggaaggtgttttaagaaagaatatgtatctttccttcgaaagaaaagttgttcacgaaagaaaacaaactgtccttaattgactaatatatttatatatgtgtgtatattttttagataatggaaaaaattccagcatttgctttaaagaatatatgtgggtatatagactatagcaaggaaaattatagaagttcggggagctgttactcccttcctatccctttcatggctctaacatgcctcttataaaccaggccaactagctaagtggctgacaatgggaacattttttttaaaaaaaaattaagccaataagaatttttaaaaatttaaatttaaaattaatttaaggatatttttaacgtattttttttcaaaatatgtatatataatttttacttatgaattttggagaaaacatattttttaaagcgtgaagtaaataatccagtgaataagcgaaagggcttataacctagtggttacaagagcctcagtagcacctaagatcctgtgttcgactccccatgggagcgaattttctaggatttaggcgttgtacccgtcgacagcgaggcgtctgtggtaacttcgtcaacgctgtcgtttgtggtaacttcgtcaatctcaaggatttgtcggcccagtgttcgaagatgcatatagagatagggtttgtgtgcgcgcgtttataggagtgagtgcgcttgcgttgttagtatctgtgttgtactgtgtaattctaaaaaaataatctagtgaataagctaaaaagaaggcatttgtaagttgtgacgatgcaaaggaagggagataacgtagaagagagggatgcatgcatgcattgacatccattgatcctgcactatcttatggtcagcttaatatggaatatcttaagtattaagtacaattgtaatgtttaacagtgttacggataagacatatctcctttacgtggatttatagtgtacggagatactacatatctaatattatacggaaaagtatattcaaatatggaaataaaacgagtcaaaaaggaaactactttcatgggaatagaagacttaaaagtctgactcggaaaaggcaaggtcttctcggcctaaaagtctgactcggaaaaggaaaggtctcctcagcccatatcctaatatggttctttaagttctacttggagaagaagacgcccgaccatataaatataccacctcctaggaggagagagcatcgaatcacaaccttaactagacccacattaagatacagccaggaggaagacaagccctaatcattgacatctactcatctagacatactcgacgtatcctagttggcgggttagaatagctaacttgctcccactgtaatcaatatgatactctccacacacacacatactcacatacatatatatattattgtgaaggaaaagaaagattaatgcatcataagtgcggcgcccgatcgccacgtggacattccagatcaatccaaagggatcagacggccacagcaaggaaagtccccactggccattccaaccaagaggtggcggcacatgaagcctgatggtcgccgacgacgaccatccaacacgagagtgggatgcggcgaaggaagctagggagggagaaggagtgcttaccgagcgcatgcgaggtagataggacgaagggagcacgctgatggcgaaggccctcgggttggcgacaatggtagcggtacggttctagtctgcgagcgaggagtagtagttgggtgcctcttcatgctgggcacaagaagaggggttaggggatcttagggtgggtagaaactgcggagaaggacgaccgggggccggtaccgagggcggtgctcaccttgctcaaagaggatggagtttcgattgtatttggcgaaggcaaagaggcaccgaggtacgtggagagctttcgaagccagcggagcaggcagagcagcctgacatggctctaatcgctagcggtagatggctggaggcggcaatcgacagtggtaactcgggctcatggagaaagaggcattctggtggcctctgacttcaaagcaggggacaccagcctacggcgtggcacggctagtcacagctgcaagaggcagctggatgcggcgaagctcacatgacgtggtgaggagaaggttataggcacggggagctcgagcgcgagtaggaaaatgagagagggaggtggaagggccttgatgtggcctagagggggagaggatgaataggttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaattccatcttcagctcagaagcactacacttctaaaaagggggaataatagcaaggctgagtacaaccaccgtgctcagcaagccacaccaacgatgccgacgtgcaaggggatacaaggaggggtttgtggctatttgcagaaaggcagttgtaaaacactttattgagcaaaacagtaaaacggttgggtaattaaagtaatattgaatctccactgatcaacgctacaccacgttgaacaggcccaaccaacccatctgaaccacagtgtattgggtcgatttattaagatgggactaatcacggtgaatctgatcgatcgcccataaccgcgggcacggctattcgaatagttttactctggccagaggtgcacaactgtacccacaagacacaacccaccgacatgtcaccgcgtcatcatgtgcccatgaagcacacgtcaccatgtcgagtgattgtgacgagatccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttacagggtttcccgtgaaccggtccttaattgccatgggtgcgactcacaaaaccatgcacccacagcccaccattcagttgcattttagttggataattacgaccatgaaacatggccagatgtcacgagcacgcagctcaacaagatactaggatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaattcggagttcgaatgaattagatatgaattttagaagttttgagccatttaaatgaatttctagaattaaactcgatttattgcgcaattattatttatttttccaaaggaaaagagggttgctgacgtcatcaacggggaggggcggcgccggcaagcgggccccaccggtcagcggcacaagggcgccggtccaccgtggaccgggaccaccgaggcggttcaccgccggtccacgggaaccgacggcccggatcggcccaaagccgatcggacggccacgaggcggcgcggctgggcacggtcacggctcaaagccggccagccgagtgatggcgcacggcagcgcggccaccggcgacgacggccgacgacggcgcggg

SEQ ID NO: 30466 - DNA, 3188 bp, Oryza sativa
  unsure (1)..(3188): unsure at all n locations
tttgaggatggcattttaacgaaaccacttttgggagtggcattcgagcgaaaccccgttttgacaatggcaaaatgtcaattttgcaatctcgatcaaaatccgcagaccgcgaggccgacacgggagccgcagaccgcgcgatcaaaatccgacggtctccgctgcaatctcgagccggaactcaactccgacccggagaaacaaaccgttggagtccgacacgtaggcgaacgcgcatggacacggcccgtgccgcctataaatataggctgctgcaacgttgcaccgtcgaacaaacaaaagaccaagcgaaaccgcagatttatttcctgatattaagcgaggcatataaaatcaaagggttcgtcaaacccatccgatccgacccctccgccctgccccgtgttgggatggagaacaaaggcagcgagaacgagaggagcctggcgaataatgccgccgctgctgccgccggcgacgtggaagaagagacgacgaagccgttcaggtttgctcccgaagtggagaagtggacggcggcggagaaagaggcgacgctggccttcttccgggcggcgaacgctgaagcggccaagtacatggagatgacggaggaggacgtggtggaggagtaccggcgggcggggaagcttcaccggtatgacccggataaggagtggcagaagcgttatgcccgcgccggcagggcgcacccgccgcccgcttgtgccatatcccgcttgcctcatattcagcaatacctcaaatacctcgaggaagatgatcagaagcaattttccgtgataaactaaatcagtggcgttctttactgatgatctaggtcagtagcgagcctctttgaggcatggtttgtacaatttgtgagaaaaaaatgtcttacagtttgattggcttttcccacgatgtaactgtatatttgtggtgctcctcccttgttatttatatttgatgtttggacaattaaattgaatttgttatagagtctgcaaggctggctttaacataaagcgggattttttttaaccaaccactttttcttagcaacgatttttctacaatgttttagttttttctgtaagagtaaagactattgcattggtgttttagttttttctgtaagagtttttaatgccccgcattcgagtgagaggaggggatagaatagaagactagtgcattgttgtttcagattctagctaaatctctccaatcaaaactcggaacaaacttaatctatgttaattgttaaacaatctgatttgttttaggggtgagcatcatgacgctgggtttattgttgtttcagattctagttgaatcgcagtaatcaaaacttcaatcaaataatatcctagataaaaaaactacacctatgttccgttctatcaaggatgacaaataaattggattcagttaaaccaaatagttcaaacaaaaaaaaactgtcagaaatacattgacggctttaacattgatcacaaatagaccaaaaaaacttatccaattcaaccaatagccgaaatgattcggatagaatagacagaaaagcaactgatatttgagtttcacctaaaaccggttcaatcaaaatacacaaaaaccggttcaatcagaaggcacacacacggtgctaacattagtatcatctagacagaaaaggtagggcatgtttcactatccacaacaatccaaccatttgaactcaatacagtgccaagtgcaacatatctcatacaagctcactatccacaagttcaaagacaagacacacaaacgttcctaactatcatgccaaaacagacaagctcactatccacaagttcaaagacaagagacacagatattccccaactattcctcaactaagacacggatattcttcaactattcctcaactatcattccaagatgatgtagcgaaccacgaaacgtgcattacaatactgcaaaacagacaatagaactatagaagccattaaccaactgtaaaagtactattaacatagagtatagccacaaatcacatctcattatacatcacaacttgttagattaaagtattgccaatatgtagttgctcaaatctaaatcagccacttaaacacgagataagaaaagcttcaatcgactgcgatagttcaggggtaattcagtcgaccgcgatagttcaggggggtaattcgtacttttttctttaaacaaaaaagaggttgttggtatcgttcttcagtattaggattaatgtgccttctcaggatttttattgcgaataacattacttgaaacatactccctctgtactcgtaaaggaagtcgttttggacagcgacacggtctccaaaacacatctttaacttcttgcttctataaaaaaaattattaaaaagcgatatatgtatacttttatgaaagtattttttaatacaaatctattcatataatctttatattttcaaactcaacaacttgagagttattcatgatttatattctcaagatttaacttaaacattatcctaaacgattttttttatgagtacggaaggagtatgtataacactcttttgtgactcaataaattcaacttcttgttccctttttttttcttttctcggcagcagacgaaattcttcttaggtaacatttcaacaccaaaagttgtaaaggaaaatgatcaacaggaacacatgcatgtaccatctggattcttcactagttcattgcattggtgacagcaagcagtagctaaaaatcgacccttgtgtcctgtgatgagggtacgtacgtatctgggacggaggcagtgactttggcaaccatggcctggcggtggcacagctagcatcgacggtgatcgaacaggcgaagtccgaccgaagggcacgcacgcacgcagacatagaattaaatttgaaaatatactttgtttcttagaaatattcgtgatacaaactttttagcagaaatataacgtcgatcttgcacaatcgttatgcgaaatgacgagagcgtgacgacacacgcagtgtcgcgcggtgggagcgcgagaccgtgcgaaatcncgatatgaaacagcaagagaaaacggtctcgcgtaaggaattagcgagaccgaatnnnnnnnnnnnnnnnnnnnnnnnnnnnnnnnnnnnnnnnnnnnnnnn

SEQ ID NO: 30467 - DNA, 5689 bp, Oryza sativa
  unsure (1)..(5689): unsure at all n locations
gtaaggaattagcgagaccgaatgtcttgtccatcattgccgattaattagtgattaattactctaattaatgattaaataatatttaatcattaattagagtaattaatcactaattaaccattttcaacagtcgctttcgcccggtgagcgagcgagactgcttggtctcgcggtttggccgcgcgagaccgtgtggtctgacgccgccaccacgtacgtcctcgattttgtcattcatagtgtcgcagtttcatcgtgcgagactgtgcggtctcgccctattaccgcgcgacaccgtgtggtctcgcgctgtcgttgtgcgagaccgttcgcgtcgtcacgtccacgtcactttcgcgaaacggttgtgcgagatcgagggtatatttctgctaataaatttacatcccgaatatttgtgagaaaaaaacgaatcaacagtatattttcaaatttaattccgcagccatagagcaacgaagatcgataagggtccctttgaatcacatcaatgaaaaaacagaggaataggaaaaacatagaattctaataagaatgtaagtgtaaaacagaggattacaaaacacagaaaaaatataggaataaccgtttgattagaccacaagaaattgatgagagataaagactcaaaggatttcttccatgaggttctacctcttattaaaatttctccaaaacttatatgggaagaggtattccatacgaatttcatatgattccatagggttcattcctttgattcaaaaagctttgtaggacaaatttccttcgcccctccatgggtcaccccgccgttccacggtctctgatcccctgtcaacaccaattgcttttcgattttggcccactctgatccgtttgattctggtttgtgttgcataatttctctttcttgcatttcagtaataaccgttgtaaatctataatctcgattctggttctattgcaagctatggccagtatttgtttatgagtgtaccaatagattagagctaattcatgtggtgccaatcgtctctacttagaatttttttttaccaggatatggattttggggaagaaataatgtcgattaaccattgcttttctgtttattttaaacaaccttttgctattaataactgcgctgatgcaatgggatttcaagttggattgcttaaacagtatgcttctcatataattaacatgttttacacctcttatacgcttcactagcgtatggacctaaaggtgcttagccaagcaatttatctccaggaaggaaacgaaattcaggatgatagttggtgcatatgacatggagttgttggatatataatttaggaattgttgcaaaaattgctatttactttcgttgttcgtacatctctagcttgtctaactgtatatactcgagatctattgctgaattctgtcaactgcttgttctactttttcagaggtcttgcaatttaaatgctcacagtatttggtaacatggtgccctcactatgctgcataacttctgtctctgcatcactatccagttgttgcagttccatttgaggtaagtttggaactgcttaaaagcatttaattcattctttagttcactggaaatagtcactctaaataacaccatatgtataaggaccaactgttatcaaggaaatttaactttcaaattgaagaaaatgtataggatgcaaaacatcatatacgatggattggttgttagtggtatttaacctcagtttcttatggtaatacaatatgtaacactacctattttatcaacctttgttttcaagtgcttgttttcagacaattgtttaatatcatggggagctaaataacatttattactaatcacccccaagcaaatgtattgccaagggcgctatatagcttagccattgccttaattaatttatggcctgcttgcctggaaaatctgaaatgaagatctgtgatatgtagagatgtcaccacgaaagaaatgaggtagttcttagatgtttggtatctttagtcttcagtgatatggtattcttctagatacttgttaatcaacaaaagaagtgcattcaacagttttagactttatattaagacatgttcaagttttcctcttttatgatattactttccaatctccgttgtgctaaacatcactaaaaacaagtccccatagacattgtccttcactctaaatatgggtgcttgctgctgcaggatcttgggagatgccagatgtctttatgggagccaagtagccaaccataccatgtttgattatgacaacctgaaggttggcttcccagaggcggcataaggccccatggtgatcagatgagccggagagtccttagtttttcagcatgtatgtatatatttttcatgctcaattataatgcttgggtgatcaggacctgtctgttttaaactttagtttggctatgctaaacatgaactaggcagaattcagataacagtctatcataggaaataagcaataataaaacaaatcggtagcagtatgtatatgttggtacttgattgcttggctgtgttcataattgaaaagctgtattctttttaaaacaagtagtttatgcttacaggctttttcaaggaatttgagctacttattacagctgatgtgctgccttcttatatgttatgttcagtccacacgatggatagctcactaacattaagcagaaatgcccctttcatgagaaaaagaaaagttatatggccatatgtctttgcaataaataattgacaccggactgttggtgtaggttgtatttgataggaaccatcctgtttagcaggttgaaaatatctgatactgtgttagtcattcctaggctgaaatcattggcaaataccctgtcaacaccatgctggggcttattttaccgagccacattatttcccaccttcagtgatccaattgtcaagtactcaagttgaattatcgatgcttaaagataggcttatacacgatgtaacattgttttcagtggcaggtaagcattaagaagctatgacaatagaaatatgtggtttgggaagcacagttagttagacatgtggctcagggcatagagtagtggactacaaattttataggagtctattttccatatatcagaatatacaatgttgaaaattgaacatatacatgttctggtttattcgatatgcatattaacaatatggtaaactttgacactgctaattctaggaggttactcaaattttgaatggcaaattcgagcacagcttatatatcctggagatacatgtttgtcaagtgacttgcgttcttgctgttggctgcttcattgttctgcggtataactcagtatggagcaaatttgcacttatttatattcagatatattgttaatttatttttcatttgttgcagtacattgccaatattaaatgataaattgagttctctacatatatacagttgcagcattcatttttcacatcattgttgttagaaattagtttgatactttgattcttgctgtagaaattcaagatttgagaagctcgccatgtaggacaaataacttcaaagttccaaatacagcatactaaaatgtatgtgtcaaaaagcaagtttccccagcagtatggtacataaacactgggctatgtagagtcccgctcttcagggctatatatataacaaaattaaattggactgtccatttaaacatgaataaaaaaaatcctaaaataaactaattattgaacgcacgcatacaaaaagggttcatgtcccaaaataaactattttatcacatcacgcgaaaaaaggtgatgtgacatgaatcacattatagtgctttataatgggcggcttcaacatgaatacaaacaaatcctaaaataaaatatttatcaaacgcgtggcaaaaaacaaaagatatgtgtgacattatcctaaaataaaatattttatcacatacccaccaaaaaaatatctgagcataacatcaaacgtgtggcaaaaaaaaattaaaagagatgcgtgacactatcgtgtatgctgtttcacttcctatatctatcatccgattttttttaacagcactaccattccagtgacccagattgaatggcggatgaagcgcccgagcgagcatcgtttctcctagcgccctgatctgagtactctcccataaaaaatccatctgagctctgcatataacctttcttttatatattcattcatatcacatcatctcccagtttgaaaaatatattttgttagacaaataaaattgcaccgtagcgtttagcagggcatattactagtgctagggtaggagtagggaggcgggaaaattggtgctggtcattggccctccaaccgcgcgattcccgcgcccaaattccttgcctcctcccccaattgccccaaaccctagcaaggtggagggatctggaaccttctgaaaacgggagcaggagctcgcgccaagcaccaccccccatggcggccaccgcggactaggcgctgctcgacctgatcccccaaatccactccctcttcgctgatccgctctaagtggtgagtcacaacggaatgcgaggctctaccgcattagggattaaggttggggtcgagatgatttcttggtttctcgtgcgcttcgaattcttgttcttgccggctcattttggtacttggggcgcgcatgggttagggttgtgttttgttcgaggtgtaccttagggttgataagttttgttttggacattaatgttcatattgcgttaagcttagaaaaacaaaaaaagaaacaagaaacaaatgtgccagttcatggtggatttgatatctttgttgatggttcggtgcccattcatgatatcatgtatatggagtaacaatgtttccagttttccatgacaaacttagatttattccaatcttttgtgggaggattaacattgcatcagccttttgttgtcaaattcaacaggaactggccaagtttgttcagcttgggatggtggagtttccaatcagattgttgtatgtcatgagtttatttacataatgattaaacgagtgtgatactgcagctccacatgaccataggatgaaccacttgcctgtcctttctcgtaatattcttgttacttgtttagtggttgattcattgaaattgtttgagttgttggatttgtttaccttggcagactgtttcaacaatcgatatgtgtgtttttgacagatttcatataaatggctcagcaagaacttctctgtatcatccaatgattccaagaggtaaaggttccctttttatggatatttcccttgatcattggatgaaacatcctgacctgtcatgaccggcaatggtgacactgagaaagaggtttaactgtgaatgatagtgtgtgtgttttgggctagactttatcaaatataatgcggcctgcgtgccttaaatcgtttgggccaatggcccatgtaatcaggagataaatactcaagagagagaatggctgtggccaacctggcaaaagaaatcgaatctatctctctccaaactaaatctctcctctgcctcagctctgttnnnnnnnnnnnnnnnnnnnnnnnnnnnnnnnnnnnnnnnnnnnnnnnnnnnnnnnnnnnnnn

SEQ ID NO: 30468 - DNA, 697 bp, Oryza sativa
  unsure (1)..(697): unsure at all n locations
cgacatattgttcagagatgcaacagaaaaaaaatacaggcattccgaattaaactcacaaaatctagtgtttcatggtaatttagtggcatccatctgatgtagctaaatcatacaacttatatagagcgcaaagggaacaaagcaatcggagaggcggcactcacttggcgacgacctggtgatcatgaccgaaccgctcggccgcgcccttgacgacgtcgggggacaagacgtgcggcgccaccgacaagtcaggccccgggaggtacccgccgtcgtagaacctccggagcagcgccgccgcctccttcccccacggttgcctcgacctcggcctcggcctcgccctcggcttcctccgctcctgcggtggcccatccccgggctccggccgcggggcgcgaggcttcggagagcttcgaagcgcgaaaaaggaaaagagcgtcccangccgcgcggcggtcccgccggcggcggaggagagcccgccagcggcggaaagtgccatgggttgagagggttcgggtgacggagacggggaagaaatctggtgtgatctgaacccgccgatcaaaaaccgtatggccttatttggatgggcctagatcgaagcccatgtacacgaatgggcccgtatactgaaactccaggccattcacgtagatgggcccgtatttttgtactagcctaatgc

SEQ ID NO: 30469 - DNA, 30530 bp, Oryza sativa
catgatcgtcctcctcttcaaggtcgtcgaggaatttgaggtattgttgtatctcaggcacacaaagccaggagggaagcgggcggggggtgagccctggcgacacgcgcgtaacgaatctgccactccttgcccggatcatacttgtgcagcttccctgcccgccggtactcctccaccatatcctgccacgtcatcttcgtgtaccgcaaggcgtccgccaccgccgcctggaggaaggcctgccccgctgctcgctccgcggccgaagacggcctccacttcttctcccgcgcaggctccacttcttccttctccatcccgatcgagtttaatctggttgctttccgctggaaatccgcagatacggtacgtgtggcttgggtcttcttcttcttggtagatttatagttcgtacgcgttcgcctacgtctcggactccaactgttcgtttttccgggtcggagttgagttccggttacgcgagatagcagcggagaccctccgcgcggctcaacgctggggttcggcgctgcacgccatgtccgacacggattcatcggcggcggcggcggcggagggtcggaagccgtcgcctgctacgtcgcctcctccggcgaggtaagcgattcgatctctgcccgtgcttgggtctttcttccaggggaaggcgaggcttcgcgtcccgcttgtcacttgagacttcctatgtcgcgcccttctttctttttctacatgcaacgaggcctcatcgaggcacgatgatttgaggcttcgagcctgagcacgaggagatatcatcgattggatggagcgaatgctagcggtgcgaaacagtgtgaaaagtaacagtcgtttgtctaaaaaatgctgtatgaagagtagccaaatttttttttagataatgatgaagagtagccaaatgggtcgcgtatatattatgtcattaatctcattcttaatggaatcatctgagagtgatctacgagtactacaagcttcatgcggtgactctgaactgggattaccgtttcatttgcaagtggtgtctcctgctgaagtagaaattttcagtagatcagtgtttgtaaagcttaatagtcaccacttgcaaaggtagcataagctgcacaagtatgacccggacaatcgccagggctcagtggctcacccctcgcctgattccctcattgcccgtaagccccggatgaaagaatactttaagtatctagacgaggaggatgaacaagatttttaaatttgcatgtttttagtttatttctatcataatgttatgtttcttcttgtttttaataaaaacgagctcaggttttgttctgcttagtacgttgagtttacctgtcctgttggtcgattcttgtaccttttgttttgtttttcctcgattacttgagtattataaaccacaatgaaactcaagctttatatgacatgtacaagtaaaatcagcagcaaatcatactagtgcatgtgtatgcggctttatgtattaggccgtgtttagttgttttggcactaaatttttgacgtataagggcacacatttgaagtattaaatgtagactaataacaaaacaaattaagattccgcctataaactgcgagacgaatctattaagcctaattaatccatcattagcaaatgtttactgtagcaccacattgtcaaatcatggcgtaattaggatcaacagattcgtctcgcaatttacatttaatggcacatacatgtgtccaaacatttgatgtgaaggaaaaattggaagtttgaagggaactaaacacagctttattatgctagcaaaagatcgattttcactgacaagatcaatcgttttataatcttaggggctgttaacagtgaaatttggtaagcccggagtagtcaccggcttatagtcagcatcagcttcgaagtcctgagattagccgatgagagttgtcaagtcgtcagttgtcggattcttgctatattcggttaaggaaattgatctactaaaggaagcttatccggaagagaccgagttcaaagaggatgcggcatggcaagttatctatttattaggaatagtttgttagtttccttttatctttaggaaagtgtgtttagtgtcctataaggactttatctttttcttttatctataggaaagtttctttcttgtccaacaaggacttgtatcaacccatgggtataaatatgtacacccggggtctatgtaattaatctcatgatcaatacaattcggcgcatcgccaccttttaccttttctactttatgttatcgtccggcgggacttggcacctgacgcggggctgcatcggtgttcgatctccggcgaaggggtaagttcaatgttctgtcggcccaggcaattgtatcgtttacgtcggcgtcattcaaggctgcatcagtacattcgacctcttggattgctctggtttagataatatatttgcctacatatttatcatatgtctctgttaatctagttttagcatatcaatttagctctatcggctgcttctcgttttagggtttctgccggtatcggctaaatcgcgttgctatattagattagcttagacatctaccaccctgaaaactcagtcaacggcttgattgtctagatattatgtttcttttcatacttagtgctgcatcagttaagtttgatctactaagtcgtgcttagaaccataatctctagcctgcttcttgattgccaataagggtttcatcggggtttcagccggtgagttatctggacgttgcatctgctcataaggattgcatatacatataagttggattagccgatgacaacaaaggttttactgtttaatctaatcttgtggatttcattccagccgatgtatgatttaaccttcagatcgatgcttatctatcatatcattattagccgattggtttatactggattatattgttattttgttacatcatcatcagccgattgcctttatatcattatctgcattggacatatagccgattgattaaaccctatcgctatcggcaggtatcggcatcgtctattatcggctatcggctggaactactccatcggcttgttagccgatcggctatttgatctattgtttacatatcttgtcagttgcaggatcaaactgactggcacgcctgtatgtcatcatatttggacctgcactggagctaagcagatctcccaagccggtgtgttcgattttttcgtcaacaggggccaggcaagttaaaaaaaaaaagaggcactacactgttagcacatatataatagaaaaaagttttgtttccaaatagaaatgaaagattaacattaacacatcattaaacatgagctattttagacaataaaattgctgattgaacagtaaactgtagtagcataaaaataattcatcaaagtatataatagatgatatggctcctaaaaataaaaaaaacacgccttctgttgaatattagcgcaaattgtgcaatgctacaaatggagtaaataagacataaagattatgttgtagtgatactaagagcaagtttaatggtatagccaactactagctccaaataatctataatcgatttaatggcaagtttaaacaatagttacctataaacatatactacactagtataatacctagtcccacttgtcatatatacattgcgtcttgcagtttgtgttgcagctggctacaaatctgtagcccgctgctcttctctctcttcatttatctcctcgatatgtgtttacaactggtttacaatctgctattgtacctgctctaaggctgttttcgttcctccaacttcctaactcactcccccgcgttttccgtgcgcaagcttcccaaacggttaaacggtgtgttttttgcaaaaaaattttacacaaaagttgcttttaaaaatcatattaatcctgtgttttttaaaaagctaatacttaattaattatgcgctaatgagttagtccgttttacgtgcactgcacattagttcccaactagcgggaacgaacttagcctagttggctaattacgcattaacatctcataagaagtcataatctaaaatcaataactcttctaaccatacgaattttctcgttttctttatggaattttttttctcctcagagagaataagcgtggttggctatttttgcaaaaaactactcgtgtttatagaaaatatcacagagatccttaaaccgactaacaacccgtcatgttttatcctgaaaacaccttgtctttcagtgaaatacaatgtgaaaaagagaaaattccgcttcaaagagtagcgctgtaaacatgataagtgtagaggtttttatgtaaaacatccatcccctacccccaatccccaaaccctcccggcctcccccaacgcttcgggaggaattaacgagacagcttcgacggtgttgattttacgtaagcagtggacagtggtgcaaaagtatggactgtaacggacttccgatgcatctctggctggagttaattaacatgctttcagcttctactagccacgtaagccacgcgttgcgtggctcttttaagacccgttcgaaagatatgtaaaaatatgtatatatgggtgaggccaacagtgccccgttattgagttctcgttgatgggcaaaattttaaaggttcggtaaaaaaacaaaagatatatatttatgacaaaagagagtgcattattatatgataaataaatactaacttgtttctctatctattctaaaatatatatggcattcttattttgaggaaaatcaaaacttaaaaatttgactaatgaatggactaaaagtataggagtatatgattagtgctatgtatgtcgatttttatttgatttttatatcactatatgataagggactatgataagggagtgtcgtcaggtttctatttaaatctttttatgtaacgttgatttcgtagttatcgataataaacgaaagaaattagtagtagttaaagtataatgttaaaatttccctaaaaaaagtataatgttaaaagattgtgtaaaaaggtaacactatatctaagtgcattttagaataaagggagtaattagtacatatgcatataagtacttaactaaattatttaaaagaatacttgctacactatttacatatgcatattaaaacacacatcctgcctatagcctttttctctgcatttaacaggtcacatatgtacaagacatgctgatgatggatgcagtacgggctgtttgaggttttatcaatttttgtcatgccaaattttggtaagctaaagttgtatttgaatcgaaatcaaaataacctaagttaactattgaaatggccttttttttaagacatgctaaaatttagtttcaaactaaataaacactaaatattattaaaattataaaaattagtaagatcaatttagacctcaaaccaatccagccctacacgttttcctacagtcaaaataaaaattaatcgtccagtcctcatcgttatcgtccctactcatttcttcattgtttcccttttgcatctgactctgggttctgggatacacagaccaaccacgactccacgagtaggaccgcatcttgtccccctcgtctctgctataggtagcctgtagctcgacctttgccaccgtggatttgcgctgaaaaggaggagaatgtctgaaggatgaggctggcttcactgaggagtgaggagtgatctcctcaacctagccccctttcgtcgatcttttctaaagatgagttttcggcggccagcagcatggcaacgcatcgagggcttctatcttgtgctgcctgcactgacttggtctcaatagggagatggtgagttggtgtggtgaagatcaaggaagcgttgcgtttttttttcgtcaattttctcaattctcttctgctagttgcatagttctcctattgaagaactgtactacgtatcgaatttgacaaaaactctagatccttctgtcagaagcttctagaagagtccacttctccttgcgtcggcaatggtttgctaggacactgtattcagcggtgacggtggccggtgggagaagagattgggaggaatggccggtgggagctagcgcctagcggcaaggacgggagtgacggggagatgggggaagcttcctgaagcctctcctttgcttgactgagagatgggagcgacagtggtattttactgagcctgagggtctgtttggttccattgcccagctagcctagctgggtaagggcaagccaactcgttgccagcttgccaggctcgccatataccctttgtttgattggtgtgctttctatggcaagaattagtggctagccgtttggttgcttcaacgaatcatcttgctctttagagtattttgtgccgcttcttttcatattgagcaaaataatattgcacacagatcaaatttttttaactgatggctttgtcacaagaacactacagattcttccacagttaacttggccacaagaataatacggatagaagtagtaaaaagggcaaagctatatgctaaaagaattcctggaaacaatcaaacatctttgtgaactactttattacaagttcgaaccaaagcatatcaattatttaaataatatctaaagtgcacgtttcattcttaaactatttagcttgaatgcatagtaattattcaaacatctcagcaaagaaattacatagcagctggatagttttgtattatccattgggccacatattccttaatagaatctaatggcctacccttcaacatggcagctatattctcatgggtcgcgagataagtttgcagctcaagtcgaaccatgacagggtattccgtcatctcatcaattatcttgaatagggattcatttggatgtgtcatatgtgtgaaacacatggtttcagacatattatccatagcccctgttatctcataaaccacattatcatcagttctaactcttttacctttatcagattttctaccttttgcacgcctagaagatgagctacttccagtattattctcttgatctggaagacaatctgagtcataatttgatgaagggtcaacatcaccaggactgccatttttatcaccaataaaatcatcatcttcagtcattggatggtcatatggtgtttgcagaacattaaattcccctgttgcatgcttgtcttgaaaaataaactccatttcatcataccaacgtatggggacgttaatgaatttagcccttttatctttggcctacacatgacaagaaaaatgtcagaaacatagacatccatattatatgtaaacacgatagttatttgcaaggaaagaatagttagaacactcacattagtcattcgaacaacttcagtctcatcatataggattttttttctcaacatcatcaaagttggccccgctcaaattctttgcctccataatcaccttccactgagccttcaacttgtgataaacttgtcgacttgtgaagtttgtgtgatacttgccattaatttgctttgcacattcctcatgatagacttctttaaatacaagttgtcttccatcatgcttggtgccgacggccagaaagttcctagctactactgcccataccatcgacaatctccattaatgcaaaatcagaatccagcaccaaaggcccaaagcaagattactggatgtggaaatagtacatgaagcaacatagacagctcgtatacatccatccatggcaggaagatggagagatttaatataagaaaaaagtcctcgtacctgcaaatctagatagacgaggcaccatcggcggaagaaatcaaatttgggagcttctcagttctcaccacgagcaatcttgtgtccagtagcaatcttctgcaagaacatgctctcctcaaatcgagttggccttgctctccgatttactgcgtggaggccggaggctctactgcatttatatatgggcacgggattactgcagatgaatcgaggatgcttgaaagttcagcaaggggaggaggatgattgcaaattgactggatctgtgagccctatagttcagccaagagtgggggaagagagcgacgagatctgcaagcctgattctttggcgaagagtggaggaggaggacgaaattggggggctggttgttgaagaaggtaacaacttttgaaaaaaatcgcttcatccttatcaacaacttttttcacgcgaggagcttgccatcggaggcgagccgattcggctctcccttgtgagctagccttttctcgctcctatgggctagctcgcccccatgggctaggattttttttctgattccaaacgactgtccttgccaggccaggctaggcccctgctagccttggatccaaacgcaccctgagcctcctttactctgactcatccagatccaatggcttggaataaatcttcctttcatcagatggtcagtatttacttgatgacgtggcgcaatgtggtgaggaaaaactttagtattttcactactttagatacataatctgttgcctgtgataattagcaagcaacttcgttgtacaagctacccaacatatacatggctcagggcaccagggcggtcgcactgcccgtcctaccccaggaccagaccagaactgttcatgagtggtcgacgacggtcgagatgcgatggaaagtatggagacgataacctccacaagagtgtgcatgtagtgtctgaggcaaccgatgcgagtgtacatgtggctgaagtgtgcctgcgtcgcccgccgtgtgccagagtaggctggtggaggccgaggagaagtcgcgtggccatagaggattttgaacttgattaaataaaacatgtctttgtcttaataaaaaccaaagagaacaaaccataaatgtatttgagaaaactgaataagccttaaaaaagcacaattacttctaatattgttcattctgcccaattacttctactcttattcatcatcctcatcaagcccaattattttttatcttattcatcatcctcattaagaagcttgaggtaatcttgttcatcatcctcatcgaggagcttgaggtattgttccaacttaggtatgagggccatgacgcagggaggcggggggtgagccctagcgacacgggcatatcgcttctgccactccgtatccggatcatacctgtgcagcttccccgcccgtcggtactcctccaccacctcctcctccgtcatctccatgtactggtgcgcgtccgcgatcaacgcccgcaagaaggctttcgccgcttcctgttccgcagccgtccacttctccaagtaagcgtctatcccgaacggcttcttctcctgccgaggctgtttctcctcctccttcgcgtcgccgacggcggaattctccaccggcgtctcgccgtctttgcgctccatcgatctcaaaatcgaggatttggatggaggattacgctagtttttttttaggaaaaaattaggggacggtttggctttgggtcttggttgattgatttatttataggcgcggtctccgcctttccctgtacgcgttggcctacgagtcggactatgtttgtccgggtcggagttgagttccggctcgagatagcagcggagaccgtcggattttgatcgcacggtctgcggctccgtgtcggcctcgctggggttcagcgctgcgacgccatgtccgagacggattcatcggcggcggcggcggagggtcggaagccgaggcggctgcgggggcacaagaagggcgccgtcacctgctgcgtcgcctcctcctcccgcccgggcgtcgtcgcctcctccggcgaggtaagcgattctgctcgtgcgtgggtctttcttccgaggggaaggcgcgcgacgccatccagggccttgcgacttcctctgccggagcaacgcgtggcctctctggtgggagacaccttgctgcagcagcagcaggaggaggaggagaggggtgcccttcgctgaggacaacggtcgaacacctcgtgggcgctgtctgctgagctagtggcacaatcttgtaggctcgcatcgcatgcttcctcccctgcgatgcagaaatctgcagccatgactattggcagccaaattcattgccggaggctttagatggctgcttgtgcgttagcgggggcggttgagctggttcataaggcactagtaggcaatagtcatgtggccgatctatagaggtcttgcatctctgacggcaaactgagataatcattccactgctgtgtacaataatgcactggtaactttgtgaaagtagcaacctgcataaccatagattagtatccagttccctatttcaccttgtccttgctgcttcctgatggcacttgagttcactaattcagtaccaattgtcccaccataactttcccagcatgaagatgttgtagagatctcatctaggatttcatatacgatcggtaaaaactacaaaattggcactaggtacatgcaagaacgttatgaattgctatgaacttggtgaatgtgcatccgtttgctgatatcatcttacagccagtaggtgttttcttcttttagggcatttccctttttctgcaaagttacaattctaaccgtgtgtcgcactaccttgagaatatgattcataattcttgacccttcttatttgaccacattaggatggatgtctttgctggtttgatttgcgtacgaaggatgtgcttttcaccatggaggcgacaaatcaaccaatttcttctgtgtgtttcaaagcaggtcagcatgccctccgttgtccaaaccactccagagttttgtcccaaaaatatgtggggcgtgccaatgtcacacactaaaatgtcctctcttttggtaggaaatgaagatcttgtgtatgcctctgctggaaatgaaattttatctttcgatgttcgaatggtaagttcagcatccctatttttattatgtgcttaacttggtttctctcttgtaatatggttaccatgattcttttttcttattagggacctcaagcaaagccattggacacttataactacaatagagatgaaatcaatcaggtaccctggagtatattgccatctcattctctatgaaaagatcactatttcatcctgaaatgatgctttcactttatggatgttctcttattattttacctaaagcttttatgcaaatgcgattggattaaaaagagaatctaaaaggccacatttgatgcagattgctgtgagctctaaaggttttcttgctgctgcagatgacagtggggatgtcaaggtaaaatattgtgttgacataaatgttgaagacaagcatgcttctattatcttaaaacatattaagtgatcaaaatattggtagtgctgtttagacttagaggacttcacttgaaaatgttgaaagagttggcaaatctgtaagcaatgcagtttaccattaaatttaagtaaatgaacattgactgtaaatatttatgttgcagtttttctagtttttcaattattaacaagttatatagctagagaatttatggtgatattttcacactacttgcttcatttaattggtttgttgttagaaagttttcttgttgagattttctgattttgtgtgcttgtgtatcatttagataaaataatagtttttgaattggaaatagatttctgaactaccttgctttggtgcaatagaaggttattccaagtcagaacttgctcatgttttcactcttagagaaattctgcttttgcttttgcagattatcaacaccatccaaaaaagcctgtacaaaagattgagggaagcccacacaagtgtatccttatgtagtgctactgggatgtttaactctgatgtttcatctttttatgatcctagtattttttttttaatttccctgcaacatgtaaatcagttatcccttagttatctttataagatttgcagcagtgtacaattcattccttggagaccttggacaggtcagtgctacttcatgcttcattgtttgacttatacttttcttttgtcaacttgtaagatgcaaatactagctattctccttggattcttttattttaatttgtaatttttttatcctcacaattagttcagtttcatctaacagctattactggaggccttgattcaaagcttgctgtgtgggatttctccaaagggcgaacactgttttctatagattatggtacctcctttttccttgaatgaaaaacttacaatccatgcattgcaccaacttctatgtatgtgtttaccttttgacagggtcatatactaacaattcctagtgaatcttgtatggttactttaatgggttcacatctttaagattaaatgggaaagttgggttttgctgattaaccacaatgctgtatattcccttcttttcgcataaattttctccagcatgcattgattaacttttttttttttttgctcttggacgtcaggatcacctgaaatgcagaatggaagttcaggtgggcaatgtttcaatcctccttttgttcactcaatagcagtttctgaagagggcatcttgggagggtcgtacaaagtttgtgctgttgcaagaggagatggtgctgttgatgtggttgatctagaatatgaacttgcccctgcaaaatcaaaagggcttcctcggatggcagatttgagtttaagctcgaaaagaactgatttaggagatggatgtggtagtcaaagtcaagggaacaggatccaccttgattacacagtgggtggtcatacttcatctgtttcttgcgtgtaagtcccactatgttgtttctctgtaatttcttacatatcttacccttttactaactgcttaatactttaacagtacattttcagcatttggcgagaaggggaagtttcttgtttctggtggcaatgattcatcaattaaattatgggattggtccaaagggttctcctctgaaacaaacaacagtgctgaattggtgttggatataaaggttaataaaaaggtagccactcaaccttaaattctgtgaaatgttgtctgcagactttggctatctatctgcacataatactccattacttgatgtactactagatagtaattttgctgttaacggatgtgactgaattcttaggattgggtaaaattgctaacctttgatctacatcttgacaggtgaactggttgtgtactactccgactgattcagataacctgattgtgtgtgacacatccaaggtggtcaaagtttacaatctaccttagactgacaatgtgcggcattatcaatgcccaagagcagccctgtaccagtcgatgggacaatttcttgaggacatttagcacaaaattgtgtgcccgaccatcagtgtcagcttggtcctgactagtcttttgacaatgatgaagctaggcccactgcagcaagttgtgtgacgtgagaaatcaagattgttagttctctgcagctagttgtgtgaagtgagagttcaagattgttaatacggtgaaatgaacgtatgttctctaagagtcagcgtgtttttgtgcttgcaaccagcttccttgtactaatggcgaaatccatttatgttttgtgttattttagctgttctttcttacaaagacaataccacaatgatgtagcgcatcatcttcaattcttcctcatgtaatgtaacgagtaaatcatagtcaatattcaagcttacatggtgctatatgtagcacatatgtacgctactatgaacaaaactatgcctgagtaatgaaacatgtttttttttttttttttttgctcaccaataacctctgcaagaacacctaccttcttcaaaatggtgaaatctatttgaatccctcaaaattatctctctaccacacatcttggagatgaacttggcagcctcatggcaatggctgcaaactcttgaattcttggtcacacggattggccgcccttgtgacagattcagaacaccgaatgccacggcgagctttgaactatgcccacagagcgcctcatcatgaacagcatcgtcagcgcccatcagagcatattttttcttaggatcatggccttcttcctgcatcctcctggcaacatcatccaggaactctgcaatcctcattccttgtggatgatttcggttttccgcgaagaagatatgggcctttcctctcacttcaatccagctgcagccagtgttctcacggagcccacggccaccaaccttgttcttgagcttcctgacagcctcccatctctcagcttcagcatagatgttggcaagaagaacatagtaccctgtgttctcaggttccagctcaaagaccatctctgctaccttctctgcaagcttgacattcctgtgaattcgacatccacgaagcaatgagacccagatgctcgaatccggttcgatcggcattgtctctatgaactcataagcttccttcagattcccagtgtggcatagtagatcgaccatgcaggcgtagtgcttcagtttaggctctattctgtgctcattccgcattgcattgaagaatctccatccctcatctcttaggcctgaatggctacaagcatacagaatggcactgaaagaaccggcatcaggctgaatgccacttcccttcatctgctcaaagagggcaatggcatctctaccgcgaccatgcatgccatatccagctatcatgatggtccatgagataaggttcttgttggttaacatgtcaaacaaacggcgtgctagcagtaatgcaccacatttaacatacatgtcgacgagtgcattggctacaaaattatcttccaagtaccctctccgtactgcgtaggcatgcatctccctgcctcgctccagcgatgaaaggcttgctgcagctggaaggatgcaggccatggttaccgcattaggtcggagttggagtagcatttcattgaataaggtgaaggcttcattggcaagattgctcctggagtaacctcctattagtgtattccatgagattgtatccttttttgtcacatgatcgaaaataaatcttgcctcttccatatacccacatttcacatacatttccatcagtgcattagcaactggaagaacttcctcaattccatttctgatggcatatccatggacagatttcccatgtttcagtgattcgttgccagcaaatgcatcaagagcactggtgattgcgaagacatctggtctgataccttctaatcccatttcctgaaataacccagccactttgtcaaaatgcccagccctggtataacttgtgatcattgctgtccatgacaccacatttttctgttccatattcctgaatatcttattagtgctacgccaatctgagcaatttgaatacatatcaagaagagcattaccaagagatgtctcactaatcaatccagttctcacagaatacccatgaaccactcctcctataaatgaatagtgcgactgtacacaagccggcataacacttagcagtgtagtagagtccagctcctgtccttctaaccacattcttacaaacaactcaacagctttatcatatagaccattggaagcacatccaccaattatagaattccaagaaatgatgtcacgttgaggcatttcatcaaacaccatgagtgcgtcttcaatcctgttggattttgcatagaatgatatcagtgcattgcaaactgcacactgtgccccaaaaccgtacttcacaagatacccatgaaccaccaaaccatccattacaccagacaaaccagtgatacactttaggaggcaagaaatggtatgctcatcaggagtaattccacagtcatgcattttctcaaacagcaagaggctttcttgaaatttaccaagcttcgcatacccacccatcattagattccatgcatgtaaattgcttttcgatgacattgcatcaaaaaccttccttgcatagcccaattcaccacatttaacatacatgaacaccagtttggatcccagattttcatctatcccattctccaaagattcaaattcccaaagtagtccggttttaactgagtatccatgaagcacccttccgacaagattgtatcctaattcagcacaagcaggcaaaacgccaagcatcgtcactggattgatctcgaggccttcagaccacattttggcgaaaagctcaatagacttaccatgccatccattcgaaaagcacccgctaatcacagaattccaagaaatgacatcccggtgaggcatcccatcaaacacctgtagtgaaccatcaacatggccacacctagagtacagtgctataagcgcatttccaaccgcacattgcacccccaaacccaacttctcaaggtacccatgaactacttcaccatctgcaatactgcccaaaccggcaatgcatttcaagacacacgaaatagcatgtgcatccggcctaaccccagaacagtgcatctgcctaaacagcaaaacgccgtcttggaactcaccagctttcgcgtaaccgctcatcagtgaagtccaaactcgcacgtcactcacttgaggcatttcatcaaacaccttccttgcattctccaaatccccacatttcacatacatcagcaccaatttccttccgagaacactatccattccatcttttccaacaccagatgcgcgaaccaagaaatgggctctcttcccggcctccaaagatctcagatccgagcagagctggacgaccgcgccgtagctccgggcgtcgacgccatccgagccgagcaacctcaacgcctcctctaactcacccgcccgacagagcctctcaatctgcacgtccacatcggttctcggtgcccgactccgcgaattcttggcgcccctcggagcagaggccgcctccaggatatgaccggacgccgcgaggacgtcgcacctaacccttgttcttgggctgctgttcttgggaggcggccatggaggaggggctcggaggtggctggaaacggaggtgagtggaggcgtcgccatgggagcaggaggaagaagaagaagaaggggagttcaaattttgccgcgaaatcccgcgatgttgccgcggcttcgcttggttgaaatggatagctttctggattgggttgcaaagtttcccatttcacgcctcacatttaagaaaatttcatgaaaaggacatcacgcatttgtgttgtagtactactgtactagttccaaaatgatgcctaaaaaatttcaatattactttgagggtatcaatgaaaattttccctgagtatcagttctcattttttcttcatgtggctgtgagtggattgaagcagagagcagaaggaacaaacttttggctccattggaggacagggagttcttcacctgttgtgtggtggagcaagaaaaaatggagaaaatgggaggaattctcttgcagcatcaccaaatctctccaaattatctcgcaaaggctgccttcccaggatcatttgctctccacaaaggtgacagtgaatcagttcattctgaaatttacacacatgccttaatttacatacataaacataagtaattaactatgattttgcagcatgccatcatttctctttctgcttttataacacctggtttgaaactgcagttagctaaaactgcaaatcatggcgaaatgaactaagaaacttcttgttaagtaactgatcttttcaattagttgcagactttgcaaatgggattctgctttgtcctccacggaatagcttctcatgctcatcgttggggagcatcaggtcagaagcaaatggatctccgttgccaagaacggttaataggcgtagcaaagaagagctcattgagttcttcaaaagcatccagacctccattgccgaggaatcgccaagaacttcgaggaggacgaggaagcaatcatctgacccgttcgaagaggttgagaggaggaagcagtcatacggtaagtgaaaaaagaaaacgtagaacttgcactcgtttctgcatgtacagaactgatgctgttcactgtggattgaactgttgtatttcagaaaaagaactggttattgctgttccaagaacacatcaaacaaatgcaggctgtttgacatcccagaactgatcatctgcttcttgttgacaagctaggcatagctgatgtttcggaggaacatgcagatggggagccaaaggcgctggatctgaatgatatgaaggtggctgagctgagagaattggcgagggcgagaaggatgaaaggttactcgaggctgaagaagagtgagctgattgatcgtctgaagggtgtctgattgtcaagtcctggccaagaccaagaatcacgcagttgcagtcttgcagataaccaggctactaccagcaactttgctgacagtgactgaattgttatagcagtttttacagcaatctctgactttctaagagtacctcttgagtttttgttcactctgaaaccctctttcacttgttgaaagctgtagaaatgtagaatacatgtaatgcaccttcttatggtcagcccctgtctatgataagttttttttaaggccatctgttgcattgaaatgttttaggatctctgaaaccaagtcccgagtaattgtcttggctcattcaccaaactataaaaagtagttaaaaactgttactcctaatacatgattacaaacagtaatactaataaccgataaaatgaagtttatcagacagcaacacagagatgatattatttgtgccaagaaaagttgggcttcttcggttcttcccatatatgacagatatacgacaagaattcatcgatttatacggcttgtgataatcaggtcgaatcttccaatgaacaagcaaacagaagattagacattttttttgtaaattgctacatatacaaaacatatacataaaattagaattacagagaaaccaagcttccgttgtagtctagctggttaggatactcggctctcacccgagagacccgggttcgagtcccggcaacggaaatttttttctaatcccttttattaactgaaattacgtaaatgcccctccctttcttttccattccaccggggcaatatagtaattgtcaccatacaaacacccagcacaacaattttagggtttcctcccctactcctacaaagctccttccccgccgccgcccgagcaacactaaaccccccatctccgccgctcccgcctccccctcgccgccgccgcctcccagatctcgccatggtgagaggcgcgccgccttgccgtcggcgacgtcttctcctcgattcgttcttctgtccgctcgggcgcgcgtggttttgatgcgttttcttttggttggtttctgtgctcgcaggcgtcggagaagaagcaggcgaacccgatgcgggagatcaaggtgcagaagcttgtcctcaacatctccgtcggcgagagcggagatcgcctcacccgcgcctcgaaggtaataatcacgatgcacctgttcatgtcatgtcagattcggcttggtttagtcatgtagagctgtacggtttgttggtttcagataggctgagtgcaatggtgagctttccagtccggattgtgtagcggctagctattgtttggttctgggcatttttattctttgattgatgtgtgtccaatctagctgttgtctggttgctcgtggatggtttataaagttgtgttactgatgctgctagcatgaagccattacgattagaagctggtttggactttcaatttattccatttgtcgaatttgtagattgggcatgattagtccagcctcattggcctcaaatgaacattttgttttgactttgagttttatgcatcatgttttcgatcgtccatactcaaatgtatgtaaattctgctgtttgttctgttaggtgctggagcagctgagtgggcagtcaccggtgttctccaagggtaaattctgaagtctggcctgttattatcagtggtatgtggtttattgctggctttcagacttggagtgacgatgatgcgatattgcagcgaggtacactgtgaggtcgttcggcatccggcgtaatgagaagatcgcgtgctacgtgacagtgcgtggtgagaaggcaatgcagctcctggagagtggcctgaaggtgaaggagtacgagctgctgaggaggaacttcagtgagactggatgctttggttttggtatccaggagcacattgatcttggcatcaagtaagattatataatcccataatcttgtattatttcaatgtagagcatttgttactaaacttccttttcaacgcccaaatgtagttacttttcttcatgcgtagatttttatttgggtgaaatgtagtttttaaaatcagtttgatctgtgtatttactacatttgttgtttctgtatcaaaatcctcacttcaaatctcaaatgctactcatctttcaacatttgtaatgtttgatgtataacagaaacagtcgtgctatgcattggttcctaaattttgttcagtgtatgtttcatgcgacgtagttgatcatccaatgttgcactagtgtgctagcctcttggactcgtagcaggttattgagtatcttcttttactacgatatgctcttgcttttagtacgatatgctctcgtgcactgttgcaaaatgtttgctagtgttttccagctaatgtatcattgtattgttattgtttgatatgttcttggaatcccatgttaactaattatattcacagtatttgtcaaggcacattgttctattgatagtagttccttgatgtacatagacctgctgacacattgtctgttttttttgttgactgcacactaacccctcaatatcaccccatcatcatcattgaatgaagttatgtattcacaagtaaattgacctatctgttgcctttcaggtatgacccatccactggtatttacggtatggacttctacgtcgttcttgagcgtgctgggtaccgtgttgcgcggcgccgtaggtgcaagtcccgtgttggtatccagcacagggtcaccaaggaggatgccatgaagtggttccaggtcaagtacgagggtgtcatcctcaacaaggcccaagccaacacctcctaagcgtcactagtgcctagttctctttagaacttgagttatttggatgttggatttgtatgcttcttaaaactaaagatgttttgttattttgtcaactttgagttggatcagttttggtggtatgtactttcatcttaatgctcagatctatttactctcttagcagagatagatatatgatttgacatatgctacgaactgctgtcaatgttgataaaatgaaaagagaatggtttagaaaaagaaaatgtcactacagatgtttctttggcaatgatccaataaatgtaactcagaaagttcaaacccttctggcaatttagtagaataccaggaatccccatggtaatcgtgcactttcatgtgaaatcacaacgtattttttaaaaaaaatccgtgtgctccaagcggatacggaagttgggaactcgttcctgtaaaaataaatctataatcttgccctccaagcctaggcgaattgtacgatgatgtttaccttgtaaatttcttctcattccgtcacggtgcttatcttttccaaaaccggtcagtctacaatttgtttgcaagataaatgtgattgtaatgttgatcttcgacgcaagagtcgtttacaaaatgttttaaaaaaagtactatccagtacgattggccggtaacgcgtcatgactcatgagctactggacttggaatcaaatcgacgattagcacactaagagcaagttcaatagtatagctaactactagctccaattcatctatagccaatttaatagcttattcatataatagttacatactacactattaatacatggtcccacatgtcatacacatattgtgtcttggagtccgtgctacagctggctataaatctgtaacccgttgtccttctctttccttatttatctccttaaaatatgtttgcagcttgtttgtagcctgctattgtacctgctataagctagctgcaaacatattttaatgagataaaagatgagagagaagagcagcgggttacaaatctgtagccagctgcagcacggactacaagacgcaatgtgtgtatgacagtgggaccatatgctaatagtatagtaagcaactattatattaattggctattagattagctatagataaattggagctagtagtggactatactattgaacttgctcttgacagctgattaaacaaaacgaagatgctgggaagctcatgtcgaaaagataaacgtgaactgaaacgccaaaggagtccagacatccaggtcttgacggcattcatcgccgaaatccccaaatggacacggcgagcttgtgcaccgtggagaagcgcggcgccgtccacgtcatcaccctcaccggcgccggcgagcaccgcctcggcccgcccctcctgtccgcgctccgctccgccgtcgccgccgtccgcgccgccgccgccggggcgccggcggcgcgctggtgattgccggcgagggcaagtacttctccaacgggttcgacctggactgggcgcgcaccgtgcccgccgagctgcacgcctccatgggcggcgccttccggggcctcgtcgccgacctcctcgctctcccggtgcccaccgtcgccgccgtcaccggccacgccgcggccgccgggtgcgcgctggcgctcgcgcacgacgccgtggtcatgcgcgcctcccgcggcttcttgtacatgagcgaggtggacgccggcctcaagatcgtcgacttcttcgccaagctgatccggcagaaggtccccgacgccgtgaacaggagggatctagtcctccggggcaacaagatgacggcggccgacgccctgcggcggggcatcgtgtacgcggccgtcgacggcggcgtcgacgacgtggtgaccgccgccgtccgggagacggaggcgctcgcggcgaggggatgggacggggagatcgtggccgagaccaggaaggcgatttggccggagctctgggccaaggtgaaggaccacgccaccgacgagcctccgccgccgccgccacggccgctgctgtagtctaccttaccgtatgttgtatcgtgtatgcttccgctgcatcaagattggtgcgctgcaaatgtatcctcgcaggattgcatgatttgtatcacatgattctgctgaattcttgtgttcttgcactgaattgcagagatgttcaggttcactacttgatcatcaacaaacaaagctgcaaaatcaagacagggagtagaccaggatgtgaaggaaagagggttcattgcgattgggattggcatttacatgatgaaagagcaaacaaaaacagggagcagctacactactgtagggcaatgctaaggatcacaaaatgggaagaaaccaaaatgaaaggagaaaaaaaaaagaaggaaagcagggttccctagcttaacatgtctctcagtctccaccaactacatttatccttaaccttacctactactcaaccagcatgccccgtcacgtacttaacaccagcagcagcagcacgcatttctccatggttagataatttacataattgtacttcttctctggtactgagtccttgcggaaatggcttgacggatggatggatcatggaacatggatggtgcaatctgagatggagtccaagtccaggacaatggagtcatctaggattgcaatgtccagctcatggaaaaataaacgaacaaaacggtggcgtcgcggtgccctttagctcccagcatgcgcaaagttgaggccatgttgccgtctgatatgatccggtatgagcctgtggatgagttctggagaggcgctggctagctgcataccagaaatgagcattgataagcatccatgacaggtaaatataaatgtaccataaaaagcgactgtttgaaaatgttctcgtttacttacttcatgcttgaagttgaacagaggagggaatggacgaccatttggcaggcgtgcattgggctctcgtagctcatcaaagaaggaatgtgcacatgcgtcaagctgcatataatcaaccaaatgctaagctctttgaaaatgtccagcatgctgctttagagattatactgttttccagctaaagcataagctttaaacaattaacagcaactttttcaagtggagcactaacaactatatttaacaggcacatgcgactgtatgaaagttgcactcactcttcaccagccaacacaccaatttggttttggaccactggatattataattacaatgaccatgcaggaccagggatccatcaatctacttccataagggacctcaacagaaacatttcgtttattgttcttgacacacggtctatgaatatttgactgtaacagctaacaacacttgaaatgaaatgctaaaataagcaaatccatgtaaataatcattatcctagcgcttagcgaaaacaatagatttatagataatataaaactaagcaaacgaaagaaaactcacagcagtgcagcgtagacttggtgaatattggagaagacgggaagcaaggtctatggcttctggaggcattctcttgtggaaaatctggtggtaagcgaaagaacaacagatggatcagttaagcagctgcagatacattttttttatttcaaattaaacatgatgcagaaactggttttgaagtggcctacaatgccctgcaagtaaaatggtatgaggaaggtgatccaatataagaaaacatggctaccttgtgccaaggatgagccttaatctgaggaaatttgaactcagtatagttggggttcatgcatcgtatttcctcacgggttggagtaccaagaacctgccataatatcaagttaacacaagaaatacccgtggcaaaaaaaaaaatgtagcttgcacaacatcatgcaataccttgattatctctactagctggtcaacagcactctctccaggaaacagtggctgacaaatacacattatgaaatataatcagaataacatcacagcataatctaatcaaggaacctgaatgttgcagttccttagataaagatatagtgactaacctgaccaagaagtaactctgcaagaacgcatccagctgaccatatgtcaattgaagttgtatactcggttgcaccaaatatgagctcaggagcacgataatagcgagagcaaatgtatgatatgttcggttcaccaggaacctggtggaatagtacaaggagatcatcaatctatttgttaaaatagcaaaatgaagaaataacagaactagggaagagaggccaacagttataatccaagctcaggaattcatcattatagtcctagctcagcaactttgcatccaacttaataaacttaacaatccttcgacataataacagcacatgataaaaccaatttggaaatattgatcatgataggcaatttcttttattaactattgagctatctaaaaaagtctatcccagcacagtgcaaattttaacttctatcacaaatcaatcatgaaaggcaaaagcagcatatctacacgtaaaagcaacatgacgaaataaaccacttatgctgtcaacattatgactagcctaccactagaataatttcagcatacatcaaaccactgagaaattactcttaagggtggaaatcaacataccagaacctttgcacttccaaagtcacatagcttgacttgatgagtgagaggatcaacctgtatcagcaagcaattagagaccagttcaaaacaaacaaccaagcaagagaagtaatgtagccttgttcacataagtcataccaaaacattttgtggtttcacatccctgtggcagactcctggaacagtatgaatataagctaaccctctgaaaagctgcaagcatagcaaaagtatctttagagaagcaatgagaagcatagtggcaatcagagaggtgttaacatggtggctgacaaacctgatagatgtaaagcttcacatagatcaatggcatccgctggttagcattgctgtagtgcttgagcacacggtagagtgtctcagggacgtactccataacaagattcaggaacagctcatccctgcttgtggttgagaagaagcagtgcttcaggcagatgacattggggtgttccattgcgcgcataagctgcagttcacggttcttgtaacgccggtcctgcaacaccttcttgatggccaccgtttcccccgtctccaagcacttagcctaaatgtgaaaactaaatcagtttgattcaaacatatcaaaaaatgtacaatacacggtaagcatgcatttccataagaccaagcatcgtacctggaacacaatcccgaaagaaccagttcctacaactcgctccgccatataactaattgtctgcagttaaggtaagaaaaaaatcgcatgagaaatcgcgcacaatatctcaagattgacggattctatgttgtgcatcagagttccagcttatcatgactaactaaaattagaagtgaagcatttattaccccctagaaacaacaggatagactatgaaatagcggacagaaaaagaaaatcatgcttcctaaaatgtacattatcctcaagtaattgaataaccaaacatttaattgaggaatacactacgtaattttatcagtcaaatgctaaattgtttacaaatcaaaacgacaactgtatctagtcagccccaaacccacaaaattgcgattccccgacgaatcagcacatagatagctaacttgatcagccgaacactaccaacagcttagaaacggcttaagagagcacaaatccttagcgaaccaagtgattgttacgagcaaggaagcaagcgaagggcgccaaaactagcacattccactgtacacaaagaagaacagaaaccaaaaagaccccgaaaaaagctcacccgcttcggctcgccgttcttgccgccgatggtggtggagatgatgtgacccgtcacggggtcgcccccgccctcctcctttttttgcagcacctccaaccaaaaaaaaaaaaaaaaaaaaaaaaacggcgccgcgagacaccggagagaaaaccagcattagcccaacgaccaccgaaaccagcagatcggcaccgagccccagcccagatccaccccgacaccccagatctggacacccccctccccacgggttaccttctcgctgatgccggcggtcgccgccgccgccgccacgccgggggggggcggtggcgcgtccagctccatgggctccggccccggcggcgcctccatgcgggggggagctgagctgagctggggagggaggcggctgctgctgctgagcgttggtgcttggctttgcggggggatggtggtggtgtgcttttgaccggtcagggaggggaggcagcaaggctgcggggtgttgtggtgtggtgtggtgtggctgctgccggtgaggccggctttggagtttggacagatggggaagtggttttaccgataactgtgctgactcctccagctaataactgtgctcagtatgatatttttgaagggttttctttcatgaactgggatgttttataggaggaattttagaggatttgcatgagagatgaaccaaggtgaaaatcttgagtttcttagtttagaaggagtctttggtggtattgattaggataaagaattgggtatggatgacgaatggagatgtggtacgtctttggcatgaattttgttgatgcttaatttgtatgttcaaatggcggttatatagaaatattttttatcatcgtacggtttttatcggtttcatcgtaattgttgctttcttaaggttgtatcgggataaaaagctcgggctagaataagtcaagaagaatagagatgttgtacatctttagcatgaattttatgaatgcttcatttgtatatttcaatgactgttaagtagaaatatttttattaacatatggttttatgtttttatccgtttcatcgtgattgttgctttctttaggttgtattacgataaaaggttgggacagaaagaaacaactatacggtacgtctttagcatgatttttataaatgcttaatttgtatatttcaatgacggttacgtagaaatatttttgttaacacgtgattttgtccgtttcatcgtaattgttgctttcttaagattgtatcaggataaaaagttgggccggaataaataaagaagaatagagatgtagtacatctttagcatgaattttatagatgcttagttggtatatttcaacaacggttacatagtaatatttatattaacatgtggttttatctgtttcatcatgattgtttctttcttaaggttgtatcaggataaaaagttggggctgaaaatagtcaggaggaatagaaatgtggtacgtctttagcatgaaatttatggatgcttaatctgtatagttcaacgacggttacgtagtaattttttattaacatgtggttttatccgtttcatcgtgattgttgctttcttaaggttgtatcaggataaaatgttagggttgaaagtagtcaagaagaatatagatgtggtacatttttagaataaattgtatggatgcttaagttgtatattttagtcatgttacatagcgatatttttattaaaatgtgattgtattcgtttcattataattgttgtttttttttgttgtatctagattaaaaaaaactagggccaaaagaaactaagaagattaaagatgcggtaagtctttagcatgaattttatggatgcttaatttgtatatttcaatcacggttgcatagcaatgttttaattaacaagcagttttatatgtttcatcgtattagttgcttttttaaggctactgatgctacttatctatgatttttatgcaattgatgctactgttttagattgcagagatattatccactaatttgatctctctaaacaaaccatcggacaagatgattcactgatactaatagatttatcgtgggaaacattttcagttttagaggatttgtttgaaatataaactaagtcatgtgaaaatcttgaatttatttatttagaaggagtgtgtaatattaatgatcatgataaaaaaattggggttgagaacagaatataggtgtgatactatgaattttatagatgcttaatttttatatctcaatcatggttaagtagtaatgtctttattaacacaaagttaccgaaataacatattccgtgataatcctcatttctaaaagtgcgattgaacatattcggcataaattagtgcctatatattcaatttagtagtaactactttttatttcagcatgatacaaatacatcgatatattagaggtgattttttttcttattcatgtgctgccggttgccactacattgttttggtgacagtcggtgactccttgttattacacgaggaaaatattaagtgcatgataactacagttgtatatcgacacatcctctttcaaatatttttaaaatacgaggtaaatgttttaaaaaacttattagcgtttttttgagaaaattattacaacatttttaacagagtgtatcatgaaaataaattatgagttaacttcatcgcttagtgaaagttttgtctttttttctttatcttatagtcatcgtctttattctgtagttttccatgattttacccaaaggtgtgatatgcggtaccgaaatgccctcaatatatgaacatgtccggacatcatctgaacgaccgaaaaaaagagaaacacgggacatcaatatcagaccatatttaaagatctttttaaacgttggaacgtgtcttgaatcctaaaatcgaacaataaggccggctaagagcacccgcaatagtaaagtaaggtgctctctataaaatatgtacatctcagcaatagactcgattgatagtaagtatgtctacattagtatctatagctctctcatacattgcctcgtttttctctatagactatctctaagttagtagatagttttgctctctctcttcatttaataccttttaagtaggaaaatatgctgacatacatctcttttatatatatatatatatatatatatatatatatatatatatatatatatatatatataacaatcattgtggctgccctaaccgctatcgcgatggctagctagacac

SEQ ID NO: 30470 - DNA, 1440 bp, Oryza sativa
agcgaccccctaagatgggcgccggccactcggccagggcatccgcgatcctcgtcggcaggcactgcatgccactctccccaccgtctcacatcacatgcctctccaacctgtcgtcgtggcgcgctcgccaccgaccgccgttgccaccgcacgccacgctttgactctaccgacgtgcccaaacacagcacacaccgtcccccccggccacattagccgttgttttattacgcgcgcgatggtccagctgatgcgtgtcgtaggcgtacgtgccactgttcgccgtggtgcgtttcgatcacgagccagtaattaaccacggcttctagccagtcttcgtctatcgtcgtcgtcgtcgcatgtgcagggtggattaggtttgccagtcgctggcatatgcatcgagctatcggtttggtcttggggataaaatgtcagcagcgtgtcactagttttttttttcttttctgtttgttcttcccgttgtttttagatttgcgtggtcaaagtggcagcagttggtgactgtaccgaatactgacatcgatcggcgtggtggtggtggtgatggtactgttcttttgttatccacggtggcagtcaaatcagctgctcgtccaatcatgcatgcgttcaaagctggattagttgagagctcagtagttcaaagtagttttttttttccctagggttcatctccacttgtcatttgctgcttctcatcgggacactttcatactgcatgctgaaaggacagaacactaattatagtagtactttcttctgaacctcatacgctcccaatggaaatggaaacgagccgttaatttctcgtgaacttctttgcaaaaacgccacaacgtacgatttccctgcgaaacttcaccggaattctgacaagcaccaattctactagggctctaggcatagcgtctttccgtgagaacgcagttaattaaccaattaaccatgccggaaaactggaccctttcgatcgggaaacccgggaagccaccggactgaaacgaactgaaacgaagtagagtagctcgcagcctctcagctactactacgttgtgaccaggaaacgcataggttttgacctgaccaccaccctcattcaaagctcgcactggcctggacggcgctctgcctgctgggctagctagtctctctccgtttacggtagtttctgatagctgcagcttctcttaaaacctctcgctgttagaaactctttcaaatagtctagattttcacttagattttgataaggggtgtgtttagttcacgccaaaataaaaagtttggttgagatttgaacgatgtgacggaaaagttggaagtttatgtgtgtagaaaagttttgatgtgatgaaaaagttgaaagtttgaaaaaaagtttagaaataaactcggccaagatgtatttgtaga

SEQ ID NO: 30471 - DNA, 16366 bp, Oryza sativa
  unsure (1)..(16366): unsure at all n locations
nnnnnnnnnnnnnnnnnnnnnnnnnnnnnnnnnnnnnnnnnnnnnnnnnnnnnnnnaaaagttggaagtttatgtgtgtagaaaagttttgatgtgatgaaaaagttgaaagtttgaaaaaaagtttagaaataaactcggccaagatgtatttgtagaattcagaaaatgcattagaagtcggaagctaggtttttcatttttttcatattctcacgtactacttcttagaatcttaacctacaaacagtacctcgatcactctctgtactgcaaccaagcaaagccctgtggccaccggcctgtgccaatggacgcgctgcacagtagttgatgctactcctcctcgatctgcttgaccaagcctcacaagagacaaggaataatgtgaccaaaggtaacaagaatcacacacgattttcgtcactagacactatagttagacagtgccatggaaaaacagcactcgacaaaattcagatcatgtacagtatcagcggacagctagtagctcagctcaaacactagccaaatttgacagatctcgtgttgtttctcatcagtcatctttatcctggagctcgaggctaaaagcaccagattcctcgcttctttgattcgaatggatttgcttaattcagggatcaaagacagagaataaaaaatatagtccttcatttaacaaccagtagcagcaacaaacaaatgggtgcctacctggaacaaaaaaaattgcacacactgatcggtgcgcctgaatgattgagagttgcatcctcttctttccgttattctttctccaaatagaatatgttcgggaacaagatttaacatgctggatgccattattatcgaacaggaatgcaaggatcatgtggtggggccatggatgccgtggagaggcaaatacaaagacagcctatgtcgcatcccacattgaccagaatagggacctcaatcatcaagtgtcgatctctcgggcttaatagtagtagggagtattatccaatgtaaagccaacgagtaaggtacggcaagtggagtatcttctgctaatctcagctttcatagtaggagtactcgctttgagattctatattaattgacattttggacaagattgaagttaaatttttataactttgaccattaataactaaaaatatttagtttaaagaaactagaaaaacatatacatttatttattgtatatattataatagaaaaataaggtcaaaggtatatcttatggaacgtgtaattgtccaaagcgttaattaaaatgaaaccggagggagtacgttttttagggtatatatttgatttttaaaacacggcatttgtactaggttttattcttcaatgagtactccagataaaaacaatagcaaggtgcctaggtcataataaaaaaaatgaaaacaaaatatatgttggtgaaattataagtgcatgacttcacccactggaatacaaatacaacatcgatgaatattcggttttactatattacttgcggcagtttttaggcgtaaaaactttcaaattgtggaccgttagacaggattcgtacagaccggatgataagaaattgcataaagcgcgcgggagaaaagagcaaacgtatgacctccccgtttatgactgaacagagctaaccgattggacgaatttggattttcgtttaattacataccaattccatatttgttacatactagttacggtaaccctaactcattgtaactacattataatttaggcataaagatttttatatgtttttaataattgcatatgttatattatagttataatatagttacggtggaattatattacagctatacaatatactacagttagatctaaaagttttccacataaaaaatttgcagcagttttttaatagtcccaaaatattagttatacgcggttgcaaatggtgggtgtacgtagaggtgagcgggcgtgcctaaacactaagggtgtgtttggatagagggatttaagtggataggacatggcggcccatttttgtgggtgtttggttcctgggcggaggtgggatagggcggtccggagggaaatattccgcccagatgtaggatggagggatccggtcgattcggccgaatgcagctgcccgagcgctcgagcgagcgggggcgagcgacgagtgggtcgcgtcacccctctcaccacgacacgagctcggcggcggctacggcgagcggcgacacgagctcggtggcgaccaagccacgcgacgagagaggaggcaagctcggcggccggcgcgggcgacgagcacggcggcagtgggacgcgagctcggcggcggcggcagaggaggcgcggcggtgaccggtgagagaggaggcgggaagaggacgcgccgacgacgaccaggacgacgacgaccggatctggggcggcgtggcacgccggcgagagaggaggcatggcggcggcaggggagagaggagacgggctcagcggtggccatgggggaggcttggcggcgggattgccggtgagagagaaggcgaggggcgatcggggaagataggaggcgagggacggccggcgattttgagaaggaagattttttctttttttttgtttttctccttccccttttatttctttatgctttttttatttatatttagatttttttagtatattgatattttttttggtttggagaatttggaggggtatactcactatctctaatgaaaggatgattgcaaccacttattcatcccactcccccaaccaaaaaaaaattagatcaccatatccactttcatccctgcaaccaaacaaaaaactggatcgccatatttactccaccatacaaaaaaccgaatcgccatatccagtaaaatatggaccgccatatcccatctaaccttgaccgggaaccaatcgcaccctaacagtaccatgcgatcatacttaacagaactactccgagcagtagtggtgagagggagtagtagggactatcatttctgaaagcacgaatagtacgtaactggatgaaggagtaatgggcaaacgatgtgctagtccagccagcagccatacatcaacatcaataagcaacaaatgttctcaggggcttgggcttttttgtccagcttgggatctagcccaggtccatatggaacaggagcggaaaaagtacattgaaggtccctcaacttgttacaaaatcatcccccaaccatgaactcagatattcgacgtcccttaactaatcaaaataggtccttaactaatcaacatgtgagacccacatgggtcccacgttgactcagccgccatgtaggacaaaaccagggtcaaaaccaccgaaagacctattttgattggttttgattagttaagagacgtcggatatctgattttatggttgggggatgattttgtaactcgatgacaagttgagggaccttcggtgtacttttaccaacaggagccaccacaaaagaaaggaaatatcaaatataggccggagtgaacctgctactgggctaggcggctagcaaatgttaacacaaaaaggctaaggtggtgtttacttccagagacttaactttagtccctgtctttagacactaatttagagtattaaatatagactacttacaaaactaattatataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggtctaactagatcccgcgttgcaaatactgtactctcttcatccaaaagttttaaaacgtattttagtttttgggttttccaaataaaatgattatatttgttttatccatgcataaaaaaagtaaatgaagaaaaatgtctcttcgtttagaagcagattattaattactcattgcatgcattctctttctttgttgcacgaggagtaaagatggatgagttaatttctccttatttttttggtgaataaagaaatacatcttagacttttgaatggagtgagtaaaatttaacaaaactggcattgtcgtatgatacaatttcatttttctttctaaaccaatcctaagtttccaaccaagaggcaagcaaacgtctaaagttgttcgaagtttttaacgctatctagtttgttatggcttattattcggtttggaggaatagaaacgcatgcacacttttaatcgtaggaattcccaataggtttgagtggatgaaaaatttcttatatcaacttgtatataaaaaaagaacttcctttagttttcctgtacttatatttctacaaaccaaatgtcgttcgtaagaattagtctttacaaatccaaattttatgcgcccgcccccccccccccccccccccaaaatttggatactttagcactgagaaaagttgctgttttgaagatgacttgtctgcaaacaaatcaattaccgattaatagcacgcacgcacctacgttccgctcataccttgaacgggaatgtgaactcatcatgaccataataaacccatacttcctccgttccaaaataaatatatttgagattgacattttctaatataataaatccagaagagatttatttagattcattgtaatagaaaatgtcgcatattttttttcgaacgcgcaaaaggattgcatgtcaatatattagaagaaaatagtatttgttacacaacgcaatcagttagactgacttatgccaagaaaggagggaaacaaaagaccaaagaaaaaaaaactaggttattatgactccaaacagcgggaagggggcagagcccactactctccccataaaaccccaaaattagcaatgccagctaacggctatagatgaccctctgagaggatggactgaaggacctccaagactgaagataatatagagtcgaaaaccctagagtccactgttgccaggagaccaggagaatcagagaatcgaagccggcacggagatgctcaggcaaagcatgccctagacgatggccaccaatcctggaggcagctaccacggggaggagagagggcagcccaaccaagaggtgacaacacacggagccagacctgtcgagcgaacacacaatcgaggaggatgtggtttgccatctaaagctcttgagtgtaaaaggggcagaccgagtgactatcaatgctgcgcttctgggggagatcgggcgtgcaacaacatcgttgaaatgcaaactagaggaagaatttgtatttagcaggacccttcgcgtgctacagaagatcagcacaagcaaatgagggctggccataaaagaacatctggtacgccgaacgtgttgagtagcgttggtcactcgtctaacactgcaacaccaaacaagacgatccccgaaacctggcgagagctgaaagtgaagcaccaaatcccaaaataagaagaaattgggagatgaattgatttttttggatggaaaaaagtacgtactcaattactcatatgcatggtcgttttaactgctctgttctgccgacacgaagcatgctagctagtagcgtgtacattatcaagcagctcgtcttctatacttctataaaatcaaaggcaaagggaagggacttgatgatggcgcatcgatcgatccccattccatatctgccgtgaacttaaagccttcacaaaccaaggtggacactgataaggtcgtagtaatccagaacctctgcctgcctccatcagcgccggccggccggccggtctgctcattactagcagcacacagtttaaactctactttggtgtagtacttctcgtacacgttgttgcttgttgccattatcacgcgtagtttattcggagtagttctagtctggagctttggaagggggccggccgcttgtccagacatgcgcaggcccagcttgcaacttgccgcgtactactgccccgatgctcgctgttggttggtgccacatcccacgctgccatgccatgcacgtatgtgcacgcacacgcgacgtacaacaacgtcgcgttccggtggccattggtccgtgcgctcactgcgtcctgcatgtgtgtgtgggcgtgtcgggggtctcgaccgccgtgcgcgctcgggccgtgccggcacgagatgccacggttcacatgaggcgcaacgcacgcagcgcatctgcgcatgtcccccactcggttggtggtggtggtggtagctttggggcgtttggctcggggctcgcacgcgacgcgaccgagacaagcaagcgcggtctgcctagcttgtctccttgcgcgacttgtagatagatagatagatagatagaaatagaacggcagtcggtgcagcagtagctggaaactcgcgcgcgcgcgcgagcggcgggcggcttttccgtgttcggtgtttcggtgcggcggccatatatacgcgcgcgcgctcgcgtactacgtgcagacgacggactagtgcgtgcgtgcgtgacgcgagaggctgagaggagcattttggcccttggtttctttcggttcttctgctcttttttgctggcgatggggtggtcgtcgtcaagggctatgctcgtggcgcgcgctgtggccttggcggtggtgttcctcgcggcgaaggctcagctgtcgccggggtactacaacgcgacgtgccccggggtggtgtccatcgtgcgccgcggcatggcgcaggcagtgcagaaggagtcgcgcatgggcgcctccatcctccgcctcttcttccacgactgcttcgtcaacgtaactacgcgaaatggatctcttgctcggccaatgtacttcgccttgttgagtttaatgaccgcgtgcgtgtgtgcaggggtgcgacgcctccatcttgctcgacgacacggcgaacttcaccggggagaagaacgccgggccgaacgccaactcggtgcgcgggtacgaggtcatcgacgccatcaaggcgcagctcgaggcctcctgcaaggccaccgtctcctgcgccgacatcatcacgctcgccgcgcgcgacgccgtcaacctggtcagtatctgcctcgtgtttttctgcacccatgtaatgctggcattaatggcggggcgcgtgcagctcgggggcccgaactggacggtgccgctggggcggcgtgacgcgcgcacgacgagccagagcgcggcgaacaccaacctgccgccgcccggcgcgagcctcgcgtcgctcctgtcgatgttcagcgccaagggcctcgacgcgcgggacctcaccgcgctgtcgggcgcgcacaccgtcgggtgggcgcgctgctccaccttccgcacgcacatctacaacgacaccggcgtgaacgccaccttcgcctcgcagctgcgcaccaagtcctgcccgaccaccggcggcgacggcaacctcgcgccgctcgagctgcaggcgcccaacaccttcgacaacgcctacttcacggacctcctcagccgccgcgtcctgctgcgctccgaccaggagctcttcggcagcggcgccggcaatggcaccacggacgcgttcgtgcgcgcgtacgccgccaacgcgacgacgttcgcggcggacttcgccgccgcgatggtgaggctgggcaacctgagcccgctcaccgggaagaacggcgaggtacggatcaactgccggcgagtgaactcatcatgaacatgaaatggattcttgatgtacgcttcgtgaacgccataaacttattatcaaatcttgtttttaccaaaagcaaatggaaaaaatgctgttcttgcactgatttttctccaaatttcgatcgaagcgagcagcacacacaaaactctgccatgaaccgattcatggcggagtggggttttagtccggaacagatctcagccgctgattactagatcgacgatgcgatcagaacagggaatctgctgggcccgtggaccagtggaacactgcagatgtggcagcccaggatggcaatgtttgattggctgactgccagattatcgctgtcttttccaacgagctaagcagtttgtcagttgtcacatgagttaactctgaattttcaatcattttcaagtcttgaaccatgctttagatatactattaattaacgcaatttgttggctttctcaactctataaaaccgtgtgacagtggaatcatctctctttctgagataataataaagatctaattaagcacattaagcaaaacaaagcatccggtttccagcgatgaatgcatcattgaataaaaaataaacataaaatctagcactgaatgtctgctaaaagtcctgaaaacccatggctctttcatcatcacacattggcatttgcattgacgcgcagacacttcacgctagccgacttcgtcggtgctgtttatcggcgactcgtcagtcagtacactgtgaatctgtgatccatagctactgatgattgagcaaagcccctgcggcgacgaagccggcaaagtagccacaggttgggccacagcccacatggaacggacgggctcacatgctgtgatgagcctgtgacactgtgtcccgatctgtgtaccttttctctttctggtttttacaggctaatcatcatctcactctgctcacccatcattgcagattaagcatcacaggaatgagaaagaaagtaagtataacactcgctttacacggctgaatcctgatcagaaaaatgcccagctggcaggtgtgtctgagaagttgttcccctttgcatcctgctagaaaagtcttttgctacaggttgccacgcccatctgttcgagtccgcggcggcgccaaaatcgctttggtgcgctgcagaaaaaagcgtcgcacaccacagtcacaccatgcccgccctccatgcaacgcggcgccagcgcacggggaattcgcgagagaaaaccgcggcccataatacaacatggcacgaacgcgtacacgcgcgagcgcggcaatgcgatgcgtcacgcgtcggcgcgacggcgcgtattagtattatcctccgcacggggcgtttgctgatgagacgcacgcgccgccggacgcacgtccacggggatgacaaaacgcaggagtcaggacgagacggagacgacgtgtatgcgtggttgtgtgcagggcatcgcgccgcgccgcgcgcggcatatgctgcatgcgccctgtgcgcgcgggggcagttgatccgcggcgttttggaatggagaagggagaggcgcccgagctggcagcctctgcgtcgtgcgcgcgctgccctcgcggccacggcagccgcgcgcgcgctcggtcacgcagagcagaggcaggcgtacgtgaacccgccgtgcacccaccatgtggcccatgctggtgctgcggctgcagtagcgtggtgtacacacaggacgatctacaatggcacgaaacaatggagcatcgcattcgcaccgcatggcggctagatagatatagtattcttttgtcttgtagatcctctggtcctcgacatcctcaagagtctcggaacctcatcaggattcaggacaaggggaagcgaaggtaaacatgaaaacatggtgttggaagtggaactgtaacaccaggtctgtgacgagggagggaccatggaattgcctgcatctgcggcggggataaaaaaaaagcggtatattctctctattctaaaaaaaattaacctcatactacgacgtgacacatactactacaatgaatctggacatagagtatgtctatatcgtggtgccacatcctagtactaggttttttttagaacggtggaagtagcatttgtccacttcagtttttccagagatgctgacagagtaaagctgaacaaaacctgcgactctggggcagggcatactccattattgagagcggctgagatgggagcatactatgatggataatggcagcaattttgactcttttactaaacttgttcgaaaactagatgtcgacaaaaatataaccaaaaatatatctttatcccgtcaaaaaaaaagctctttaccttactagatcttagcactaaggcccaacatctcaacgccaagctcatcagtgataaatttggaacaaaattatcgaggctctatatatgtaaattatctaattattaactaatataaattaatatgatataatttagttagaatttgaataatctacaacgtaggtacgtccctgagacccattgatgcggacctcgtggaatacactataaaacgttgatagatccaaatacacatgaaaacttgcatagtgatcagtgactagagatggcccccaccgaaaaatgcatccctatccctacccccgtgagacaaaactttcccgtgcccgcaaaatacaacgggaaataagattatcatttatcaaagaggatcacccttgcccccacgaacctgacaggggcatgacttctcccattataattcccttatgaagaatcaactatagccatttccgtccctaataaaagaattcctcgtaggaaaagggaaaacggggctcattgccatatctagtagtggcgtagtgtagtggtaaatggtgtttgtatcaccatgaagaacatggttcaaatcacgaccactaaaatatttttaaaaggtgaaggcacaacaaagaaaaaaaaaagggaggggaggggtccgaagtggcaaaaaagaaaaacaatgatcacgaaatgggcttcaaactagcaccttctgttataataagggagtatcttaccactagactactagatacatcttgataagaaaacaacttatagtatttattaatttgtattatattactctgcgctaaactatatgatgctaattttttaatcttaacactaaggccaaagcccatgaggttgaggtagaggcctaatgttggttatagttcttctggtctatttatagaatacgttttatgaaaaggttaaaatgtcaatatttcggggataatggagtagcaagaagggtaatacagctcatgagagatttggagcaaggtgcagcctaattagtgcacatcaagcgatgccgagctccataatgttatcgacgaagtcatgcggatgcagatgactagatgaggcgctccctgttcgtcagattatctcggttaaacaaatgccggagcggttttaccggccgtaagcgcctcttcttaccttggacggtgacgccggggacgtggccggggtgcggtgccggcgacccggcgaccatggacccaggacatggcggtgcctgtcgctttgatacgcggcggcgacggcggcgagagcccgccagcccggcattcgcgggagactacggagtggccgtgtggggacagaagtcttgcatcgttagcgtggcgaggtctcgccgtctcggtgcaccagcccacgatggcccaagtaaagcccaaaccgtcctattttggatcgccaccattggtagcggcccatagggaagggacgtatgaccttttcatttggatcccggttttgagggaagctctgcaaatggtagagatcttaaacatttctgcatctagattttaggcccctatttttaattgtcctcaccaattgcggtccttttctgtgcttagttggcggctcatttggctgatgcagaaatgaaagctttgctgtgaccgagttgctcatcaactatccactagtagtagtaatagtagcttaattcgtacctgttccagtaattgcatcttgatgtaggagcgtgctcctcataaaagaacatgcattaacttgtgtcgactgaagaatcgaagtgcactacatgaatgccatgatagtccatttccagttcacatcagaaacatcccaggtttatcatgcataagaaagtacagcagagctggataccaaagttaacgcgcccacgcatcaagcaaagggacacagaacaccaagtttgggcattgagggtttaatcaggttacgaatcaaaatggaaacatgcagcgcagcaccagcaaactacactgacaacgatcagaaactacggctatcaatcagtagatgaagtggccgaaactacagtgcaaaacacttggcaagactaggtttcatgagcatcaagcgagatcgtcttcttcttaatcatcaatggaacaatcagcagggaccttgctcttgagtctacgtgctctcgctctttggagcagcgacttccttgtcgagacgggaaacctctgaatggcactgatatgtaactaatcccagcaatgaaaccgtgataatttggaaccacccgagctgctttagtccagcctcaactttctcaatccttctgagttgatgatccataaccttagccacttggcaatcctccacatacttgtattcctgcagaaacacactacgtcatgtggtctgaaattgagagcaataaggatcactcaacagcatgcatctaggggcttgacagaaacaaactcagggtattctcaaaagaaacataagtcagggttggcagaatggtccactccagttctagcttcaggaacgtttggattttcaagaatgaccagggctagctatgtttacctacagttagctgatcccacacccatgggcttcctgctgcagttggacaatgagctgatggtgacatggagctgttattttgcaggttattagctatgcacagaatgtagcaacttgcacggctgagttcaactcacttttagcaatttttcaatttttaagtgttgatttagaaatacttaataaatgtaactatatggcctggaccactggaagcagttagaagacaagagagaaggttagcagcctctgcatgatgccacgatatactccttccgatcacaaaagaacatcgttttagagtgcgagtcaacacacgttaactttgaccataaatatcatttacgatataggttttgaacatatgaaaatgatatatcctagtttctcataacacatgtaatatcatattgattttgaagagttcaaaacaactttcttttgtgactggagggagtacaccagatactatgaggataagcagcaacaagaaaaacttgtgatggcacatgggcacagcactatcacacctaaatagtgaacaatgtggaccaaacactgaaaaaggtaatcattgattcagtatgagctggatgttatagaaaccttctttgcatggaaaatgcaagcctataccggactgttctttgcttctaattgccaggtgttcaacaaaatagcagaaagggattatctgagtgcatgccatgtatgatggatgttcaagagaccaagaaactcatagataaatttgaaatagtggggggaggattttcagtggtctcctttgtttagaagtaaaatatgacaattttctcgttaataacattattcatggcttccaaaaatggcctaaccgaaaccatacaaaccaagtacaacaattttaacacataccgcaaggcgattgtatccacacacaatcccatttccataagccatccgttccaaattaatggcaggtagaaccatggtcgtctgactgacgcctctgggctctggtggttcatgcttaaggccaatggcatcagacaagctccaatatgcatattttagttgggtttgtggagattggtgcttgctcctttttttaaccaagtgcatgcatcggtctatcactcaacatgcatggtgattgcaaattctatgcaaaccacacgtttattggcattagtttccaacacatattataaaatcactggctttggatcaaatgtaacaagcggtggctaattacgcccaaacagcttttcctacaaggactaacactaagacaaaaagcacaggcttggatggatctgtggttacctgaccagaagaatacccatcagaagaatactcatcagaagaatactcctcagaagaatacacacggcggcggcggggcacaaagaggggaagtggagatgcacggtgaagggcagggacgccagcggcaggggtggcggtagcagtggctccctgtaagcggaacatttctcggttaattagcggcttcagaattcagtcaatatgtagaacacacctcagaattcagtgagtagtggcactaaatgtggccaccttgaaaccttaccgtggtgaagcagtagcggcgtaccagagagggtacctggagcggggaggcgccgcgagcagggcgcacggcggcgtatcctccctgcgaaaaagtgcaatttcggtcagcaagcaagcagcagcggagcaagcttacgtaaggtgaaacggcgaagaggtcgaggtcgatgcttaccccggcggagcagtagcggcggacaacggagggcgcctggatcgacggagcgggcgcaccgcgcgtggcggcgtgaagggtgaagncgcccccaccgccctgggagcaagaaatttttagggggggttggggaggggttttggtcgggtgatcaccgcgaaacccnacncaagtaggcggcggggggnatggctcataccttggcgcagggtccaggggacgagtacggcaggaggcgggccaccgncnaatagtcggcgtgncgncgncgaaggacggcncggagcgcgacgaccatggcgtcgccgcgagggttttgggtttgctcgcgtctcgtctccacccactccggtgaagcgtacgaagnaagcgtctgtggactgcgtgtagtgcaatgaatggaagaaggcaataagccaagggagtctttatgggccgggccgggcctggctcagtgttggaaatgtaaagaaaagccactgaaagcaaaatgctttcagtttttttttttttggagaaacaaaatgctttcatgtttgtgtgccattactagaaacttatattgctcatctaataaagtttatacaaaatgctttcttgtatttgggttgatgaaccccctggctatattctaaatcatctggtaaatgatgtaacaattttatcatatcaataaagctagccgaatggcattcctccctcccaaaaaaaaagtttatatggaatcatgcagcactaatcatgggattgctattatatcaaaaaaaatcatgagattttcagtgtaagaatgcagtttgcatttgaccgaagagctaagctagaatacataatttcagattggagaacccagattaatacgccagaaattggaaaattgtttttggacattagtagtgtcggtcacactcttcatttttacgctatattttgatattttcccgatctctgtgttggatctgacgtgtaacactaaatctcggacatacactttcttccctatccattttccctcttatatatcatgaggtattacgggcattgcaaaattgtttatcagatattgaagttttcttttgtatagttgtgccaaccaatattaataacatcaatcagaacaattcccgtatcatttttctaagcttttagatcatttcatcgtggcttgcatgcaacactacgaaaaagtagttgctgtgattgtccaaattatgaggcttaaggtcgtgtgtttggaaaaattaaggagattgggttaattacttgtatttacactcaacaagaattgccccatggactcttggagggttgaaatgagaatttgacaattggaattatttcttcatctacgtacgttccaggagatcagtgaccttgttgaaactaaaagggcactgtttttgtttattggactccagtcgcaagttcgataatatataacatacgttttatttgacgatctctctcgagttaaaatcacatatgagcacgcgtgccacatgtacacaccaaataatggaagaaaattttaatgcttttccatgctgaattgagagaattattcctgaacaatgaaagagagcgatggcgcgtgtttatatttcgctatgtagtcaggactgtgttgcttttatgttgctcaaactcagtacattttctgcttcaaaaaacaaaaatgttgtggccatcacaagagtttaaatagtaccagtacatacaggtggcatctagcaaacatgccagtaagtggttcccaccaaccattttcctacgtggaggatagcaacaacgtgcccgtaaagtgttgaaaatgtcatactgcaccgactttccagtccaactcagcgcagacaaattcagaaaca

SEQ ID NO: 30472 - DNA, 1221 bp, Oryza sativa
  unsure (1)..(1221): unsure at all n locations
gttgcttgtttctttttgcttttctaagcttaccgcaaaatatgaacattgatagccaaaacaaaacccagcaaccctaagtttcacctcaaacgaaacgcaaaccctaactggcaagaacagtaagacaagtcgcacgagaaaccgagaaatcgtctcgccccccccccccccccttcccccaaatatttccttctttcgaatgccttgaaccgagaaacagataaagcttgtttggtaacacgagagaaggggaccagtttatacgaaggaattgatgatgagattaagatgggaatttgatttttaatcccaatatcttgtttagtagaggtgatggaaattgatagggagtttagttggagattaaaacggatggctgagatttgtttagacaaaataaaggagaaattctctcctaattacctgccactacccaagtattgaaaatgagggagttccttccttaattcctcatcccaatcttaccaaaattctcatgtctcccaaccaaaccaaacacttaataacctcatccctctgaactaccaatccctcctaaaaactccctccaaccaaacgggccgtaacgcggtagagcctcgcaagagcaagacaacgcgaaatcagacgatagagtcgtactaatcaggatggggattatttccgctatcactcaccacacggagcggatcggcgaagagggcgtggatctggggaatcaggtcgagcagggccgggtccgcggcggcggccgccatgagggtggtgcttggcgagagctccttctcccgtttccagaagattctagagccctcgcgcctcgctagggtttggggaattggggggaggagaagaattggggaattggggaattggcgggaatcgcttggggggataatgaccaagcggcggttttcccgcctccctcctttttcctctaggcggcagccagagagaccgggacgcaggggtaggccccacctgctctagatacatccatgtcactgacagtgggacccacgctggagcggtccggttaacccgatgggccacatatggcgcgcacatcacactcaggttctggcctgttccggcccaaaacgcattgccgtcccaacgtaagtcgtatgaccgttccggcccatcatatatcaannnnnnnnnnnnnnnnnnnnnnnnnnnnnnnnnnnnnnnnnnnnnnnnnnnnnnnnnnnnnnn

SEQ ID NO: 30473 - DNA, 2615 bp, Oryza sativa
gaagttggaaggcatcacaaagtggatgcacgagattgatcagcggctggattcccaaggtggcagtctcgagaaggtgactaccaaggtggatctcgccatggattccgtcggcaaggtgcaggttccgcgactcctccgccgttgaatccacctgttcctcctgtgttggatggggttgatttgggtcgtggttttggtgatgggatttatcggcgtcatcagccacttcctaaaatggattttcctcgtttcgatggttctgatgtgcggatttggttggatatgtgtgagacttattttgacatgtaccaaatcactcaaaatttcaaagtctctgctgctgtgtttcatatgtcgggaaatgtggctcaatggtatcattcttataagttagtgaatgaggttaactcttgggatcagtttagaatggcagtcgaaacagaatttgagggtgttgtggaacgtgagaaaatgtctgcactagatactctgactcaaactggtacaatgactgagtataaacaacaatttgattctcttgtctatcagatcagagtgtttgatccatctgtggggggtaacataaaatgttagtgactcgttttatgaatggtcttactgaagaaattcgagctgctgttgttgttcaattgcctgacactgtacagcaagcatctgctattgctcttatgcaggaatctgtcttggctagtagagctaccaaagctctcaaagggaaatttgtgaaacttcctcagtacaagagtgatatcagttctgatactgctccaggtcgagtagataaagaggatctatggaaggctaagcagttgaaagactatcgacgtgctcagggtctttgttttaagtgtggtgacaaatatactcctgaacatcgttgtgctgttggaggccaaatcaaagctatgcagttggaagaggtgctcactgatgacatattggatgttgttattgctgcagaacaatctgatgatgaggaggactgtcatatttctctgaatgcattgacaggagctcaccttcctactgctattcatttgagagcattggttcacagtaaagtcttgttacttttggtggattctggcagctctcacagctttattgattacaactttgcacagatgctgggtttacctctaaaaccaattccttctactctggtgaaagttgctaatggtgattgcttaccttgtcagtatgtggttcctggtttttcttggtggattcaggggcacacatttacttatgacatgagggtggtcactttggggggtcacgatgccatcttaggtagggactggcttgagcaatggggggaaatgtcttgtcattgggctaataaaacactcaagtttcagtatcaagggtcttggatttctcttcaaggagtacaagatgctgcagtcccttctgaaattgctgctgtcactctgccacaacttttgaaatggcataagggttgtgaaatatggactgctgctttgttggaacattcccaggatgatgtccagcatgtgattccttcttcagtgcaacaattgttaactgactttgacgatgtctttcacgatcctaagtgtcttcccccacacaggggttttgatcatgctatttctctagtacctgatgctattcctgtcaactgcagaccttatcgctattatccattacaaaaagacgagattgagaaacaggtgaacgaaatgattgatgctggtttaattacacctagtatgagtccctatgcatcacctgttttacttgtcaagaaaaaggatggttgttggcgtttttgtgtggattacagaagattaaatgctctcaccattaaaagtaagtttcctatgctggttgttgatgaattattggatgagctctcaggcactaaattcttctctaaactggacttgaaagctgggtatcatcaaattcgaatggtggaaactgatgaagccaagacagcctttaagacacatcatgggcaatttcagtttagggttatgccatttggtctcacgaatgcaccctccacctttcagtgccttatgaactcagtctttgcaccatttatcaggaagtttgtgttggtgtttatggatgatatcttagtttatagccctgaccttgatagtcatttgcatcatctttagcaagtttttgttattttgaggcagcaccagttgtttgctaagaggtctaaatgctcttttgcttgcactcaactagaatacttaggacatatcatttctgacaaaggagttagtactgatcctgagaagacagcagcaatgctggcttggcctgtgcctacttctgttactgaattgaggggatttttgggactgacaggctattacagaaaatttgttcagggttatagtatcataacacgaccattgacactcttgttgaagaagaatgcctttctttggactgatgctgctcagcttgcttttgatcagttgaagacaactatgagtgaccctccagtgttagctttgcccaattttcagcttcttttactttggagactgatgcatgggcctatggtcttggtgctgttttaagtcagcagggtcaccctattg

SEQ ID NO: 30474 - DNA, 2245 bp, Oryza sativa
aaactttgggtcctgttaatcagaaattgtccatttacgaaaaagagtttctagctattatgatggctgtggataagtggagatgttatctgcagagaggtccatttatcattaaaacagatcacaaaagcttgtgtcatttggatgatcaaatattggggactgaattacagcaaaaggcaatgactaaattgatgggtttgcaatattcttttcaatacaagagaggggttgataatattgttgctgatgctttatctagaatgccttcctcctctcaattttgtgctctttctgtggtccaaccgatctggattcaggaggtgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcgaattaagaaattatttgcttggcctggtctcaagttggatgttgaaaattttgtgaagcaatgtcaggtttgccaacaggacaaacatgaacactgtcggcttcctggactattagctcctctcccaattccaaaagaggcctggcaggacatctccatggattttattgaaggcttaccgcgctctgatggttataatgcaattttggtggtggtggattgttttactaagtatgcgaatttcattcctttgcgtcatccattcactgcatcacaagtggctcatctggtggacaaaactgtatttaaaactcatggcatccctcgttctattgtgtctgatcgtgatcgtctctttactagcaagttttggacaactctttttgctacttgggacactcaattacagatgagcacagcatatcacccgtaaacagatggccaaacagagcgtgtcaatcagtgtttggaaatgtatttacgatgcatgactcaggctaactctaagaagtggagccattggattcatttggcagaattttggtacaatacaaattatcatacatctctttgctgttctcctcataaggctctttttggggtggatcctcattattctcaagttcctgatctgacattggctactctgcctgatgtggtggatgttcagactgaaaggcagcacttgtctgaatttttacagcagcagttaactcgagcccagctgcgtatgaagaacaaggctgataaaggtcgttctgaccgtgtttttgctatgggtgatgctgttttcttgaagttacagccttatgctcagtcctcagtagttaatagaccatatcctaagttggcttataagttctttggcccttttactgttttggagcgcattggagtggcggcttatcgtttggatctacctgccagcagcactgtgcatccagtgtttcatgtttctcaactcaaagctcaggtgccagatcatactcctgtttatacttctttgccatccccagtggttcttaatgctgctgacattgttcctgaggcgattttggagcgtcgactagtgaagcgctgcaatgcagctcatgtccaggtgttgctgaaatggtcttcattaccagcagatcatgctacttgggaggactatcatgttgtgaagactcgctttccagatgctccagcttggggacaagctgaaactcctgcgggcggcactgtcatgaccggcaatggtgacactgagaaagaggtttaactgtgaatgatagtgtgtgtgttttgggctagactttatcaaatagaatgcggcctgcgtgccttaaatcgtttgggccaacggcccatgtaatcaggagataaatactcgagagagagaatggctgtggccaacctggcaaaagaaatcgaatctatctctctccaaactctgtctctcctctgcctcagctctgtttctcttcgtccccaactccgatctcgtctaaatatctctctctctcgtcggcggcgagtttcgcggtggcgtagtgttacatgaccacacctaactagtcactaattcttttcaggttgcttcaggagttcgttaacacttaacaaacatggggctgatcttaaagtgatttacagtgtatctggatgattaaaaaaacaattccacaggtgtaaaactcacttcaggccataaacttgaag

SEQ ID NO: 30475 - DNA, 11138 bp, Oryza sativa
  unsure (1)..(11138): unsure at all n locations
cacaggtagcatgcaaaatgaccggaacaaacataaataatgtctggcatgcactcatcactcaaatatataacatatactccctccattccgaaatataaggcacaaccccccttaacccaaagaccaagaaataattattatcatcttgtagtttggaactttggatcatcctaataaatataatgcatgcgtccaataggattagataacatgagagtgaagaattttaaaaagtaataatttaatagagaagatgttataattaattgcatacttgcatgcatgccttatattatggaacatctaagtctctaaaaaaaagtggtcgtgccttatattatggaatggagggagtatagaggaagagaatgatcttgtgtcagaagggagggcaataatcatctgttgacatgatatttgccaactaccctgaatactaacaggggaaaaatctcaaacaaatatcatctgtgaagacatatttcaaaatattcctcacaccctgaatggcaacagataaaaaacaaattagctcataaatcagcactgttggctatatgtggcatcaacctgattgtctgatgcaatgaaatactcaaactaatcaaatatttaataacaagaataacaacaataacagtaataacaacaataactataataaccataataatatcagggccttaagccccatgtacaatttattaaaactgagtggccatatgttcagtacatcgctgtttttcaagggccattttaaaatctcagtatatataatgcatatatgcgtgttatttcagattttaacttagacaaagacattttaaagctacattgctgaaacatacatgacaatcacgaactaaatcaaacttcatcataggataattagaaacaacactactgttgaacactggacctttttttacctatgatttcacctaggggcagataaaattgatgcttcagggtgcaatgaactgttgagctgctcaactggaacagatattgcagggctcaaatcaaagaagttataacccaaattgtcatctaccgccctttctccttccatggtcttcaccaccacggacatggatggtcttctactgctatcgctctgcaaacaccacatggcaagcttcatcacctcaatcacttcctccttgtgtaagtgcatttcatcactattcttgtcaaccagatcttcaagctggcctttctttgccttctcttgcagtaaagtaatgagctgaacattctcctctgactgagagtagtcaatgttctttcttccactgatgatttccatgaccacaacaccaaagctatatacatcaaccttctctgtgatttgtgaagtcagccattcaggtgccatgtatccaggtgtccctttcattcttgtcacaactttgcttatctccctctcgatcagctttgatagaccaaagtcagcaactttcgcattgaagctgtcatctaagagaatgttatgtggtttaatgtccaaatgaacaattctctgcctacactcgtcatgaagataagacagacccctggcgacattggtgattatcctcttccgcgtgccccaatctagtggagcattgctatgcaagtaataaatccacttgtctagtgatcctctaggcatatactcataaaccaggagcctgtgtgatctctccacacaaaaacctatcagctttaccagattgatgtgatgaatgttgccaattgtctgaacttctgctaagaagtccttctttccttgacctgctcgatccagcagttttactgcaaccatctcattgcctaattttcctagaaaaactgaaccaaatcctccttccccaagcttgctactgaaatcattggttgctgctttcagcatcttgaaggtgaacctcgttattgttccaggcaggtctgcaaaatcgctttcatcagctctttgtcgattacacctcttcctgatgaccattgagataatggtgagtgtcactagtgcagcggcggttgctccaattgcataaccaaaagtgttttttttctttgatggaggaagcaggtgtgtactctgcaccttgacgtacaatgttgacctagcgtttaccggatcttttgagtagtagcctggatcaagatatgcttgcagtgaaaggacttctggtagcaagtaacacgtattcagatatgacatagaaagagatagatccggatagagcaaagcctgagtttggttgagatacaaactaaacaaggcagctttacaggagcagttgctcaagcagtctttcttgcaactctcttcatcggtcattggtgcaccacggctatcgccccagagatggaagtatgtaacattaggaattgctacgagttggtgatcttgcatagcttggcaggaaatctcagtttccaccgcacaaccaagagtaggtctcatgttgtcaattggcttgaagtatgtggtattgggacaggagcactccgtagtcgagcagtccatgccctcagtggagcagccctcacttaagcagatgccgtactccccacaaacagttgggtattgacagtagtttaactcaaagatgtcctttgctatcacccagcgttgtttgaactcttcccattcatatagcctgagatgcccatctgactcaaacctcaagtactgaagtgagtgtgcaggtggcaatttggtctccagtggatcagatccagggattgataggctcccattcaccagagtcacaaaggttggtttgtactgatactgtgtgatgctttcatttttaaccagatatgacgaataaaactcaaaccgatagtatggttgaggttggtcagatccggcaaacgcatagagcccatcagaccgaacagtgaaatataactgtctgcttgtagtccagttggtggcagagctgttgggccttaacatcattccctccgctagcatctgcccagggagcaaagaatctgttggattttcgaacgactgccacaccggcatgtaggcatcattaaatagcaccaggttgccagagttggtgatggtcattccaatgacaaactgccctgaggtgccggtggaccagacaacgctgccatctgcatttgcaagaaccaaatcaccactggcggtgaagctcagggtggcgttctggtgtgccgcaaggtcacggttggcagaccacacgaccacagggatatcgccggagcctgaggtgatgtagacggcgaagaggatggcgtcgcaaggggaggagcagtagaagccggcagcgaaggacagtttctcgttgccattgcctgggacagagcagaggagcacgtctctagaggtattgctgctccagaccctggatacatttgcaacggggccaggggtttggtcaccaccgcatgtttgcagggctgcatgtgcggcagtgagaaagaggaggaggaggcggcctggaagagccattctcgtacacagcaacaaccatgtgcacgcaaatcccactcctttttttccttaaccccccaattagcgtataagaactaagaagaggactgcaattctctggatgctgctgattcttttttttataaggacttgtgtttttcttctttcaaaattgtacaactatctaaggtcagatgaccattgcactaacccagttgtattgctgtcgactgtcgtgtgccgtatgatagaagtattggtctaaaggcaacgtctttaaagaggacagaggaaagcaatgagagccaggtacatttcagttccttgtccatatcacatgttggtttatctcagcattgactttgaatattcttagtcaagaaacagaactagtggaacagataaaatacagattgttttcaaaacattaaattgagtaacagatatcgatgtagactagaataaatatgtttccacatctgatgttaagaactagtctttaacccctgcatagcatgggctattattataaacattaaaatattaatcacaatatgttggtaatatttagagttacagcagtttaaataaagtaaaataaaaatatgcctcagctacacttttctaatttttatattcaaattttggaattaaaggtggcacatgacattgaacacagattggatttagatcatgatggtatgatccatctaatgaattatacaattagtacatatttcctctgtttcacattctaagacgttttgggttatgaacatatgcatgcatagatctatgtttgtgctttatatatgcatccaaattaataaagatgttagtgaatctagacgaaggatgtagaggccaaaacgtcttataatgtggaatggagggagtagatatcagatcaaaatatctcttggaatggcgaaaaatagggaacatctatttcaagaatgttttgatctaagtaacagcaagaaattaaaatgtttagcacaagattagtgaaatactataccgaaattctggaagaggtaatgttgaagaagtcatctgtgcctcgttctctttactgtgaggaagaaaacctatgattatatgacatattagccatcctatcttttcacgaatatgcagttgagttgagcacacctatacatagccagtgcaggccaccacattggtcgcaagttagttggcttaggattacaatagttgatttaactgcagtagaaataagttgtaggacttgttaattagtcggtcaatttaagtattgctgtgcgtatgaataaagatcagccaggataattaatctctaatatcttgttctccttcctccatgtgcgctccccctacacattgctgctaatttctagcctgagatgtgaacgtttataactcgtacttaaaacatgaggtttgtcaattaacctgggggcacagtggatataatttacatactactgacgcgtgacgactatattcaccatccaaataacacagatgtctatttcacatgctaaaagagttccctatttccaacctacatcttacgtacattcaaaatttgaatcactgcagtgcttttattgacataatcatcttaatatcattgcgagatggataaatgacgatcagcagaagttaaacctgttagctaggggcaaccaacaaaatggtgcaacaaaagacacaaaataactgaactgaaacagtactaccatttctagtcaatacacagattaacttgggtatgcactgatcgatgtgtgatatcaatgatatgattgcagtaatacagttcacaaaaatggttttctacatctgcatttgcttcaggtggaggcatggagccatgcagtgacatcttgaatgggtcaacgggaacataattcgcaggacttaacaggctaataatctgaagcgcatggatacaagttatccttggaaggaaagacaattccgaatccgctttgtctacaaataaggaagctataagtaatgcaaccatgaatctcatggnnnnnnnnnnnnnnnnnnnnnnnnnnnnnnnnnnnnnatcaaagaagttatagttcaagttggcttcaacatcactttctccttcaaggaccttcatcaccaatgacatggaaggccttctgttgcaatcactctgcaagcaccacattgcaagcttcattatctttatcacatcctgttggtgtaaggacatgtcattgcacttcctgtcaatcatatcttccaggtgactgttctgtgccttctcttgcagtaatttaaggagctgaataccccctccaagattggaatggtcaaggtttggccttccattgatgatttcaatcatcacaactccataactatagacatcaaccttctcggtgatatgagatgttaaccattcaggggacaaatatccaggtgttcctctcattctggttgtcacgtgactctggtccctatgtatcagcctagacaatccaaaatcacaaactttggcattgaagttatcatctaagaggatattttgtggtttgatatccagatgagcaatcttatgtgtgcactcctcatgaagataagcaagggccctagcaatgtcggtgatgatattgcgccgtgtgcgccagtcaagagtatcattgctgtctttgtagtagatccattggtctagtgatcccttgggcataaactcatacactaggagcctgtgtgatttctctagacagaagccaatcaacctgaccaaattgatgtgatgaattcttccaattgtctcgacttctgcaaagaattccctttttccttgacttgcttgatccaaacacttcactgcaatcttctcctcacctaactgtccactgaaaactgaaccaaatcctccttcacctagtttgttgctgaaatccttggttgcaagttttaacatctgaaaactaaaccttgttggcatgccaggtagctcagcaaactcgtcttcgccatctttgtcttgctgacgcccgtatttggacaactaccaagacaatggtgagcatgacaaagaaagaagcaactcctacaagcacaggaaccaaaggtactaatctatgtttttccaggtgaggtgaaggtgtgatctggaccttcaggaatgctaaagaatcgtatcctggataacttgtcttaagtgagaggacttgtgataccaaggtacagtctccagctgatttattatcaacataccaaaacaaggcagccttgcaagagcaagtggtcaagcatgcttgcttacagctctcctcatcagttagttctgaaactctggagctatcgtagtataagtatgaaacattaggtagagatatgagttggtgatcttgtacaaactggcaggagatcggggtctccagtgtgcagccaagatgtggtctcctgtcatcgaccggtctgaagtatcgaatgtgactttcagttgcagttggacaggagcacagtccattcaagcagatcccatactccccgcagacagttgggtaatcacagtactgaaatgggaaaacgtcctgcacatatagccatctaccattttggtctgcttgccattcatacaacctgagttgcccatcagattcaaatctaatgtactggagagacagagccggtgattgaagggacaaagtgttccagatttgcagatgaagaggatggaacaaatatgtccaagctcctgttcgccagagttaaatacgctggaggattctgtgacttgtttccagttgacactgtgaactcatagtagggctgggagttgctagatcctgcaaatgcatagagcccatccgaatgaacagttaaataatacaggtcgctggcaatcagatttactgccaatgcgttaggcttcaatctcattccttgcaccaatctctgtccagggagcaaggaatccgttgggtggtcgaatgactgccagaccggtaagttgttgtgattatacagcaccaggttgccggactctgtgagggtcattcctgcaacagactggccggaagtgttggtagaccagacaaggctgccatccggatgctgaagaaccaggtccccctcagccgtgaagcttagggtggagttctgccggatcaactggtccctgttggccgaccatacatctgccacgggttctgggcgccaagaggtcatgtctgcaaattcaccggcgtcagtaacagtgtagactccaaagatgtaggtgttaaccagggggtaattgtagaagcctgcagcaaaatgaaggttgtgattgtctggtacgggccggctgagtagagggttaacgacgagaacatcggttgttgggaaagtgcaggtccagatggtggacaggttcgcggagtgtcctgggctgtcgaaacagcaggtttggagggtgagaccagcggtggtgaggaagaagatgaggaggaagcttacaggagccatggccatgcctggtacagacaatagggtgcagctagattttcatgcttgtattttgaagattaaagtactgcaatctgcagcattgctttatctgtcatctgtgagttctaattccttgtttgttttccttgacagagtgttcaggccggcaatgagtcacattgatggatatggctataggaagcttactaatggagtattatcgtgtgggacggggttaactgaccaatcaacaaggaccaaagtggcttgtgttttcgatgtctccccgactttgctccgactatcaatcatgtggcccgtggaagattcacaaaccaacggccagcggttttttacggggttgacttaaagtcgttagtttttatcatcttttggtcggttttcgttataccagtggggagtggttttcattttgtaaacgaaaaggtaaaccttgcatagaccgttacactttcaacgaagggacctttgtgcatgaactccctgtacagttccccctcagctatctggcagtcgatgttggctcgtgcagataaatccatgtacaaaaaggttaaggacaaggcaaaaattgttaggatgtatagatcgttgtacttaaaaacctttgtccgttcactttgtgtggaattgagatcacctgcatactgcacttgctatagccactgcaacttgagcagtcatataagcaccgttggattgggaagtaatggccaagatattactgggcatatttgacaaatgctgtagctgcgtatttcccgtagcgagcactgtagcagttactgtttgaaacgacgtggcatagatttaaaccgttgatcgtcttaatccaacggtgaaaaatgattacaactgcaaagttgcagtctctattacaactgcactggaaccatattcctttgtgtgtgtatatgtccggcagcctgcactcgaatcccgatgttgactcgcgcaaaagaaagtccatggataaataaggcaaaagaaagtccatggataaacaaggttaaggacaaggggaatatttgtaagcacccgatgttcactctcgtaaggagtgaagtgtacaggcaatttttaaatttgtacggacatgtcatctaggttttaaatttctaagatgtatttttgcgtcctcgaatttattatttgtgtcgtatatgactaaacaagtttcaacttacttcatgtgttgatgtggcatagcacagcggtgcatatatgttagtgggacccacatattagtaaaaaataaataaataaccatctttttctcctctctctctctctcctttatttttattttttatcctctcttttaatttaatttttttatgactagcactttggtccaccgacacgtaggcatcaacgtggtgtgccacgtccgcacatggagggttggaacttatttagatctatatgacactcacgacaagttcggagacaaaaaaaagtatattttgagatttcagagacttagatgacactctcacaagttttagggactgctcatacacttaagtgtatgcaggttgttacactgaataaaccaacaccctccatccatggttgatgactttgtgctgatatgcatattgttcttcccgataggcaaaaccaatgaaagagtaccaccctctccatccatggttgctgactttgtgcaagagtatatccatccaaaatcaaaaagaaccactccccaatattatacctttgtgttgtgagttagaagttgagaagggatttgaaaagagaagagtttgggggttgagtggttgagaagagaagttaagagctagtgagctttactccaatctttgagcacttggattcatagcaagcaaatcttcgattgtgtttgttactcttagaggttaagctttctagttagcagagcgttattcggtgaacttccaagtttgtgaaggtttccctcaccttcgtaaggaaagaggtaatttagtggaaaccaaactattttctaggagattgcatgttatagcaagcttcaccggtggatcagcgctcatcatccatatttggatcttgagtcgtttggagacttgctaatcctaggtggttgcttgaaacctagatttccttggggttgctagcctggtaagggaagtggttgaaagagacaaattctttcagagtttcctcaacgaagggcggaagcagaagcaactaccccctccctacaatgccgtcaatcctggtcctcgttgcaaacccgcatgcgcaaccgccgctgtgatccgtcacctagcccctaccacagccataaggatcggtcccctaacccctaccacgactgtcaccgttgcgagcggagagtggaccggacatccgactgtgagggcggtggagctcctaggttgccccttctaccgccactaggaaaaggtggacgatgtcgcccgggacaagatcgacccttgcgcggactccgctctcttgttgaccacctcgcgttgcactgggccagcctccactaaactggtccgtcaccctcgctgcccgctctgaggggctcgtcggccaccggcacattggctagcaacctcaaagcttggggtgggtccgggggaagaaagagaaaagaaagatgggaaaggatatgagtaggcgctgacatattggcttcacaattgcttttcttgttacttacatgtgggtttcatgtctacttttaattctcctagtgactggactgcaacatgaatgtcacgttagccaaaatcactccccaatcaatcgagggagtcattatatatgattttaatagttagagggatccatatatccggttttagtgttgagagatacgaatcaggtctatctgagaaagccaagttaaattcaactttttcctcctaaaataggaatgttgatatatgatgggccggaacggtcatacgacttacgttgggacggcaatgcgttttgggccggaacaggccagaacctgagtgtgatgtgcgcgccatatgtggcccatcgggttaaccggaccgctccagcgtgggtcccactgtcagtgacatggatgtatctagagcaggtggggcctacccctgcgtcccggtctctcgggctgccgcctagaggaaaaaggagggaggcgggaaaaccgccgcttggtcattatccccccaagcgattcccgccaattccccaattccccaattcttct

SEQ ID NO: 30476 - DNA, 16573 bp, Oryza sativa
  unsure (1)..(16573): unsure at all n locations
nnnnnnnnnnnnnnnnnnnnnnnnnnnnnnnnnnnnnnnnnnnnnnnnnnnnnnnnnnnnnncaactaaactccctatcaatttccatcacctctactaaacaagatattgggattaaaaatcaaattcccatcttaatctcatcatcaattccttcgtataaactggtccccttctctcgtgttaccaaacaagctttatctgtttctcggttcaaggcattcgaaagaaggaaatatttgggggaaggggggggggggggggcgagacgatttctcggtttctcgtgcgacttgtcttactgttcttgccagttagggtttgcgtttcgtttgaggtgaaacttagggttgctgggttttgttttggctatcaatgttcatattttgcggtaagcttagaaaagcaaaaagaaacaagcaacaaatgtgccagttcgcggtggatttactgttctgagttgacacgtctgcttttctttgttgatggctcggtgcctattcatgtgtatgtagggagtaaaagtgtttccatttttccatgacaaacttagatttactccaatcatttggtggaggattaagatttgcctcagcctctttgtcaaattcaacaattttgaagctggtagtttgtgtagcttgggaaacacgacatagatgtgatggtggagtatccaattagattgctgtatatcatgtgtttattcacataatgattaaccaagtgtgatactgcagctccacatggccataggatgaaccagttgcctgtcctttctcttaatatttttgttacttgtttagtggttgatccattggagttgttggatttatttgcctggcagacagtgtttcaacaattggtatgtatgtttttgacagatttcatacaaatggctcagcaggaacttctcagtatcatccaatgattcaaagaggtaaaggtttcccttttatggatatttcccttaatcattggataaatgaaacatcctaaccacaactaactagttactaattctttttaggttgcttcaggagttcgtcaacaaacatggggctgatcttaaagtgatttacagtgtgtctggatggttaaagaagaaccccacaaattattgtgtaaaactcacttcaggccataaacttgaaggtaatgtcttgcctcaggtttatcatagtatagtttcccaatttacagtatacccttttctgataaatgttgaatttgactgaaaagtggagcatttgttttttttttctttatgatgcagaagcaaggcaagaatttaaagattcttgttcagttcaagtgtacagtatccaggcttgtattccaaaagatactgctgtactttggaatcctgaatttgtacaggcagaggagctttttaaccggccatttgatgaagaaaattgtttgagagataataggtattgttcttcttagtcaccttgcttagcccccaaaatcaagagaagacataattagataggagcagtacagaatgggtcagagtgggagggagggatgtaatatacttatattaaacagcaaaaatataaataagaactatatggtgcaaaaaaaaaaaatttacaagtatcccaatgtttgccacttatttccctcatcaggattatgaattcagtatcttctcttctgcaggttttgtggtgttttgaattcttttgtcaagcgaactgctaatgggaagcttgtgagttcatttccgccaaagcctataaatagtgttgctgcagctgcaccgttgaaaactagtagtgctccaaaagaacaatctgctaagggtcaacagcaaggtctacctggatcatccagtccaaagaaaggaacaagtaataaggctgagaaggatatttcctcggtcttggataaagccaccaatgctcctgttgtcaaagaaccatcaattgctctgcagggaaacaaaaacaaggctcagaatgggaaggcgctgcccagtaatggtggatcacttgctacgatgtggggacgtgcatcagctaaacccaagactccagctaccactaatcctacagttttaccaagtgttgctggtattgcatacaaacattcatgtttcttttctttgttatattttcttgcatgttaattcaaatgcatacctaatcatgtaaaatcagatatgtcaagttaagcatacttctgaagttctcatcttgttgctgttttcagttacagctgatgcacaaatatgtgcaaaggaagaagcaaatgctgatagtagtgatgatgaacaagctgtacactacaagcgtggctctagtgcaaataacagaaagagaagagcagtctttgatctttcagatgatgatgaagatgacaatgttgtagccattgcatctcctgagccaccggaacagtgcattacaaatcctattgatgaggttgctcaagaaagtaaccccaaacaagaaaacttggaaaataaacaagaggttgagaaggatgtgaaatgttgcataggaaggacagagtctcctgagtgtaaaaccaaaagtagcaacactgtcagccattctgggatcaccttaaaagaaaagaacaatggtccaccacctaatgacaataagcaggatcatgctgctgagactgcttccaactcacctaaaagaaggaaagttttgaagacacgaatagatgagcggggaagagaaggtaagcattatactctaatcccataaagtatattacacatgtttctaatatgccaatattgtttacttatgtttactggctaccgcaaaaacaaaggcaaaactataataatacaaatgcagtaaaaaaaattatttttcctgtattgtggctagtttgtgtcttttttatggaaagcatggttatgttgtgttgacatgttgtcctatataacaagggaataaaggcagtatgcagttcttttgaaatagtaaggatagtacagaaaagtgtagtttagtctaatatagacgaacgaaatagtttacactatagtgacgtttagtatgtccagatttatttatagtcaatcttctagttttaagctcatgtaaggaaatcatggaaatggtgcttttttccgtattactttgggtattactttgggtgcatggctgcagtgctgcatgctcacaatgcctacagaatattaaggtggcactgatatgtgttaccatgtattgtcagaatattattgtaacatgcatcttagtttaattccctggtctgctttacatccgtattaattggagacattgattttcttacttgcttttctgtttcagtaaccgaggttgtctgggagggtgaagcttctgcaggtgataaggctgagaagaatgtgagcgatactggtgctgcaaacaggtaatgtcttctgccgtgtttgatgaaatttgatagctcattatagtttcaccacattcagcgtcagtttcttttatatttttgtaccactaacgacctgattagttttcatgtattaatctccattgaattaaagacaacgtggttctgactatatttgccactatgggcatggagtattacctaatccctaggtcttcttccgttttgtggaaatgtttggccctgtagccataaataatctgtccagtatgaagctgtaggtatggtatggagctggccatagagtagtaggagaaaatgtagtcatctaatcaccatcctgctgattggtaccttaaacccttttacatcctatatcttatctacaatagcaatccaatttgtttgtgaaatattgttcagcctgctttcctgatctctttgcacagctggggaaaatatgtattgcaaaccatatatgtagtggaaatctaaaaactagcatcggatgtaaaaatagacatctgattgatttgttctcttcaagtcctaagtactagctgtgttggtgcatgcaagtatgccatctaatctgatttcaacatttttcctgatttgatgtctctatcttaattagtttgtgagacgactaggcaacttcagctagcgtgtcatttttaacagaactccctcacaaaaccaacgtacctgatccgattggacctgctgataactattgttctccttgcattttctgtcagggcaactctctcaagcaagccgcagccagtagcaaagaccgaaaaaagcaatgcttcgagtaaaacagccggcaacaagaaacctgccaaggctggaaccaagcaaggcaacattatgtcattcttcaagaaggtataagccttctcgcttatctgacagagttattcaggaaggagtatctgttgttgccctggctaaagctaccgtgccaagctcccaggcaactgtagtattaattgattcaagtaaacagaccagcatgtttcagaattcagaagctcacttgctgtacatatcctgtgtgattttgtactggtactactacccatttttcagaattctgtatgaattctgaagatgctgctggatgagtatggcaacgacatggcttgtgaagtttgtactgtaggctgtatgcatccaggcacccgtgcggccgtgcctttgtcacttcgccgtgtggtcagattcaggtatgggcattgtagcctagtacgtgtacacgtgtactagttcatgggatgctttgcttgttttccctgacacatgcactgtacatcacctgtcagctgcatggtccatcatccatgacataccaggtcaacctcatgtagaaagttaaaaacaaacagtcatctgttaataacttttgcatcctatatctggtttgatagccgctctctggtcgccaacaagtaaagcagatgagtacaacgtaagtaaagctctactactactataccagcagcagaagtatgatcttgccgtctcgtatttaatcttttctcctcctctgaaagttcgatcggcatgtacactgcgtgttctacaagacaagctttgtcagcacgacagtgtgtgatcgagcctcttctccagttctcctctcctttccgtttgccatgatcatgtcttcccatgattacgccatgttaatcctacctaaacaccgatcctaatctcgccggtttactacttatgaacgaacacgatctgtcatcatcgtcgtcgatcgtcgagatggtgccttaagacggcagcaaaacggcagagcaatcagggaaagaggaatttggattctaggtagagagagacagacaccaacgtcacaactcgattggattctactacattgacatgatacgtactagagtgagacctgcgtgtccgtccttgtgttaggttacagaaaacgaaccgtctcgaggaagattacgagctatatagcgtagttaggagaaaaaggactgaggtaggattaacaaactcaagaggaacatgtaattaacccaaactttgcatggtaataatcaattcatttgtatgatgacattggaggagattagcatgatgactttggatgaatcgtatgatctgtccaactcaatctataggctttactaattaatactccctccgtcccataatataagagattttaagtttttgcttacaatatttgatcactcgtcttatttaaaaaattttgaaattattaattattttatttgtgacttactttattatctacagtactttaagcacaacttttcgttttttatatttgtaaaaaaaatttgaataagacgagtggtcaaatgttgcaagcaaaaactaaaaattacttatattatggcaaaaactgaaaatcctttatatcgtgggacggagggagtagcatgtaataacggatgaagatgatgatcgggccctgcactctgggacccactcaagtgttaaactcaatttgggatcgccaccctgtgggctaccggatggatatgcttcgaccaactctgtccgtgggcccacaaagcccatgccacgtgggtcccggtggcggccacgtcacccgtatcgtgccgtgcaagaaatttttttcttttcctctgatcgtcgaagacaggaagttctacggcggtaaataccagtacaagttttactttttcaaaaaacgacactacatgcctttcaaattttaaaggaaggaaagaaccatactcatactcatactcatagctagactttatttacctttacatggagcatttaggataatgaaatgtccgtggtagtttcgttaatctcaagatagccggctcagtcttttagagatgttcatataagtagggtatacgttcgtatagatgaatatgcacacgtgataatatacgcttatattgtattataagaaaacattagttttcacataaattaattattatacagagtaatcccattggcagattacactacagagcgaggcccttaatcccgtctgacaggtggggcacacacatatctctccgtgggtcatccactcctagaggcgctgagctggatcattttgggcaggggcggtgggaacgctggcccacgagttgggaggtggaccccccgggtcaggcccacacgtgatgggtcagagcggtgcatttgcacatgggccgcctagtgccgccaggacggtcagagcgcgggccccatgtgtcataaagagacagccacgtaggttaggttaggttaggttaaacgccccggattaggggacatgaatacatgatgccccccaaaattttttgaccctagcaggtgggccctcgtttgagccttgtctattttagttgtcgcattgtgccgcatgtaatcaggtatgtactgctccgtccaaaaatataaaaaaagtacttcctcctatttacaatataagtcattatagtatttcccacattcatattgatgttaatgaatctagataattatatatgtctagattcactaacatcaagataaatacagaaaatggtaaaataacttacattgtgaaacggaggaagtagaggtttttataagaaactatgaaattagcatgtaaaattaaatggtgaatgattagattggttgagatgagagtgtgtgtatatggagaataactatattttttcaattaatttaaactcaacaaatagctagtaggatgtagggagcaattgactaataatcgctattgggctctatctcaaaatctttcaagtaatttcaagcatgtttttttttgaatggacaacgggggtaatttcaagcatgttaaaggcccctttgatttggaggaaaaacataagaatttttagaggatttcaatcctataggaaaatttcctatgaagccctttgaaacaaaggattcaattctatccaatcctttgaaattcctatggaatggataatcctataaatattttggaggaaatttagcaagagcttcaacctcttgctaactttcctttgagtctatctctctcacccaattcctgtgtttttcctgtggttcaataaaacggtcattcctgtgtttttcctgcgtttttcaatcctctattttacacttgcattcctattaaaatcctacgtttttcctatttctacgtttttcgcatatgtaatgtgtgttctatggtgtgatactttagcagtgcatgcctgagtgtgcgtcttgaaagactattaaacgacgtaggttgttcacttgttcttgtggaaaaactgaagtgaggacagtctatcaacacatctgtaaagaataaaaaacccttaatatttttttgtctcaatcaaattttacgaaggcaacgaacttctcgtcaaaagagctaacctccatacccggtgtttggaagttggaacggtgccaatcaaaggttagttgagaagtcaccgtgaatttagaccatttctgcgacaatgtcatgtacacatccgtcccattttaaacgcagtcacgagcttctgtgttcaactttaattatacgcattgtttgaaaattgtttgaaaaaaataaaaaacatcagtcacgtataaaatattaattttgttttatcatctaataacaataaaaaaactaatcataaaaaaaatttcaaataaaactcatgactacgtttaaaatggaacggagaaagtaattaccagagattgtaccgttgcaacacttttcaagattgtgccgtgaatttagagcccataggttggcctaataagccaaagcaaaagctaaaattcaaatttttgaacctgaagttgattttaagatattttcaatgtaatttctttttatattagcttttaaatcgctacaaataaatatataaaagttttatctataaattaatttttattttctaataaacctttttacttaccagagagcatgaacaaccaataagcttcctagaccatttttccgacaatggcaagatgcacggatggcttgggacgtgattgtaccattgcaacgcttttcatgcatgagagcaaagagagcgtgtgccatttttgggcttaggacaaccaattacacatgcaaattcttaaaagagaaaaaaaaaagagcacacatacaaagtggaaaacgcaggacagggaactaggcaggagccagcttttctcatcacattttcagttctccccttgtttggaccatctgttcatgattgacgactcaaatgcggctataattcctctcaactttcataccgtttagtccttcgatttttctctcgggcaaactagggtatcttttatgtattattaattgaatcctttttttaaaaaaaaaaagaaaatggcataatcctgagcttagagactttgcaagttagtgtcctgatttccagacgatcctgggtagctgttcctgctagtctcaccggctagccacctcactatgatgtcttacatttatgatgtattatatttatgatgttcgacgttcttcataattgtttatgtatgtatctgttcaaaactaaaaatgttgttggttacgactatgacagcttgttcttcgtagctcgttgccagctgaatatatgatgtaacaatagagagattaacaatcagttattgctgataaagccatacatcgaattaatcaaaacatggagccggccgctttgcatatgcatgtcatcagacaaaatcaaatgtgacaaaactgcaaactctttttgcctgaatctatatatccaatctgaatggaagccatgatttgctctgacctaatcatggggaggttggtagcagctggttgttgcgtgatatgctcgacgagatcgatcagccacacagatgtgagattcatgcacataattctccaagatcacgtaccttgcagtcaaagcatatataataggctaattaatcctgtctcttagccctgctcttacggaggtaatcatggtgtaaaccactggaccgactaataattcgaagtgccccctactggttagtactagtacttaaactaaaatgcgacacacgccgtcacatgatgaacatgattattattattatttcaaaaaagaacaagaacatgattatacgtactgaaagcaaatgcattataaatattaactaagttgtgatctgtttcaagattgggaatgaactaaaattaatttgcgcacaactttttctctgagctaacgattggcaggcacactgagcaagagttctttctccttttacaagtatacattatattaaatatattattactgcattacttttaaagggtttagattatagtatatggagtacacgtttgttaagaaaataaaattatcagaagttatcaatcacaaagaaactagctagttaaataatttaatctttttccatctagttgcacgagagtcacactcatttctcgctttcagtccatgtcagacaaaagagataaaagtatcccgcattaataaaacaggaaggaattgtgtgctttccctttaatcacgatcgatgcagacattttgatttacaaagttgcatatttgttttgtggttggagctgtatatatatagacacaaatactacaacagttatgacaaagttgctttgccgactacaacaaatttaggctttaactgtttcgtcctcttggattagttacggtgtcgcttgcaagttcatgatcgagctaccttaatgtgatcctttccaataaatctactaatctaaaaggtagtgattgtcaatgcatgaaaaatactgtatctttgacacaacgagctgtatttacacatcagaaagctcacgacctcgaagacgatgatcacaacacgttctagttaatcaacatataaaaaacaccatctctaatctttcttttgtacacacaatgctacgtactccatccaccatataaaaaaccaatctagtaatctggacatgactctctttagatcatccgtcatataaaaaaccaatttaataatatggacataactctctttagatttgttgtattagaatgtatctttttttttacaggacgagggagtattgctttcaagaaattaattaattaacacatggcggctagctcccatcaaagcaagtaagcaacacagctgtgttgatgtgtacacaaatgttcgttctgttcacctaaagcttaaaactggtttggctccgagaaacttcaacggaaagcagccggttgtgatgaatgaatcgcaagcgaaatgagtgaccaaatgtaaaaacacctacacactcacccatgaaaaagcccatgcatggaatgatttgatcggattccaagtgtttttttaaaaaaatatgtttttgattgctttttagtcttaagctagctggtcatgatcgagaggtaggtcggggccccacatgacaggctcccaaaaggcaaagtaccacattttatggggtgggcccacacgtaggagagccccgctttgagatattctcaagtgcactcaccttgggaggacccaccttgcaggtcatctcgtaggccatcatgctgggtttatcttttttatttttctccatttatccatggcttttaagcttgattggctacaaagacaaagaaaggtaggggtagaggtaggtgaagatgaacatgcatgccctctctaaagaaacacgaatgaaaagaaaaaaaaaggggggctttgcattggtttagagtttagataatgttggatactccactaatgtaacctcacaattcacaagattcacgctaggagcctaggatattcagggagtttgttggtcagtgtgagtgtgaatgatgagtcggtgcgtttgaactgtccgtttggcttggctaatttgcttcacgcaaaaagagacagatcatgaattattcattaagtattactagtaactattttaaacatgaaaaataaatttatataattttgttttaaaaactttaaatgtaaaatatatcatttattagtttgagaggcatactttcttgaccccatgaagaggaagatatcctatgcacacaagtttctagtgcacaccaactatcaaatgttacagaaaattctagaaaaaatagacacatattttcaatagtactacacctagtatgaaatcttatcttcaattcattatattctagacgtaacaaaaaagtgaaaaatctgacaattttaagagtaataatctgctggtattttgttttattgttacggctaaaatataatgaattgaagataagatttcatacgtaggtgcagtactattaaaaatatgtatcctttttctggaattttctataacatttggtagttggtgtgtacagagtttgtactagaaacttatatgcataggatatgttccgccgatatggagtcgctcaaccaagtatctgaatcaaactcagccgtcagtcttttgccatcttgggtatgatcatgagcacacctggctgatgaacagtttggtgaatgaatcgatggcatgctggcatgcatgctgaggggtttgcccctttttgattcttttgaaggagcattgcattgcaagatgcatgaaggtgccgagatagctcatcaaaaggtgaccaacgaccaatggcatgcatccatgatccatcaatggcgcttcacctggcaagctccttgcagttgcagttgcacgcacggggaggaactcgacgaaaggctgccaaaatcgcacaagacaagctcgcacgtttaggtccccatcactgatatgagcgacagtgcgccactggtttgcattctttcataacttttcttggtttattggtctttgttgacttagaccgaagatgtaggttatttctattattaaaaaacaaaacaaccgacacaattttaatatttataaatacgataaaaagtaccttaaaatcaaacctaaaattaaaatttaaaatctggttacagtgaataagataacaagcaaagtgaagctgcaccacaaaatccatttccgtgttgtaaatcaaacatgctatcaaaattattttctaaaaaacacattacaaatacaagcgtccatgttaatttggtttgatgccggacaaggcaatggcttaattcttcacgtgaaatcagggacggatatagcgtgggtattgaaggagggagggaaaaggaggaagaagaagatagtcctcctctatcctattctagatccgtccctgtgtgaaaatactgtagtacttctttaaagttaacaaaatgtaacacaacgactgaaatcgaacctcagaaaatccccgtgttgtatttgaaaagaaaatatgtcggggaagctgggtgtatcatatcagcatcagtatcaggctatatatcagccagcaacagacaggaagtattcttcccggttggatcccttcaatggcggacgcgtgcatgtcaaagcacgaaagcgaccaccacaagagaagagacgacggtgccacactgtcagtcttacacaccgcatcatgtttccaactcctgcatgcgtatcgccgttctgctttccttttttttttttttgggtcttgtctttcttctacaagtgccaaacaaaattagttaggtgagaagcagctaaacaggggaagattaagccaagaatcttaaatcttgggaccccgtacttccagcaaagtgaccccgtcgttcccgttttgggaggtcataggttcaacagtccagtttggcagtacgaactctgattcgaggactgtgacacaatgtctcgtgtttctccctctcattttcttttacacttacctccttcgtcccataaataattcaatactaattatttttttaagaattacacagtacaacgcagacactcacaacacacgcgcactcacccctataaacacacgcacgcaaaccctatctctatgagcatcttcgaagactgggcctatgaacacacgtacgtaaaccctacccataaataattcaatactaattattttttttagaattacacagtactacccataaataattcaatactaattattttttttagaattacacagtacaacgcagatactcacaacgcacacgcactcacccctataaacatacgcacgcaaaccctatccctatgagcatcttcgaagactgggcctatgaacacacgcacgcaaaccctatccctatgaacatcttcgaagacagggccggtaaattctggagagattgacgaaataaccacagacgtctagttgtccaagggtacgtcgtctatctggacaagcacaacgccgttaagtcgggaaaaatttgctcccatagggagtcgaacccaggatctcaggtgctactgaggctgttgtaaccagtaggctacaggtcttttcgcaattcaatactaattatgaatcttaacatatacatattttgatttatgtttagatttgtagctaggatttatttttttttttgacagagtagtattgagttgtttctcatatggatggttgttttgaactctaaacgcaaacttgatacaaccatacaggtattatcttaaagttattttctttgtattagtcacatctctttggtttggagtatgattatggaaaatgtcttggaagtaggttaaaggaagcttctagcggttgcatcttcttttataatcagatcttttcacaaacatttttgctttgcatttagattttaaaaaaatatagttataacatttagaaaataaattagaagtcagaatctgatttccctatcttctccgaactcatcagctgattcttaaaatatactctaaatagatcgtaatatcgagtagattaatgctggcttgagattcatgtattttaatacgacaaaaaagagtactattaaaacagggaccggaaaataatcgtgcatgttgggaacgaacccacatttttctccacggtcgtactccagacaatgtgatgatgtgagaccagtgttacatgactttcaacaagtaacagtcgatagtactgttacttgaaggtggacacaacctatccggtcccacatgtcagtaatatgtattgatataggagtagtacgtactatcaccgtcaaaagtgaggtaggagtgcaatataaaagtggctggtggtttaccaccagctttcgtccactgatggaccacattgcggtcaggccgtaacgtaaaatggaatgaccaaaacagcccagttgttttttttaaaaaaagacccattggttaagttaattactgctaggactccataattattactatctcaactctcatgcagcagcagcaagcaggtagaaaggagaaacgagaaagcacatgcttaagaagcactggtctagaaaaagaaaaggagttggagtactcaacaactgatctggtcaaattgatgagtatggaggtttgattttctttttcctcggtgatacttgtatcagaagcaaatgtgtgtgtaaaccaggcaacacaacatcacagcaatgacaagtactcgtcatcctcttctctgcagcgatcaccacatggcataaatgataaatttgcttggaacaattgaggccaaacgtgattatttcttgaatatttttccagtaaaaaaaatcaaactaaaccttcaaacaactttgattgttctttttcttacagagaaatagatgtttcagccattagcatggtgtcatgctataaacagtgccttagaacaactgtccatgatacaatgatttgagtgatgtaagatcagatcttcaatatgacacagtggaacaacacaaataacgtacagtaacatttctctggcaccacaagaaggatggcacggccgaaacaaaaacagtgacgttttagcttgtgttcatttggggttaagaacccttcgctctaaaaaggagcaacaaattaacatctaattaattaagtatacttaaaaaaaataaaaagtagattaaaggagccattgtttatagcatatttataaataaaaaataatttataaataaaacttttatatacgtgtttttagtattctaaaagtaatactaaaaataaacattgatgaaaaaaacctcaaaattagctctaaatttaatattgaaaatttaaattttggatgataagcataaacataagtcaaaaaataaaaagataaggccctaattttcaatagaaatttgagaaacgtgtttggaagatgtgggaatagacggttcagttttaaaatttatttctaaagattcagaaacgccgtctaatagattttctgaataaaaaaatgtactcctaccagcttaaaaacatatataggaaaaagagagagagagagagaaagaacgaggaaatcgcttcctgccgtgtgctccaccctcgtccatcgcgtgccacgtggcgtggaaggccggaaacccggaacgggcggggagggcaatttcggtacaccaccctgggtgcattgaattgaattcccccccgaaataaattgagccggagattttgaggaaggcgtggaaaattacagaaatatttttttttgtgttgtgtcttctcggctctctcgccattgccgccggggcgccgcctcctcctcctcttttttcccccgctggtccggcgaatacggcggcaagccggcgccggtggagacggggtagcgtccggcgccagactgcgccgacctgggtgaccgactgaagttgaaggtgaaggaaaggggacgacgacgacgtcaggtgtggaggaagtgacttgcaaggttgccggcgccgcgtcttccttcggagttcgtactcgaggggcgtcttcctccctagaggagtgtacgcttcttctcccggcctctacggtgagtcctcctcttctctcgcttttttttttctgtttctcttgttgtttttcgattccttccccgtggttggctcgcttctctctctcgctcgtgttagttggaatccaaggcgcggttgatgatttgattggaccgtagctgatctgcggatgcttagtttttcgtcgggtttggtagagagaggctgcttcgatctcgcgttttttgactttgatcataaggtttacccaatttgaaaccgatggatttggttgcgtggatactatcaaactgcttcatggctcttagtttgt

SEQ ID NO: 30477 - DNA, 5672 bp, Oryza sativa
cacggtataccatacgataatctttaaaccgggagtgactaaacggtttggtaaacctgttgaacgctaattgtttgtgtttctaaacggtttggtaaacctgttgagcgctaattgtttgtgtttctcaagacggcattctactacctgcgtcctagtaacccctcaatccatcccaagatataaggattttgggtggacgtctagattcactgtcttagaatgagatgggattactcattctaggttataacattttgggcaacaggatagtattatgtcgagattcgatgtttaggatgagtaagatcgtaggttataacatttgggaaggaggaagtatggtataatacactatattacactgtttttttttcacggtatgaactggctatacagtattggtatatacagtattagtacacagcattcaaccatgtgtaactaaaacgtctgcaccttcataaatcagtagggcgtaaaagacgccatgggtttttaggtgcacgattgatctctgcatttatctcctggcgtagggtcttaccgtacatcgtacttagttgacttcagcagacacgaaaagaatggacgggggcccacctgccagtcgtggttcaccggttacggttaggttaccatcagaggataaacctgggcgtcccacttaacttttgatctcagcaactgatctagtagtattgaattgtactaccagtagtaattactgtgtggtaggattactagatgaacatgccattcgctcatattagtgatgggggcattagtatctgcgtattgttattacagtcctgggtacggggtgcctgggtactgctatgctggtgaatgttgttaattgttctgtctgttttctgtttccaaacaagtgatgtcaatggatttactatcaaaactttgaccaaacaataaaatttcataaactattcggtcaggaaaaattctactactaagttttagcaattggtgtcagattttgataacagatgaagtagtgctatgatcatgggtattttatacacatgttattggattctatcagccgtgtcgagactcgagagtggccaatacgttgtactcctcttactattttatattatatgtcattttgattcttttatgttttttttaaaatttgactaagtttatagaaaacaaaacatatttttcaacacaaaacaaacatatcataaaaatatatttaatgttagatgttgtgaaactaatagttaaacttgaataagattgacatgtgagaaagtcaaaatgacttataatataaaatgtaaggagtaactgacaatcacagtgatgaaaagaaatagtgctgtttttccaggttcagaaacgtccctgtatgactaatacactgtattagtattcagtattagcagcggtggctactattggttcgtcgaatctattcctctgcctgccaattgcagttaactaaatcactaaccggatgcggtttaataagttggtagcattgctgcatgtgcagcagtatcaatgtattcatagtaccgtagtacaatcaggggaagtgacaggaacattaggggtaagtggcggtatactaatcgctgcaaccaaccaacgtttagtgccagtaattagtactgttcgtgcaacgttgtgatgcgtaaagtggtgtgctagcttaatggaaggctgcactgctgccaatcctggcagtccaccaattgatagtactagtaatcaaatttctgtatggactaatccgtttctttcttgttccgtttttttctggttcttttgtttggtttcatttcatttgaggggaaaagaaacagcatggcctgcagtggttctgcagttgcacgtgagctctgatagtcttctggggaataacagttgcaattagtcatagtctagcgcatctttttgtactatactacctgtttgtgaatatttttttacatgggagtttcaccgaactccctgtttgtctcttgaatttgaaaagataaatcatctctgggagggttagttactgttcttcacttttggtgcgtttcaccaaacaagtggcagcaccatgattttttccaaaagacaaaaattttccggtaaagaagcacgtgatgtcacctaataccaccggtaggatgcagcaccttgtcgacagaaaaagatgtttttgagttcaacttaagtggcatgaatcattgcaaataaagctgagaggggtaggatgttttagtgctacagcacaatagtagcaagcaatgtgctgttaatcgccgtccattccttttcgtttttagtaggagatgagttgcaagtagccatcaggaatgtgtcgctcgacatgcgcattgcacctttctttgcttccactatactctcatctcgtgataattgagccgtggaaaactgtagcaacagatttgttcagctgcacgaggacatttgagttatccttggtgtccgggcttaatctaggttaagatgatgctagcatataggacatgtcgggtttgattagtttatgagcatcggaacatcggagcaaataaactaacccaacctattgaatggctgagttgcttgaatttcattaaggctgtgtttagtctacaccaaaattgaaagtttggttaaaattggaacgatgtgacggaaaaagttggaagtttatgtgtgtagaaaagttttgatatggtggaaaaggtagaagtttaaagaaaaaatttgcaactaaacacgacctaaaaaagattttgcatgacctcatccactcaggtctgtctttggttggaagttcaaatgcaaaaacgattttggatcctatttggttttaaaatggggatcaggtgtacacaaaacacacatattttagcaccatatactagtagttttgttattttattttatatacccccctgattatgactgacctaaccaatctccaattgaatctagcataaccggagaagttccaaacattgctattgctatcaacaaaaagccattgcctttattaggttcctgccatgtgtgaaccccggaagccagcagcggctagtcatctgtccttacccttgtttcgcatatcaccagcattacttagatttaataaaattagattcagatcagattgccggcctgctgctgctgctgctgctgctgagttgttgactgcatcatgttcatagcacagctccaccactgttggaacacacacgtcacgtaattacttcccatggagcctggaatcctcggtgaaagcgattttgatcagcatgtgataaggtgcaattaatccctgtaattttctgcttagtaatcgattcggtttgtggcctacgtgcaatgacagcgatcatttgggggaggaggggagagagatgtttgtgttgcaagtgttgccacatgttgggtgaaaacggcgaccctccaaacgccggaaaatacagaaggttttgaatcatttggatggaatttttcatcatcaaggtttcttgtagtgtgctggagtacttgctgtttgggtggtagtgaaggatttgttgcgttgctcacaagcttcaaatgcttgcctttgttttggcacgtgtggctctgtgctggtttgtgtgaaacttcccaggatgtcgaagttagagcttaccgtgttttgcctatttttggacataggagtatggcacaatcatttatctattcttttatactcttcctttttcatttttcctctgttcttttttttaattaaagaaattttaaggagatggcagcttttcctatgctttttatggttaggtttagcgtgtgttataggatatgacgatctatatttcgttggatagggtgatctaattttttttgtttggtttatatagatatggcgatccaattttttgttttgttagagggatatagcatgtatgggaaaaaaccaaaagttagtgggacccatatatatatatatatcaaaatttaatcatctgagatcttgttttaaagatttaattgtaacaaatataatgtgtaataaaatcataaattagataaaaggtttaggagaaaaaaatcggttggagcttgcttaacagaaaatcaaacaaccacagccaattaaaataggacacatcacccagaccaaaactaatgacttcatccagccaaatcgaccagatgcacttatccagcatattgagagaatattccttattccggaccgcctcatctaccctgcccttcaaccaaacacaaaaaaaaatcgggcggccatcttccatcaggctcatccacccaacctagcaaatgggatatgggagctgggattggaaaagggaaatgaataaatggctaggattaaatgaggtgggaagaatggatggttagatgcaatattactctttggagggtaggatattatttcccaatcctcaaacaaagcctcagttggcacaaataaatgcttgtttagacacagctcgaattctttgcaatgcttactagaattggaaattgctcaaaattgcagctctagatacagcgtgcattcggtcaaatttcaaatagagagctgaagtgaggtcccattggctttgaatacttactatttatatttgaatttagaaaattgctattaaagcattaaagcattaattatttgcagtatgtttgtagtactactcatcagggcaccgtatcacatcatagtaattgcattatactcttaattaattcagacctgaatcttctccaaaaatgcccatttctatatgcatcaagcacgtgttaaaaaagagcacccaaaaagaaaatagagtgcaaaatatagttagctgtaaaaattaatgaattagcatagtgcccctctaaattctcccaaattatagaacccacccctcagcagtcaccacctcatcgatagcacaaccacacatgcacagtgtcacagtggtcacatcacccacccctatacccccctgcacgccccccatcttttttactttacagtatcccccaaatattcccgcaaaaattaaacccactcctccccattcccccgcaggcagaggtagtagtagtactagcccaagaagaggaagagcaagacgaagctggaggtggaatcctcccgccggcgacgagaggccgctctagatcgacatggacgcgcaaatggcggccgcggcggcgcaccacccgctgccgcatcagcagaaggcggccaacctggcccgcaccttcaccaagctgctccgccgcaagcgcgctgacgctgtcgccgccgccaccgcggtgggagagcccggtgtgcccgatgcggccgcggcgtctgtggttggagatgagtacgagtgctccgtcgaggcggcggcggcgggtgtgccgtcgttgagcaagctgaagctgtccggtaaccttggcgcggcgtattcgctcgacgcgttcttccgcaatgcggccgagaagaaggcggcgggggtggccggggtggcggtggcgcagacgtcgccgcaggtggcgccggatgtggcgaaggattcgttgctggctaacctgttcgctggcgtctcggcggtgaaggcggcgtacgcgcagctgcagctcgcgcagttcccctacgacgcggaggcgattcaggccgcggacgccgcgctggtggcggagct

SEQ ID NO: 30478 - DNA, 29221 bp, Oryza sativa
taagtcgatccgctccttctccaagtcaatgctcaactcgatgcagtccgccggttgggatctcgccgccgcggcggccgccgtgcacccgggcgtccagctgcgccgcgccggggacaccaagttcgtcttcgagtcctacgtcgccatgaagatgttcgccaatttccaccggagggacttcaacctcagcttcttggacgagcgggagttctacgaccgccgccgcttcttcgaggagttcacggagctcaaggcggcgccggcgagcgccttcctcgacgcgaggaacgcgcggtggggcgggttcggcaagttcctgcgcgccaagtacctgtcactggtgcacgcgaggatggagacggccttcttcgggaggctggagcagcgcggcatcgtgagcgccgggccgggcttcccggagagctcgtggttcgccgacttcgccgagatggcgcgccgcgtctggctgctgcattgcctcttctacgcgttcgacggcggcgccgaggaggacggcgcctccatcttccaagtccgcaccggtgcgcgcttctccgaagtgtacatggagagtgtcagcgacgggcgctccgacgaggccgccgccgccgccgccgaggaacgcgtcgtcgggttcaccgtggtgccggggtttagagttggccggacaatgatccaatgccgggtctacctgtcgcggccgggacggcggccatgatgggttgtgacaaagccgtcttgtttcaggtgtccggcggatgataaagggggaggaatgtccattttggggcggccgtcgaggtctcccgccggcagccggctgcggcggcggcggcggtgttggtgatgatgatcagtgggtggttatgtatctattaagggatgtagtggtggtgatcataatataaatggcattttaagtttggatccattggagcaatcagaaatgttcttgcagtgttcttgtctcggatcagattgtctcctgtcacttgcttgttttgcaggggttgtactctacacaagatggaaccaaagatccagttcatgagcatccatgtatgttgggtggtaactactgctactactaactggttagcatattcttgctccaattatgcgcttatttaacttgtatattaaatcatgggggttgatctgatcaatgtggtcttagttctggaatggtgttcttgtttctggggaggaacaaaacaataataataaatactttttggatgtttgttgcgatggctttggcatgttggaacttgtgatttgctgttttgcagttggttgcctccttttggtggtttgtgatcaagagctaaagttatgcgcagtgcttatgggcgacggcatcagcatggactagttaatcttgctggcttctttaatctttaagccaagccgcctggtttggtttgttatgagaacaagacaaggtgaggatcaaaagcttttctttctttggctaatgtcaaatactcacgcacaaaacggttctccactctttcagtgttgctgtctactggattagctcagttttgctgacagtgtcaaatataaatgaggatcatcagcatagctgagctgttcgtgttgatccattactttttttttctgttgcatcattatagcacctcgtgtacaagtacaacctcttttccttttttgtgtgtaagaaagtgaggtcgtattttcaactaattttttttctccttttgcttttctttcttatttgttaagacaatgataactggtgctagctttggtttgggagcatgatacacagctaatttgcactaagcagcaacagaaaaaggatcgagatgttgaacgtgaaaataatcacacacttaggccttataatccaagtggagtgggggactttattccctaattttttagctgaactttactcctttatgagaatgtcccaactgttgttttgaccgtcatctttaggccttaatcaaacgggtcgcatctctgcattttggcccatgggctatcgcctgaatatataggggctagccaatggggtcatcgtacattcttgagggcccgtttgaattggaggaaaaacatatgaattttagaggattttaatcttataggaaaatttcctatgaagccctttaaaacaaaagattggatcctatctaatcctttaaaattcctatggaatggacaatcctatagagattttggaggaaatttagcaagagcttcaacctcttgataaatttcccttgagtctatctctctcattcaattcctacgtttttcctgcggttcaatcaaacggccattcctgtatttttcctgcgttttgcaatcctctgttttacacttatatttctattaaaatcctacattttttctattcctacgttttctcaatcctgcgaatgaaaggggcctgaactgtgtcattctttggagtcttgtttcacaactttgggcggcatgcaataggctgtaggctttagtacagcaagtagtactaacttggttgagaattatccctgcaaattcagctaaaatttacattgtctattggtagaaaaaaacaaatcatcgctaggtaaatttgtgaaactacccttttttttttgctggtaaaactatgaagaatcacacattaagggtccctttgaatcgtaagattgagaaaacataaaaataggaaaaacgtagaattttgataggaatataagtgtaaaatagaggattgcaaaacgcagaaaaaacataggaatgaccgttagattgaaccgtaggaaaaacgcagaatttggatgagagagtgactcagagaaaagttaccaagaggttgaagttctcgctaaattttctctaaaatctctataggatcgtccattccatagaaatttcaaaggattggatatgatttaatcctttgtttcaaatggcttcatagaaaattttcctataggattgaaattctctaaaattactacttcctccgtcccaaaatgtagctacatagtacaggacctgtccagattcgtagtactagataatgttccatcctgtactaggtagctacattttaggacggttgaagtatgtttttcctccaacattccatcttttgtactataggaaatacatttgtaaactgtgcgttttctcaaataatttgcaaccaaaatcgtacttttgttaggttacttcaggtagttcatcgacagttcttggaacgaaaaatcaaaattcagtacgtcccaaaaatgtttgactgtcctaagataatttcccttaagcccctgccatccaaccaaatcatccaattccattatttcgagcacatgttggttgcaggcaggaggagcacacaaggaggcaggcaaatcacaaataatcacaggttcgtgcgtgcatattaattccagtgtcatgccacgagacaggaaatgtcaaacatgtcacgtggcaaaccggagctaaaggtcaaatattccagtgccgtacatgtcgtctttcggccatggtccatgggccccttccaagaatgacatttgataacagatgacactgtcaagtgggctactaacgcagacaaatatgctgtggagtaccagtacaatcttttctttcactgtctggatctataatacttatgtacagtgtatattattatgtacattgtatactgaaatgtcacgtatactctctggcttcccaaatatagtaccacattcatcttaaaataaatttattttaggtttaattactctctgcaatttttggtttattttaggtcgaagttagtaatttacatggttttatctttatcttctatttttaaagttttaaagtgcaattttaggaaatatttcagatcaggagtatggcttttctgccctactcctgtttctttcgccacatgcagcaactaaactaaggctgtgtttgcatcccatgttcccaacccctctatctcgtttttcgcgcgcatgcttttcaaactactaaacagtgtgtttttttgtaaaaaatttctatacgaaagttgtttaaaaaaatcatattgatccacttttgaaaaaacaaatagctaatacttaattaatcacgcgctaatggactgctccgttttccgtgatggagggggagtgttcccatccaggaggagcgaacacagcctaaggcctgtttggatctagggactaaaatacatcggatgttaaaacactaattagaacttgtttagtgtctttatttatcacaaaactacagatttagtgtcttatagttctaggataaatggagatattaaatatgtagttttgaaaacaagttcttaaatctgtagttttgtgatatattatgcaaagtacctgtagtttaatttgtgataaatgaagccagtgaatttataatttgtgaaataaattcttaaatctgtagttttgtgaaagattgtgcaaagtatatatagttttatgaaatttactcttttttaaacaacttttttatagaattatttttaaaaacacattgttttatagtttgaggagcgtgtgcatttaaaccgagaaaataaatgatgggaaaagtgagaaacaaacgcaacataaatgccataaaactcctatattcaaaaagataccttgaattcgattccctatctatccagtctgtctcattgtggaatgattttccaacacaaacatgggcttcgatccaataaaggcaaagttgtaacttgacgccaacgcaagcaatttgcaattctcaagattatccgggacttcgcctctgcgatttgaaaacctaatcctgaatcccatcatgcatgtgttacatacgtacaccggggcatgcaatcacgcgtcgccccttttcgtaatcaaatcaaatcgatccgtgcatgaacacatatgaacaatatatattaatacttgcctggatcgagagaaattaagccgccgatcgagtcgatcttcttctcggcgtctcaaccatgacgacgacggcgcgtgttcttgcgacgctggcgattgcggcagcatcggtgctagtgctcgtcttcatggcgctcaccgtcgcctccacggcggcgacggcgggcgtgaggcggagcgagcagcattactctgcttctaggacggcggcggcggccgcggcggtggcagctgcgtcgtcgtcgtcgtccccatcggcggcggcggcggcggtgccggtgtcgtcgacgggtggccagtttgtcgccgttgccaagacgggaaggccgccgctgccgccgtccggccccagcgacggcggccacagctagcttagctagctagctagcgttcgcgcgatcatcatcaatcgatcgagcttgtacataaccgtatgattaaattataatccgaatgataataatacatgatacatccatcgattctgtgtaagcaatgtttaaatgctttaactactccgtgctcgccgtcgccgtcgccgccgccgtcgttgagctacaccgccgccgccaccgcgcgcgcgtgcgacggcaacttggcgcgtcgttgccgtggtccgtgtgatcggtgggccccggtcaccgaggagtgggcccaggggcggcgcacgcgggcggggtggcggtgtgggccccagggattcggcccagttgggcgggagcgtcgccgttgttggatagatgggccaagagtaggcccacgggagcgcaagtgggtggtggcgcgcgtgctgtcggcccgccgcgagacatgccgccagcttgcgttgcatcgcgggaattcaacgaaggaacgaattacaaacgcgttttgttttgttatagttgttggacgatggcctgaccggaatcaaaatcaagggtctttttctcaaacttttgtgtgtgttttcatatgttcaatctcttttttatatagtagtactatgctttaatgtggcacttcgatcagttgcattgacctaggcaagtactacaagtagagtagaggagatccaccgaaccctgcagcattggcactttgccggagatccactgaatgtgtataagcgtatgttcgtgtatctctaaaattaatggacataaatatcaagtctagaaaaaaagccttgtgataattaacacaggcgcttcatttaaaaaagacattttttttgaagcataaagataattaactcgatctggtatacttgtatcacgtacacttgtacaaactaaccgttatgtagatagccgttgatcaactttagttaaaaattttcgctcaaatatatatatatatatatatatatatatatatatatatatataatgtttttacgatcaattgcataaaggctttcccccaaactatcaaattcggtatttgcttgtagatggagtgcctacctggtgccacataaaaatgttgattatcacaagtcggcacctcaaccgcgtgcaaaatcgttttttcgtaggctggcctacaaaagatatttggcaaaaaaaaaaaggaaacctagaaaccctagccttgatcccctacctcccctacgctagatgcgccactagagctggcctacacaaggctgctagcgatggaggagctgaggcgcatggtgtccgcttccatctccgcctctaccgttgtgaggccaccaaaggtagaggagccgaggcgagcagtggatgctctcatcactgcctctgctgaatctggttgtcacaaggctaccgacgatggaggaggaggagccaaggcacgcgatggtcactctcgttgtcggccgctggtggattcgaggagaaaggagaggggaaggaagggttggggaaggagaagtgatgggggagagagaggaaggaggagatgtggaagaaaaagagaagtgatggagaagaaatgcggggtgcagcgaaaatgaagggagaaggaaaaggatggagccaggtcttcactttcgcaattgttcttcttaacatgcatgtctgtgagaacaaactatttccatagacaggcctttattggacatcccctggcttattatatatatatatttttagtacgtttgtaaaaataaaggtgggcgtatgcaaagaccaaattaatttgtagtagtgttggttgagcataactagagtcgatcgatggacacacgtaaaatgacccataccatttctacattatggatttgcatgcaccactatgcattatatgatccataccacttcacaacctaaagtaagtcaacacatgtcccccccccaaaaaaaaaaaaacccacacacacacacacacacacttaagcagggcatctcaaactctcaatgtgcatgcttgtttccacaatccacactgatattatcctatccaaaagtccaagcataactatctagggcccatagagttgacttcaagaaggggcgtctagagtaagaccttgttggcattatactctattatctgtaccagctaaatatttcaattttgtctattttaccatgagagttgaaagaaagtagtttgattgagaccatatcaaaaaagtgctttcatctctttcctcatctttctgaaggcagcatctttgttgctggtgttgaaaagacctaactagatatgatggagataatgaaaatatcttgtggacctctatgcactagtgtctagtacatatatggtctgcagtgggtaggccatgtcaagcaagtttgtttctattgaacatcacgggaagatgctgctggtttattttgccttgctgtgttcatcatagcaaagttgagcccagattaattttaggtaaccggatcattaaatcttaatgaaacctacttgaaactatgtcaattccttcaagaaagacttgatttttgatgtaaatcatggggaaattacatgaaacatatgtgattatatcagttagcatgagatctataagagatacttagattatggcccaccattatgactacctaatgccaacatttatgcacacatgtcatttcaccttttattgtaaaacataagtttattttttttcaggataaaacaagtttacattaactgataggttttgtcgatatcaaagatatgacattcattataactctgttagcgagatatatgagcgtcacatctcagtatctcatattgtgggcataaaaccaactacacgatagtataattgtattagatagactctctattaaaatagtgcaagcatattctttagcaaaacgcaaaggatacatctcatcatgaaactcaatggttcgtcaatactactatatatctaatgatcatatttatggacacacgccatttcaactttttttttaaaaaaaaggagaaactgtaaatgctagatctatattaaccaatgggttttatcaatatctaagatatggcatcattctaagacattgctctattagaaaaaccattttcgcaggcatggtgtctttttgtttctagacgggtaggtgtctcggaaccaaacgaccgcatacaattattataacttcacgagacagactttctattgaaacattttgcctgcacacgctccactccagcgatggcagtggcagcgtcatcacaaaagaacttgagctgatcagcattattgcattaatatcctgtacgtgctgtggggatcgatcaaaagtgcaaaatgccaaaagggtttacgcacagaacgcactcacgtaacgcgtataacccccccaaattgggtggctgctggcgtcgaatcggtcgtgaattgtgtcaaaattttgacatggacaactcctgggagacccggcaggaaagccagtagttgcatggaatttttccaacgtgccgtgcattactgggaacgacaactttaattatctgctgtattagagctagtttactttgctacttaattaccatgtttatccattcttgattggccatttaaagttggagccgtgagcctgtgatgttaattaattctgattctacgtatatattacctattttttaatatatgacgttgttgactttctatcaacatataaccatttatcttattcaaaattttttgcatataaattttttttaaatcatatttaaagaaatttgatgataaatcaagttataataaaataaataataattatatattttttttataagataaatggttaaatcttaactaatataaagaatcgtattttcccgttcgtcacagcacggacgatcgtgtcttcgcccccacccccgaatcccaattgctctcagacttcccaaaaccggcacaaccaaatcactcttagctccccaaaatatcgaccacaattatcacaaaatcttcccaaaattggcacaaccaaatcacaatcatcacaaaatcacaaaataattgttaaagaagaacagcaaatctacatcacaaaacttcaaaactacatcacaaaacttctcttgccttccaccggatccgccttcggccatcaccaccgtgggccctcagccgttgccaccgccgccgtcggtcgtcaccacgccatccatctgcggccaccgccgacgccaccactgctcttggtgggagaagagaggcggcggagggacttccgccggatccgccctcggccattgccaccgcggccctcggccactgccaccgccgccgtcggtcgtcgccacgccatccatctgcggccgctgccacgccttccatccgtggccgccgccgacgcgaccaccgctgccggagggagaagagaggggcggagggagccgccgctaccggatccacccgcggggcgccgtcaccgctgttcgtgcgctgccgccgcgcggagaagtggaccgccgccttcactgcttcacatcttttttaattagatcatgtcatttacttttgggcacatgtttaatcattcgtcttattaaaaaaaatatgtaactatcatttaatttatgttgttttgagttgttttatcactaaaagtattttaatcacgatttatatcttatgtatttgcataaaatttttgtataagaaaaatgatcaaacatatgtctaaaagtcaacggcatcatctatcatctattatataatataagcaatttttttcataaaccgtcacttataaactgctataggtgccggtttttttagccacagggtgttcgagtgagaaaaaaatgacacaaatctaaaacccagccaaacgtcgacagaactgcaccgccagcgtttcctacgcttcgatctgtttcacaaaatcggaagaagctcaattcgagcatgctctatccaaatcatatattgatgcctaaatcaatacagcagaacatgctagatcgatgcctaggtcaacaaaatcatcctatctaaaaattgaatcaaaccggaaagatgtgaattattaatgtccctgtccaaaaaagaaaaactaacttctcaaatccacaacatgttgaggtcacatatgttgccgttgcttgcccgaggccgaggctaaggacgccaccgctcccgctacctgccaaggccaaggccgctgcacatcggggtcatcgccacctgtaccgacgccatcacctctcccgccgcccgacgaggccgaggtcactactcgctgtggtgaggccatcgcctctcctgctgctcgacgaggctgatgtctctgctcgccagttggggccaccaccgccattgctgccgctcgcactcgcactgcgctgctcgcgtgtggatgtaggagagatcggttgtgggagataggagaaagagataacaagagaagtggtgtgtggctgcgggagagagaaaaatagataagggagaagagaaaaagataaagttggatctgtctgcccctgcctgccgcctccatctcccgccggaagggaagagggggagatagagcggcactgccggtggcctcccactagaagggagggcgccacccctgcctcccgcatccatctcctgccggaagggaagagggggagatagagcggcgcgctggtggggggaggggagggggagaggcgccgctgccaccgttgagagagagtgggggggaggggaaatgattttagggttagggtttgggctgttgaacttttatataggtcggaatcaatcagaactgtccatcatatcgtatagctacggcttctcctgcgtcaagccgaacgccattcccaagctgcccacacggaataagttcactttatgtcccttaagttgccccgattctgttcccatgacatccatactattgggctatatcatataaaactaaacctttatcatataatatttctatatttattatatttttttcaatgcacggacatttttcaatgtcaaaaaaattgttttaatttacagaattagtttgctctatttaagctttttaaaacttttcctacttcatattaaattatttttatctaatggaattaaaggataattaattatatttttttttatctttttgaccaaaggtcactgcaattttatttcattattattatttttgtccaacagtatgcatgattaaaattaccttaatccgttgcaatgcacggacgtcattgctagtatattttaaaaaatcaacggcaaaaacgaagggtgtacttctcacccgaactcctcgaggggatggcgatgaggtttatgttggtgccaattattggttcggtttcgacttgactgatgctaattttggcttatgtagaagtctacggtaagattcttctttttttaggtttcatgcccggcagtagtgttatcagttatcacttatcacatcccgtacgtcattatcttcaacagtgtcaggccagctgaataaatgttcttatgccagtatgcctaattaatgtacttgggtttcacagaaatgctgctactatggtttgtctaattcgacgtactactccacttattattgaaatattgacaattaatgacactatattcatgattaaacatttactccctccgtcccaaaaaaaagaccaatcctagcaagcatgtccagatacattgctaggattggtctttttttgggacggagggagtaccatttttctctctcttttttaaataaatacttgaaaatatattatactactgaaatatgtagcatgaaaaaaattaactataaaacttttattcattataatataatcatctaaaagtaatttgtggtcaaattaagtaaaacagttgtaacaatcattcgaaaatagataattttaattttacaccttttttgagggataatttggtcctgtttggaatgagattttattatccttgagtggatgtagtactaaatttgaaccatccacccaagggctaatattgttttgtactgagtggtaccgctcattggtaatttcctaggcctgtgagtaagcacgacttgaacccctcactaggtaatttcctaggcctaggagcaaattcaggcctagtttagttcgcgaaattttttttttttgtgttacatcggacgtttgaccggatgtcggaaggggttatgaacacgaatgaaaaaactaatttcataattcgcctggaaactgcgagacgaatttattaagcctaattaatccgtcattagcacatgtgggtactgtagcacttatgactaatcatggattaattaggctcaaaagattcgtctcgcgatttccatacaaactgtgcaattagtttttctttttatctacgtttaatgctccatgcatatatccaaagattcaatgtgacgtttttggaactaaacaaggcctcactttctgcatgaatagaggaaataagagtctccgtttggtatagctccgactcctaaatttagcttcaagagttagatttggagtaaagttgtgaaacagcctaaactcagctctatctctctagttcattttgtgagaacgctccacccagctgcgtttctattttaggtggagctgaaattatttagttaggctctaactccaatagagatggagctggagatagagccgtgtcaaataggccttaagtttgcctaatgtatactcatttaatacttaaaaaggtggtactagtagtgacaaaatctgtcagccacttacttcctgctgtaagtttgtaatttaccctatgaactttataatattaagaaacaattagatctaaatggatagttgcatataaattaaatttgaaaaatggataggtaacatgttttatggaaaatatattttattttatccgtagtaaagtatggtatttaacaagtattacaaaatatctctaacctagatgtactgttgctacactgaagactatctcaaccatgttgctttagagcgataacaacccaagatcgtcttgacctatttggcactattctattatcatatactacttttttagtcttaaaatatattaacctagtaatagagtacatatctctgtataggcatttcacatgactaacaaaaccgattaaaatgatttttcttcataaggataatgtaacccagtttttacaatgttattttttatataaaaaaaagaaagatgtaggagtccatttaacactaacataaatacctaaatcagcttgagattgcagctcacctagtacaaacacataattagattggagagcaatgcacgcaacataattaacgatgtgtgttcattgtatctatttgtacgtgtacgttgtgctgcaagccaaagcaacccagggaagtccaagcagagtaggcgacaattttggcgccaagcacatggagagggaaacggtttcaactcagccagccaatcagatcacctcgttctgctggtactctaggtggcgatcattaataatccctccgtcctaaaataagtgcagtcatggttttccacgtccaactttaagtgttcgtcttatttaatttttttttaaaaagattaaaaacataagtcacgagtaaagtactattcatgttttatcatcctataacaacaaaaatgctaattataaaaaaatttcaaatatgacggatgattaaaattgagcgcggatactcatggctacgcttattttgggacggatgtagtaatagaaaaagacgacggctaattgattcgtaattcaactcatcagaagaaaaaagatgtagaaatccaacggaataattgaattgctatttacacacacacatcattatcatctaaacacataactaatccctcttacatatatcgtaattgctaaaccatgttcaattgaaaaattgagataaaatcttgcgaatttctaacctttagagtttcacaagatatatatatatactccctctcttttttaaataaataacgtctttaaacacatgtttgatcattcctcctatttaactttttcctacaaatacatcatacttaaactatattttataaaacaactaaaaaataatatttacataaatattttaaagaaagtcaaatatgtataaaaaaaagggacactctgaatctactgtattaactaactatagatcagccggcgtcgtcccgctagtggccaacgccggggctgggcaccgacccgagcatcctgctgctgcgagctccggtggtcgccgccggcggcgacagcggcagaggtggtctcctcgggagcagcatctcctcctccggcggcgaggacgacgccgtgcttcttcttcctgcgacggcggcggcggcggcgccggcagaggatcccatcatcatcgtcacggcctcctgaacaatctccccgccgtctcccggcatcatcctggcttgcaagaacggagccgacgatgtcagcagcaagaagaccaggagcaggacggcggcgacggcggtcatggacgccatggttgtcggtcaagaactcagaattggatcgatcagggctagctatggctgaattcttgtgtaagattgatcaggttgtacagctgaattcttgtgtttggctcgtgcaggagaaggagatagcagagcatatttataggcagagaaagaggaggatgaagaggaggagatgctagtcgttgccccagtgcccgcgaatctagcgggcatttcgattgttttgccacgtcattatggtcccgtttgagttcactgaatataaagatttttttacgaacacataaaacgagaaaatcgttaatgtacgactaattaacttctagttattataaaattaaaaatagatttaactgatattttgaaaagtaacttctacataaattttttatatgaaatataccgtgtagtagttcaaatatcgtgacaacaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaattttcgtatataaacttttagaaaaacatattgtttaacaaattggaaaacgtgtacaaggaaaacgagagaagtgagttgaaaaaagaggggaagaacatagcctaaagactattagaccctgacttgttaacccaaaaatcatgcaaaggaatagcaagtacggcctcggctctattagacggaccctgacttgttaaccaccgtcctcgtcaaaaactagtgcttagtactaccccctacgtgtgcgacaatggtgcgtccccgtagaacaggggaatcgagtcaaacgagaggggctagagtacaaaatgtactaagatgctactgtgtaggaaaaggaaaacgagggggaatgcgattcaaatccgatggaaatattgaaaccgtgccggaattgaaatttggagttcggtcgccgtcgccgccgcctgcctgccggccggacggacggcgagtttaattgccggcgtatttggaaacttcctcgacagagatcgagagtcagaggaagcttctagttctgcaagttgcaggtggctgtgcctagttgctttcagggtatatttatttctgtttggcaagctaatacccagggcgaacacatgataaaaattgacccgggtcatctagtgcatgtatattgtactcgtagctatatcgagtgacgtggtgcatacatattgtactcatagctatatcaagtgacgtggtggtgagtaaggaggggattacgtcgaatcacaacttgatagctaatggggggttttaggatttaggcacaccaagtaagaactagccgactagaatgtggcggtagatatcggccacaacgtacgacgtcacctagtggacagcgagatacactgctgttgtcggacagagagtattggaaggaagtaccaaggtcgctagcatccatgagtggcaactcctccggcggccactcgttagacacgctgctcctcctctcgaaggtgatggctggctgcatggaagcgcaagaatttttcggtgagtgtaggacgacgcatcaatttctcgcttcccatcctgatttgttgttgattgtaaattagatcgagaggattgggagcgaatggttcgagtattggtagtgacacctcaatgcatgtacaaagattgcgagaaaagtaacgagtaaaaattgattgggatcctaaaccccattggctatatggtaaatccgtctatgatattacctgctttctccgttttttaaaaaaaacaaccttatattaagatgtgatatattcgttatattagaatgtggcaacaagatttttttattggagggagtaactctaatgctagcttaattaactactgtagctgattacctgatcatccagtcagggttgatgaattaatgaatgaaacgcatgcataccgggttgattgcaattggtcgtacgcaaggaataggtttaaatactttcttgaatttttacgttttacttttctgtttcacaatgtaagtcattctagtatttccacattcatattaatgttaatggatctaaatagatatatatgtctagattcattaccatcaatataaatgtggaaaatactagaataacttacattatgaaacggaggaagtagataataacacgatcttcaaaataacgttattgactatatttttttatatataaatttatttctattgtagtaatttgcaagacaactctatatatgttgttatagtgcctttaaattaaatatttttaaagatgttgatagttaaaattataaaagtttaattgactatggaacgggatggtgtaggtcccaactggcaggggaaaaccaacatcacaacatgcatgcatgcatgttaccgacatgaattcttgtgttaaggatgttgctggaagttagaatgctagctaactacttctcaggtcctggctttatggattagtcgtattcaagcaatcaaaatagcttctgcattattggcccactatgctctatgctgatctatcgtactactagctagtactgtattaaagatttaaaggtggtaacactctcaggggtgaaagtcattttctcaacaaatgcttcaggaaaacggcgctcgctacttgctaacctaacacatctgatactatatcctactgttcagggatcagtgtatccgtatgatgtttcagtaaacaatccagtattccagtgggtcactagctaaactacatgtcacaagttggtatatatttgtgacacatatgctcactatatgctgctgatgatttcttagctcattcatattgcatcaaccatatatagtattaccaactaaggctctaatcagccaaagaaaaagccaaattttaaatttttaagcttaattttgatattgattttgagatattttcaacgtagtttctttttcaatattagcttttaagtcaccaagaacacatttataaaagtttcacctacaaatttatttttatttcctaataagtcgttttgacttattagaaaataagccaaacgatgagtacctaaactatcttatgatgagctaattagagataatcactcaggaaatgatgtacgtgttttgtctgatctgctgtgtcaggggcaaagagtggctcttccttccaagccaagcctcccttagtacttacttctccgttctaaaatgtaattacctagtataagatgtgacattacctacttcatccgtctaaaaaaactcaacctaccctcctaggttgagttttttttggacggagggagtagtaatacgaatctgaagtgttctgtccagattcatagtcctaggtaatatcacatcttgtattagatagctatattttgatacggagtaagtatcttatattctctcaagagactccaaggagaaatgccacagatgaaccaaccaactaacctcatgctgttgcagtggcgcctcggagacatactccttctgcatcagccatctgaaaacatatacatgcaatttatacataaaaatgcagtggcttgtgttgctcaactgtgcatggagaattggactcttggaacttggaaggaatccaggagggtgtgtatcagtccatcttgttgctgttccttcctgccaatgcttctctagaaagaactttatttgatttagattattgaacagattaaacttggttatagaaataaattagatattttaagaactaaacttaaactaaataagaccgacagcaaaagggaacagctgaactgaagaacagagttgcaacttcgcaccattttatctccactttatagatccgaaaataaacacagctctcgtactgtcttttaactaacatattcgcgtcaagattatgcgtcgacgtccaaatattcaacttcacttttgcctataaaagtaggatgagcatatcatcagatcactaatatataaatgcgtttcatccaatagcaataaaacgacgcacgactggggctcattcaagtcaaaatctgcggaaaaagttgcagtttggcatgttgttgagagctgtagcgatcgacccggagaaattctgcacaaggaattaaggcctgtttattttgtgaaatgaaaatttttggtgccacgtcagacgtttgaccagatgttggaagaagttttcggacacgaatgaaaaaactattttcacaactcgcatgtaaaccacgagacgaatcctttgagcctaattaagccatcattagcacatgtgggttactgtaatacttatggttaatcatggactaattagattcaaaagattcgtctcgcgatttacatgcaaactgtgcaattattttttctttatctatatttaatgcttaatacatgtattcaaagattcgatgtgatgtttttacgaaaagtttttgaaactaaacagggcctaaaggcttgaatagttgaattgatttagttgttatcagctgatcggcgcatctaatgctaagtagcactgtagcagccggtgcagggcaatgtgctgtttatttcttctccggttcctgaacctgccctgatccccggtcgagtctgatgtggcgccacctcttcgcctcggacaaatctttccaagcatttttattcgtgttcatgtcctttcgatcatatttatacctacgtgaatcagtttattttaaaatagagggagtaatcttagtcggtgatgcactgattagtaagtaggcacctaggccaactagttagaggatccaatatagtagccgtaaaaatattttccacggaatagatacgctactccttctggatcaaaataaaatgacacatctaattgatcgagggttgtttgagggagtttttggtagctgcaacttctcctagcattaagagctctctcaaactgttaaatatgtgatctgaattttgggaccacaatatattcggatttgttttctagtaggagtttctattaggtgtctttcttttatcccctatatatactcttgtaagccgtacgggaaggggtgacgtttccattgtgattcccttagtttgtaatcatctcctctatagtgattattgccggtcggcgcccatagttttttcccgcaagaatttttcatataaaaatttgtgtttccgttgtgcatctattttcataacacaaacaatctattttttcatctagatttttagaagatgtggttataaatccgtaaaatgatgtgtttttcagcttttctaaattattagaagttaaatactaatcgattttcctaagaattttgaactccaaacaacacttaaatcacatactaaagccgactagaccgactttaactgattaatcggtgaaaaccgactaatccacagattaccttttgattagggcggtctacccatgtctatcaagtatcaactggccattgactcgtaggtcgaccagtcaattgagccagtacactcgctttcgtcaattgagccagggttgggagagttcatttgcgggtgcacgtgcagtgcagtcttttcgaatttcgagtgattgaaaaagaaaaacacacacaaccaaatgagagaaacctaagtgtacaaattcgtgagaattctgtggtgtttgaatctcctaagaatgaagacgaagtttaaatgtttcacgtaaaacgatgtagtaataacatgtaattaattaaattttaactattacaaatttaaaaaatggattaatctgatattttagaacaaatttcatataaaaagttttcgcacgaaacactccgtttagcggtttgaaaaacgtggtacgaatatccaaaaattaatacatcctttccagaggaaacgaacagggccgaagactgcacgttccatgggcttcacggcattaggctagtaacaaaataccggcccatctacgtgaatgggccctggagttcagtataccggcccattcgtgtacatgggcttcgatctaggcccatccaaactaggccatacggattttgatcggacggttcagatcacaccagatttcttccccgtctccgtcacccgaaccctctcaacccatggcactctccgccgctcgccggctctcctccgccgccggcggcgacgccgcgcggcctgggacgctctcttccctcttcgcgcctcgaagctctccgaagcctcgcgccccgcggccggagcccggggatgggccaccgcaggagcggaggaagccgagggcgaggccgaggccgaggtcgaggcacccgtggggggaggaggcggcggcgctgctccggaggttctacgacggcgggtacctcccggggcctgacttgtcggtggcgccgcacgtcttgtcccccgacgtcgtcaagggcgcggccgagcggttcggtcatgatcaccaggtcgtcgccaagtgagtgccgcctctccgattgctttgttccctttgcgctctatataagttgtatgatttagctacatcagatggatgccactaaattaccatgaaacactagattttgtgagtttaattcggaatgcctgtattttttttctgttgcatctctgaacaatatgtcgacagtggaagtatgacggtcgttaagtatcgatttcgaccgtcaattatctcaataaataaaaataggactaacatttcttacacgtacattagtttcaaataatgtacttcctccatatttcacaatgtaagactttctagcattacctaaattcatatagatgctaataaatctggacacatatacaaaacatatatagtgatcaacggatacatctagataagtccaaaaagtcttacaatataaaacggagggagtatgttggtagcaagtttggtctaaactctggatatggtgggtgaattcattgcgtttctgatttcgttaacctgggagaagatgtggtaatgtggccttatagaagagaacaagtgaacagctaccctggggaattaccaatgtctaggtcttcttcaatttggaaatgaagagcttagtttgtggcaatgagttttaccatgtaattggttctgcttccttgtttcaaatcttgactttctggattgtggtatgccgtatgcattgtgctgatgctgctgtatgttttgcagtggattctaacaatgaactgcattcctttttttttcctcttacactttggaaactggttaattgccacctacagtgggggagctatcagtcctgagcagattttataggttgaacacaaaactatactaaaaaaaatcatgaattaaccgtttacttatctgaaactcttccatttaactttccgtgctctgaaatgctgtgtttcaagattaatagtgattccaggcataatacatccttgtgaacaacactgatcatgctccctgtccctgcatatgctacatgagctggccatgcttgatattttgttgaacagttcctttggtcttttatgtttgattttaatattctttggtagtagtatgtaaggcaaaaaaataagttgaaaataacattgaagaactatctttatcacccaatttctccgctgttgaagctgaaccttgtgtgtgcactgtagatggttatctggaagtgacttgaagaaggttgcgttgtttggttgtccatctgttgagcgaagaacagtttttgcatcaaaaagactacgagctttctttaaaatccaggaagctaaagtaggtatcatgtaattgtcaatttaatcctatgcgagaattacttctgtcaaaacatgcttgaggttaacgttttgctcgttgtcctccttcagatatgcggctcttgtaagatgagaaattcatgccagtttgttaaccaggaagtatctaggcatgataaagtgatcctgtcagatactatgagaattcttactttattcgtcctggatacatgtcctcagcaactcaaggttactcctgaattgaaagctagcatttgcaagcttgtcaaggacaccataaacctaagccaataattactaagcagatcatttgtaactgtagaaggtacttgaagtataccaggtagacaagcattcatgtttcgtacattttatttacttgatactatgtgacaaggtctaaaacataattataacatgtttttttttctggtgcttttgccagagaggtgaccaaatttatttggatcaaatggatgaagctcatattttgtttgcaaatactacctgaaggttagagcgctgacctcgcatatttatattgtgtgtaacttctgttgaggcaggggtatgtgaacctgactgagtagcaattgacgatagctgtaaactgccaagctcatactgtttgaatacattatttgattcctttaagtcagttctgcatatttatgaggttccttgtctcttaagtatcttgtgtcagcttgacgagagatactccatagatttttctaagctcctttgctttcagaagccattgtctgtttcaatgaccttataaatatttatgaagccattgtttcaatgaccttatatcaaggaaaacataaggatatcttgtttcctgtttcctgtgatttgttattttgctgtgaactcgtaaaagtttacataacgccgtaccatgatatccttttttctttaaacatcaccaacgcttccacattccaacacatgtatcacataccatctgattacttgttttttgcacttaagcaactcaacctgattgcaccgcagaagcagatgcgctgaagctaagatgcagtggttcacccaggaatcttgcatcagtcagactccccatgtgatgttgtttagctagctgtaaaccatttagtttggacaaggtaccgtacccctatcactcaatctaactcttactctttctttaataacctgttcctttcgtgattagaaaaagatcagccaatgtatgcccttagccggcaatgcatctgccttcaggttttgttggccatattatattcgaagcactatggttcatgtgcccctgaagctccaattggcatggatccccttatcctatcagcgcatgctaacttggtaaaatatgatgcagtagaaaaagggaggcccttttcagaccaatgccccgtcactttctacctttaccttgtagccacgagcttttcttctccttcatatgatggagattcttgtgctgtattcttgtccaaccatggaacactgggtctttagcaaccattgtcacgtagtgatgtagtcgacaggatcaagagttcgttttcagactgactggaaacactgatctttggtgtgttgtgcagggagaggaacagtttggcttcagactaactggactgcttctctgcatggcacctctcttgtagaataatccaggatagctggtctcctgaggcgaggtcggtaggtcacttcatctatgtgataatgtgaacccttccatattgccgcctgatgagaactgaatcttctacggaagtgatgctctactctctactctgtttttttttccttttggtttcttttccctaatctcttggacagttcagttttgatggattcttctggcctcgtgttgatgatcaaagtattcaagtcgtcgtctcgtgctgatggctgcttgcttgattttaaacttcggctgaaactcggagcctctttcacatttgtccggtcagcgattgcttttcttctctcccccggtttgccgcttgcatggtagtgcctgccactagtaatctaatagcataggtcttcttgttaacttctctcacataataagtcaagtagtagtacttcagttaagcaagattgatcatgtcagaaagcatgctatttgaacgttttgaaaggttgaatcacaggagcgtgatgcatgcatctcactgatgcagcagagaatcaggttatgtaattttttattctcctggaagaagtgtagaaaagtccacaatccttcagttttgatcgtaatcaatctaccatcaagcttctaaaaaaattgtatcatcaagtggagccctctattaagctggctggttggattaattagaagtgcatgttgacaaggcggcagagtattcagctggagaaatcctttgtgtacgcaagtaggacgttttttttcccctctttttgagggaaagacgcaagtatgttttctcgttgcctcttctatcgaatcacgggaaaattaattcgggtctaaaagctcattctgcctgtttgaaacttgaaaaaaagagaaaatgtactggtttctaaaagaattgaattaattttgttccgtgaaacttttccagagtcatgtgaaatgaactgtttttcctggtggagttgaattcagtaatactagaaaattagcgcgccaagtggcgcgctcattatagcccttgtgtacttgctaagtagtttccaaaattcatgtctataaaaggttggtaaatgaaatattcaatggtgttattaaccgatgcaacaagttaagctaaattagcttccatggcacttatgctaaaaaaaagtaactattacactttaagaacaatcatcaaaaactggacagaaccatagataaatatatatttacatgaattcactaagataaaaaagtctgatactaccacagttgtatacaatcttttttttttaaagaatacagtcgtttccggtctagcttctaggtacggcacaaagaagaaacacaacaatgtagttacacaaaaaatttttagaaccatagtctttcacatattttaaatccggaggtcatgatttcgagcaccttgtaggtggcaacaatttatatctttggtatcttgcatatccctagaaatataaggaggtgaacacaaattagttggacctatactgactatagaaggagatcaatagcaagagacaaggttaagccagattgttctggtgggttagtggcacagcagcaaaagctatcagagacatggcagtaaaactatgactattttttttagattgaaacagcagttccagatctaaaggaaaactattgttagttcttattatgggtgcattcaacatccacccaacaaaacaaaaaggatgggggagagggatacagagaaaaaaaatctctttaggaaatattttatctttatatatttgtcagataatcgcaaaaatacatgttcagataacactatattttttccatatatagagaatgtggatagaaatataacaagctcatgatgtattaacttaagaatgtggtcatcatgaacagttgcaatcgatcgcaacttcaaaatttctgaagtaatactcaggacaatcccttgaatagaacacttgcaagttgcaatgagcacactaaccaattatgatgcaaatgttagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaaaaaaaaaatcaaacttgagttttgtcaagaaccattcctgattatgttcttctagcgcattaatatttctgttccaaattatgctaactgtatatatactaatagctctaactcatgtataattcgattgctgctacgatggaatcagtaatacataacttaactgattagtaatccatataagagtttcataacttagcatcaaattctgcaatttctagttgtgtttctcctggatttctgcagaagtagtatagtagcaacagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaagaaacattacactgtagcttgctcaccactaccggccatggcgacgaccgataagcgcgctctgctgaccgccgagaacggccatggcggcggcggtccagtcgccgtgtcgttcaacaccaatgccatcgtcctgctcgccctcctcgtctgcggcctcggcgcggtcgcgctccacgtcgtcctccagtgcacgcttcacgtcacgtcgtaggctgggatccctgtcgttggctcgccggcgccgttaccgggagcgggaggcgtcgagatgagatcgattagaaggggaagaggcatgaggtcgatcgacccttcaggagaggacgagaggctaacttttttgcattttactccttcgctagatcatattttacattttagcccttcgcgggaagagcgtatacacgaaccacgcagcgccacgtggcctcgctaatcgcacgctaatttgcatagatttcgataaatagagatggcttttgcccttgaacttatctggagtgctgctaggataaataaaaacttatattttctgccacgctatattatgttggtgttcttctataaggtcttgttcggttaatcccggtgagacctcttcaatcccctttaaaccgaataaggcctaatgaagatgaagatatgatcacaaagttaaggcgcgcaaaacaatgattcaatgaagatattagcacatgattaattaattttatattactataaacttgaaaaataaattcatttatattctaaagcaacttttatatttatatctagaatttttttgcaacatactccctctatcccataaaaatcaacttaataccggatgtgacacatccgattttagattcgtattttatgggacaaaaagagtagcgtttagcagtttaaatagcgtgttaatgaaaatcgagagaaaatctatatcttaatcgaaaataattccacgtaaaccgtcgacgcttacacacttaattatctcatgccaggaaaagtcgctctccagtaggtgacaccccaactagggccaccactaagctgtcacccatgcatatgtaaacgcatgctttaattaaccccgtatattatgttcgagcactaagctatttttacctacgttattctcttaatcaatcacaacaattttccttttaattgtgcatctactttctctggttaacatatcacaatatttttataatcatttttaactactttcttaatagctataactatcttaaaaaaaaatatttgtatttggatacggagagagcactatgctatccaaaccacccgttgcatcgtacatgcccagaccagaagccaccagtatgagggtatcagggtcgttgaggtctctcctcctacactacacggctcgtgggggccatgggccgccggggatcacgtggtggcaactggcaaaaaagcccacatcgcgcgtggcgcggaccaatcgccggccctccgtgcggcggggggtcgggtgggggtgggccccgggcccccacgctcacgtgcacgccgcacgccgccccgtaaccgcgttccgctgtccctcacccccgtttccccgtcacctccacgtgggccccacgatccaccacgtgtcgacgccaccccaacccgccgagcacgagcacggaggtcactgacatcctggccccaccccaccctcgcacgccgaggtggggaaggaggaaaaaaaataaaaataatcgcacgcgccaaaattaaaatactggacggagcagtagcacagtactcgacgtccgagcgaaaaaaaaacagagaggcgtgggttgatcgcaaaagcaataggctcctcacgtgtcccgctcgtggggcccaccgcgcatgggtgcccacgtgcagcgtcgttgacgtggaccgagccgaggggggtggggcccaccccggcggagggagagagacacgcttcgtggggggtgccccccacgcacaccctagtggctagtggtgtggggtggtggtgcgaaatgacgagactacccctggcggggttagagcagacgcggcgccgcggtggtggcatgcgcgtaaataagcggagatcgaggggtaatacggtggcgaggcaacccccggtgctttgtcaaagctcacgccactgcggccttcactacccacccacaacctcctccccctccttcgcctccgccttcgcgtgatctcttctcgcttcacgcttctctcctcctctccgcggcggcgagagcaagggcgaggcgggcggcgaggtgagaa

SEQ ID NO: 30479 - DNA, 10186 bp, Oryza sativa
  unsure (1)..(10186): unsure at all n locations
caagcggagggagcggcggcgtcgcgcgatcgccgccaagatcttcgccggcctccgcgcccccggcggctacaagctccccaagcactgcgacaacaacgaggtcctcaaggccctctgcaacgaggccggctgggtcgtcgagcccnncggcaccaccnaccgcnaggtacccccagatctcccccctcccctcccctttccgccccaccggatccgccgcgcaggccgccgccgccgcggcgacgatgtgaactgtgattccgtttttttttttttttttttttgcgccgtggagatgcacgtggtggcgactggcaaaggtggggtgaagatgccgccagtctggacccgcgcacgggtgtggtgggtgggtggggcgcgggtggtggaatttccggggggaattttcgcgcggagagcattgcagttcgcggattcgtggaatcctttgctagggcgattgttaccaccactccacccggtgattcccgctttgcttttgtttgcataagcaaaagcggcggatcctggctcctgattggccgatgggatttgtggtggagcgggggatgcatgaactcggggcgtgtgtgtatgtgtggatcggatcggccttatgcttgcgtgatgttgaccttgtctttgcccttggatttggggatagatatgcgcttgtgttaacatagtggttttgtaacgacgattgaccgtgagtatctgctcttcaagactgggcattagcatttgtgttgttgcattagcaagcgttgctaggttgtctcttcagaatttcatggctactgctgatttgctcttctagaactgaaacaatacaattagtactactttcgaatctgctgatgattgtaaattaatgaatcataaggtcatttttagagttgagttgaacaatggggcattggagttgcatgatctataaaagcttggaggttgtttgtgttgttagttcactcaccttgttctgtatcaaatgtgcttgtctgcgtcccaaacatcctgagaaacaatgcatttgacttaatttcagctaattgaataatttgatgaatgattttatttatgtgtaaccgattgtgcctttttccacagggatacaagcctcctgaacgcatggaagtgattgggtgctccgtatcaccaagcccgtgttcctcgtatcaaccaagcccgcgggcatcatacaatgcgagtcctacttcctcctcattccctagcggcgcatcctcccccttccttcctcaccctaacaacatggccaatggtgttgatggtaatcctatcctcccatggcttaaaacactgtccaattctccatcatcaaagaaacatccacagcttcccccactattgattcacggtggttccattagtgcccctgtaactcctccattgagttcaccaactgctcgcactcctcgcatgaagacagattgggatgaatcaaatgtccagcctacgtggactggttcgaacagtccctgcgtggtgaactccacgccgcccagccccggacgcacaatgcttccggacccagcatggttagctggtatccaaatatcatcaacaagtccatcatcaccgacatttagtcttgtgtcatcaaatccatttagtgtctttaaagacgcgattctggtgggcaacaattcatcgaggatgtgcacgccagggcaaagcggcacatgctcccctgcgattcctggcatggcaccacacccagatattcatatgatggatgcggtttctgatgagtttgcatttggaagcagcacaaacggtggccatcaggcggctggtctggtgagggcgtgggaaggcgagaggatccacgaggactcgggatcggacgacctagagctgactcttggaagctctaggacaagagctgctgcttaacaaaaaaaaaaaaaactaacctggaggcattcttgtctgtagcttatttgttcgtgttcattagtttctgaaagagagaccaatcgtgtggttccttcagatagcttcagttgtgatgataattgtgttatttatgtgaggcacgagctagagagaaagggggctttaattcggccaaacccagctgtgatatggtaatctcagctggctgtaattttaaagccccccctttgttgtgacaaatgtaaattgatgtgagaaatcatgcaaaattcatggagcgttcagctcaacgaagcattcatttgcgttccgtgcacggacagcaaggcatccacatacttttgccgaagcctgctgctttcctcgagctccacggcggcgatggcggtggtggtcgacggcgtctcgccgccgtggtccaaggaggccgtcgtacacctcctgtccggtgagctggtggtggtggtgattgactattgtatcatccttgccaactcgtgcactacagggtcattttcaggcttaattgaacgtgccattcgaagtcagcaaatgcagctgtgagagcacacctgtgccgtccttttccactgccttcaaaaccaaatcttgcccttgaaaagccagaccacacttgtactgtctgttctccgtgtgagcataacagcaggagtggtcgagtacctgatagtagtagtaacaaaaatttttttagaccctgggatttgacttaatcaaatgaagaattcagtagccctgatcacgtaagtattagtgtcacagctcaccaaccctgcctgctgaagaacggcttggaggagacagagacaactagggcaagtggtttgccaaacttgcgcaatgattcgatcaaccgtgttctgattgagtctttggttgaaaggtaatttgcattttcagagggttaatcttgacttgtggtgttcgagaaaccgcccctgatttctgaacatttagtacaagccaagtaattagaaacatattatagaactttagttgtgctgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgtgcttgctcgcctcgcctggcctggcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcaaccaagcagccggtcttttcgtcacctcggtacgtgttcaatatgttgcgcatatttgatctgttcatgttattctgcgtagtttacatgtgtagatctaatgatgcgttcatactagttttcatctgtaatgtcatgatttattcatggaataaattaaatcattatatgcccataatctcaacactgttgtcttcagtccataagccaagcactagtctccgagctgtctccgagtaggctggactgctgtatatgcatatgaaaagttcgtttgtttttacatggatggtttgtcatgtcctgaaagtctgaatttcatctgttttagtacaaaaaaagagaatgacttgagagttgagatgaattcaattaggtaggaaaaacgtaccagcaagagtatatttgccagattctgattttaaaattcgtgttaatccaacttcagatggctttcgtctttgcacacgcctgcctgcatcaacacactcatggtgctataaaagtctagaacatgatgcagctggcctggactagtctttcactgtctttgtgctctcaattctcaacagattgatagctttgccattgagtcagggagagagatggctgggagagaggatggagcagcagcaggagccatggaagaagggcaagacagcaaggaggtgaagtgtgagagttcagaggatggaagcagcagcagcagcagcagcagatgccatggcaacgacgtgatctccgtccaattcatgcagaaggtacgtatggtgatggtcgttgcgaacttgcgatacacggtctcctggtactaccccgttgccgtacctgaactcgcaaactgaaactctgaacttgacacccgtgtcaaaagcatatggtttctgactttcttctccattccttttcagcagcagtaacacgtttatagtaattccgttggcgattactaccatctgtgactttttgactgtggagtagatttcttcatgtagactaattcagaaacatcattagagattcctagtgactgactgactgactgactaatagggatgaaagcggtcagcctgctatcccgtataagagcccgaatgctagttcattttcaatccactgctacaaaaattagatgcaaaaaatacagttacagttgtggtttaggggacaacaagcctgcaagcccgccctgctttcatcgatccctactgagtagtactggctaaccgttgctctgaatattttcgcaaactgaaactctgaacttgacatccatatgcgactaattccactggggattactgtcatatgtgactttgtgagtgttcatttcttcatgaagactactaactcagaaatggcattagactattagagagggaaatatacggtggaaatcatatatctagtagaaacctgaaaattaccgttggattgaaaaataaacgtttgagattcgtccacatcatcaagagtaaaaattttactcctaggtttactcatgagtaaaaattttactggacgtgaatgaatttcagacatccattttctaatccaacggtagtttttatgtttctacaacatacgtggtttgcgctacatattttccatattagagattactcgcctgaccaactgtaactatgattgatccttctagatcaaattttcaacgaacattgattgctgacacagatccatggtgcatgtgcatgaacaaaaacctgctgattcttgcggaaattctggggacatatttcatgatattcgccgggtgcggcgccgtggtggtgaaccagagcaccggcggcgcggtgacgttcccggggatctgcgccgtgtgggggctcgtcgtcatggtgctagtctacactgtcagccacatctccggtgcccacttcaaccccgccgtcaccgtcgccttcgccacgtgcggacgcttccggtggaagcaggtaacaaagcattttcttggatctgaaaatgacatcccaaccaacgacaatttttttccagctttctgtagcacaaacggagttatcagtggcactgtagactgtccgacaaaaacagatttttggtttcatggttcgcttattggctgaccagccgcatccaaaatttaaattcaaaaaagttgatttaaaggtttttgttatatacgtgtgtataaaaaatatacagtatacaaagtttgtatacgtgtatataaagtttgtatacatatatagtattaagaaataaaaaaccaagaaaagaaaaaaaagggaaagaaaaaaaggaaaagaaacgaaaaaaaagaaggaaaacaggaaaaccatatgtgggaatcagatctactgtttttttccattgcataggaatcggacagcatgtttttttgtcgttgtttttccccatttttaagggaaccggatctacgattttttttgtttttttcgctattttttttctcaaactctttttttttgcttttccctgtttttaaggggaatcggacttcttttttttcggtttttttcgctattttttttatttagacggacggaggaaacactttgtattttttaagtagtagagatagagaagagatatatttttttaaaaaaagtaaagtagtataagtagaagagaagattacggacaagaaatttttttagggagtcgtagcttttctctaggagtcggacctttttttttctttttttcatggtagaagttttttctcctttttttctcgctttttttctccaccggggagttggacgttttttttttgccgattgattttttttcctccttttttgtttttctcgcttttttttttccaaacggacgacggaaatttcttttattttttaaatagtagtagatagaagatagataatatttcttttctcctttaacattggcttttagattgtaaagaacatggatgtaaaagtttttaactgtcaattaaaaacgagaattggaaggagagacattttgctccaaacattttctaagaaggaattgtgatctcgttgattgaaaaccacacacaccacttaacgctgtactattaagtacatctctttctacccgtcaattatttgtggttgcttccttcaatttttccagggcttatcaaccgtggatcaaacgatggatcggattatgtttcggttaaatttactgccaataactcatttgtggtgatcaatgtgtgtgtgtggtgcaggtgccatcgtacgtggtggcccaggtgctgggatccaccatggcaagcctgacgctgcgcgtggtgttcggcggcggcggcggcggcgcgcgcggggagcacttgttcttcgggacgacgccggcggggtcgatggcgcaggcggcggcgctggagttcgtcatctccttcttcctcatgttcgtcgtctccggcgtcgccacggacaacagagcagtataagatcgaacaccaaaactaacaaattaactatatatatatgcatgatgatcgatgataattttgtggtgtacaacacagatcggtgaattggctgggctcgctgtcggtgcgacggtcgcggtgaacgtgctcttcgcagggtatgtgttgaagtaaatcataaaatttcacagttaactacgtgctgttgatgccgcattagtagtagttgttcggtattctttttcgtttatgcttatacttatcagccagtttgaatttttaaaattaaatttgaaactaattttgtgaatttttttcatcaaagtttatttttcagcctttacttttaaagcgctaaaaacctgtatataaaagttttattcacaaattatcttttttttataaacacgtcgtttgatttattccacgaataagctaaacgatgaggcccctcattgttgttgttgctgctgctgctacagtgtgtattgcattgggggtttaatttgcaggccggtgacgggggcgtcgatgaacccggctcggagccttggtccggcgatggtggcggggaggtacggcggcgtgtgggtgtacgtggcggcgccggtgagcgggacggtgtgcggcgcgtgggcgtacaacctgctccgcttcaccgacaagccgctgcgtgacatcgccaacaccgcctccttcctcaggaggagctcgcgtaggagttagtgatagatatatagacagaattgaagccgttctgtctctcgaatttgcagcaaaaatccaatcaccgtgatgctaatgtttttcatgcccgttgcaagtgtaaatgtgtaattaacggcccaggcaggcaggcaggcggaccggcccatccttcggttgatttggtgaaatttgggccgaggcggaatgaagtatcgggccgtgatgtcagagatgcggtgggcccatagtgggctgcgcgagcggctagtggggtcgtcgtgcacgtacgtcggttacacgattctcttttctttttatttttaccgaactaggtaaaaacccagaagttgcaacgaatattataaaagaaaaaaaaatacagtatagtcggtcgattagatatataatgtcatcttcaaaggcagccatactaaaatatgctgctatgctggtggatcatctattcttatcctcttcatatatttccacaagttatatggtcggacaatacaacgttgaacacttctaattcacctgacacccacatatatatttgtgtgtgaaaccccttgcaatttctagagttaacaattctcttattcattcatgtgttgtggggcttatggcccccacatgttagtttgtggtattaaaggcagactcgaataccacactagcatcacttaaagcagtatatatacaccaaaacatacatatactacactcggacatataagaatatataataatacatcatttgacacgatctcgaagatacaaaaatcaacggtagattcatatcatcattgaattctattaaaaacgcacccacgtgcaaaacataataactttggttggaggttcccagtagaattcaataattaatgcgtctttgttttgtgtggatatttattagcttgtgttttctttagctttgctggtgtattttttaaaacttgttttttatgctagtttgtgtgaatttgtataataattggctgtagctccttgagcaaaggctgagattttattccattatctaaaaaatgcaaaacataattgtgagcataagaatcttaaacctggttggtggtggagtcactccatcaacgtaccaatggtgcttcctctacacattttttttctttttctaacttgatgatcggatagattatagatactagatagataccccgcgctttgctgagtgatatttttattctaccaaacagtatttggtatacattgaagtgttattcttgctttgaatgaggaaataatatggaaaagagacatgaatgattaatctaaatggactacatgaaaacttgatagccaaaaaaggcacattcagaattatacatacagttgatctcaaagaaaacaaaaacaaaatcaccttcaattgagatcgatgtacatacagtgagatgtcagtgctgtagccacttgtaattatgaattagaacttgcgcagtgtgcaaaaaaagttatctgaggctaaattagaaaaataaagatcagacataatttgaaacaaagtaggatatattatgaaaatagatgcacaatggagacacgatttttacgtggaaaacccttataggaaaaaaccacgggcgctgaccaacaataatcactatagaggagttggatacaaatgcggggaatacattgggctgttgcacccttcttgtgcggcttacgagggatatatataggagaaatatatgaatcctagtggggaaagatttaagagtcatactagtaaactaatcataatagtcaagttctattagtaaacttatccgaatatattgcaggcctaaatttcggatcacatatttaacaaaatctccaccttgatacgaatttcccaacataaaaatcttcaatctccaaacaacctcacatatgagataaaatcactgcgcggcaaatagcctccatgactatactgtatcaccctcgatccagaagaggtagactatacttcaaactcgccattgggaataaatcctgaatctgctagtataaaccggtgtgaacctagcagagatgcaaaattgatgcacaaactttaaactcaccatgggaataaaatcttgaatttgctggcatgaatttctgtaatcctagcagaaacgcgaaactcttgtgctcaaaacggagtacttagatcttcttattaaccttctgatacactgggcaaacggacgtagcaattccgccgaaaatttgaccaccctcatgtgatttggacaggaaccttccaactccctctcgatgatttcgcttgtgtgtcctgaaacatgtatg

SEQ ID NO: 30480 - DNA, 654 bp, Oryza sativa
  unsure (1)..(654): unsure at all n locations
aggaaattatcttaggacagtcaaacatttttggaacgtactgaattttgatttttcgtcccaagaactgtcgatgaactacctgaagtaacctaccaaaagtacgatttggttgcaaattatttgagaaaacgcacagtttacaaatgtatttcctatagtacaaaagatggaatgttggaggaaaaacatacttcaaccgtcctaaaatgtagctacctagtacaggatggaacattatctagtactacgaatctggacaggtcctgtactatgtagctacattttgggacggaggaagtagtaattttagagaatttcaatcctataggaaaattttctatgaagccatttgaaacaaaggattaaatcatatccaatcctttgaaatttctatggaatggacgatcctatagagattttagagaaaatttagcgagaacttcaacctcttggtaacttttctctgagtcactctctcatccaaattctgcgtttttcctacggttcaatctaacggtcattcctatgttttttctgcgttttgcaatcctctattttacacttatattcctatcaaaattctacgtttttnnnnnnnnnnnnnnnnnnnnnnnnnnnnnnnnnnnnnnnnnnnnnnnnnnnnnnnnnnnn

SEQ ID NO: 30481 - DNA, 646 bp, Oryza sativa
atccattttaggaagtggctgatgacgccgataaatcccatcaccaaaaccacgacccaaatcaaccccatccaacacaggaggaacaggtggattcaacggcggaggagtcgcggaacctgcaccttgccgacggaatccatggcgagatccaccttggtagtcaccttctcgagactgccaccttgggaatccagccgctgatcaatctcgtgcatccactttgtgatgccttccaacttctccaagagtttggactccatggagtccattagcttgcttcaaaggggctgaaagttttgcgggcgccgtggcgaatcagtaagaatccaacgcacggcgacgcccacaacctggctctgataccactgtaacactatgccaccgcgaaactcgccgccgacgagagagagagatttagacgagatcggagttggggacgaagagaaacagagctgaggcagaggagagatagagtttggagagagatagattcgatttcttttgccaggttggccacagccattctctctcttgagtatttatctcctgattacatgggccattggcccaaacgatttaaggcacgcaggccgcattatatttgataaagtctagcccaaaacacacacactatcattcacag

SEQ ID NO: 30482 - DNA, 904 bp, Oryza sativa
agagatcccctcataatttccccaaagcgtacccatgtgtgaataaattttgagctagtagggttgcagccacgagtaagtcttcccttgttattgtgtagccagaatgccgcaaaacttccatgcttaagcgaactgttgagagtacgtttcgatttctgactgtgtaagcctgaaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaccaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcg

SEQ ID NO: 30483 - DNA, 626 bp, Oryza sativa
ccgcgcgatggcggcgtggtggcagtggccgagggcggcgaggcgggcggccacgtgcgcctggtcccgccggagcgggcgccggaacaccgccgcggagtgcccgcggagggagcagcggaaggaggtggaattgggggcgagccggtgggaggaggagaagttggcggtggcggcggcgagctcgtggaaggtgaggaggagggggaggtcggggagagaatcgcggaagagcctggagcaaggcggcggtggaggagaaggtggcggtggcggtggatggcgcggaggaggagaaggtggtggagtactgggttgccgtggcgcgaggcgaccgctgatgctgatgctgatgctttcttggggtggtgccggtggaggcggaggcggccatggaggcggtggcgacggagctcttggtcttgcacatccgatgatccttctcctcctccttctccttctcctccggctccggattgggcttgggtttccgcttccagagggtaaccatgggcgaggcgacgagctccgagctcgcttgcttggttgcttgattggttgagctagtggccgcccagatcgggaggcggctgctgctgtggagagttgaattgcggccagctaat

SEQ ID NO: 30484 - DNA, 202 bp, Oryza sativa
ggttgcatttagaacacagatgataaatgatttgtagtttgcatagcccacgcagttgttaatccagacacagtgatggtcctgcaattataattaaaacttgttaccaagtatttctaacaaaagcttcattttgcaaccaacagaacctataccgacaaacattagccacacttaccattttaagaacacaccttttgca

SEQ ID NO: 30485 - DNA, 434 bp, Oryza sativa
  unsure (1)..(434): unsure at all n locations
nnnnnnnnnnnnnnnnnnnnnnnnnnnnnnnnnnnnnnnnnnnnnnnnnnnnnnnnnnnagttacagattcctttctgaatctctcttttctgtctatcatccctccctattcaattcctctcttttcatatcatatctagtactccttcctatctttcagtctctctttcagttccctagatgctaatctaaatagtctttcacatgtcaaagatgatcttaatcttgccaccaaaaaaacactaccaaccaacagatcaccagaacactgattagatttctcgcactgctttgccttgttaatcaccagcaaaagagatcaggcgatggagcaggcattggggttctcgtcgctgagcatgaactcggtggcgagcagcgcctgctggtcgtagaannnnnnnnnnnnnnnnnnnnnnnnnnnnnnnnnnnn

SEQ ID NO: 30486 - DNA, 487 bp, Oryza sativa
  unsure (1)..(487): unsure at all n locations
nnnnnnnnnnnnnnnnnnnnnnnnnnnnnnnnnnnnnnnnnnnnnnnnnnnnnnnaaaaaaaattgcatcttttttttttactgtgaggatgcatgcgatgcggcggtggtcagtcagtctccggcgaggtgcggtgggcggtgagtgagtctccggcgaggtgggtggggtttcaccttcacctgggagcgatggagatggagatgtcggtggggatgcggaacttatcggaccaatcctgcgcctccaggaagagcttggacaccttggcggcgacccacgacatgtccggccgcgccgccgcgtccctcgccacgcaccgcagcgccaccgccgtcatcgcctccgccgcctccaccgggaacgagtccctcagcctccggtccacccaccgccgcatcgcctcccctcctcccccctccgccgccgcctccgcgctctcgatcaccgacggggaccgagctcgaattcgcctatagtgagtcg

SEQ ID NO: 30487 - DNA, 742 bp, Oryza sativa
tctgcagctttgttgctggataatcattgatctcgcattgttttatatctgactgcttgcttgctggagccgtaagtagatgtaactggagatggaatttttgcagcaattggtcttgccaccgccgtcgcacgcgctgcccccaccaagtctcccccgaggccggccgcacgaatcacgctatgccgcattgccacgggctgccgccggcaatccatgtgcgctgatgtgcagacagaggtgcaggaggaggggaaagcgcggcggggagaagttgtcgtatatgatggtggtacgggcggcgctgctcctcctcgtggcgctcagcacactctcgctgctcgccgcggggtctcgggacgaccgccatgccggcctcggtctcgccgcgcttctgcccatccacagttgtccccggcaagcctctccccgcagcatcgtcgcggtggctaggcaccgtgatggcggcgagctcctagccgtcgggatcggccggaggagcgagagaagaagagaagtgtggttgatagtgggccccaccatttttcttttatccttgccactgacaggtgggtcccacctgctgactcagcaagtcaacagggtcaaagatgccacgtaggacaaaaccgcctccaaaaccacccggggagttgatttgcaacggttttcggagttgggggacgggttatacctggttttgtggttgagggatggtattcatacacggccatgttgaggg

SEQ ID NO: 30488 - DNA, 752 bp, Oryza sativa
ccttaattctcctttggattcttccctttgcttgctatgcttttgcttctcttctccgcgtctcgttttctgatcatcctgtcatgttgttgctgctttatttcgatcttcttttctttctttcttcttccaagcagttattgtcccctatctccttaaccgcattctagcttacttctccttaatttctgaggctacagagtagtatttatgatatgcaactgtcgattgactatctgaatgatgcagacttcgagtatatgatcttggttcttgtccatgaaaaaggtagtatcagagtacacatgcatgcagagaaagtataatgcctgcttggtcactggctgtttgaccgtattaaccaaaactatacgcaacttacgtagaatgtatcgtgtgctcgtgcagattacgagacgacgacgaaaagagattggcacgccacacgtgcaaacggttgcacgagcaacgggacttatggagactcattcatcatccatcccaatgggagtttttttttttctttcttctcctctcattcagctactacaagtttacaagataggtgagatcacaagaatggagatccatcaatgacaacgtacccatgtacatagccagccagctgcccagctatatcatcaaagtataaatcgcattcttgccatcaaaattccaagcaattgcatcatccgtatatgtcacatactcacaacccatgctgatgtacacaacatctcaaaatgaatgcc

SEQ ID NO: 30489 - DNA, 1237 bp, Oryza sativa
  unsure (1)..(1237): unsure at all n locations
ttgcttaatgtactataccgatcttttgattgatagccagatattatccagctttttaggtgttttgtcgcttaatgatccggttatcgactcgaacagaggtttaccacatacttcctaatgaatcatgtgattcagtatttccgactatatgtttgctcatagaaagcttatactccgtgaggcagacgatggttatatctagatttctcagtggttcagtacaactgaaccataccgactatatttgctgattgaaagctgctattttgtgaggcgatttgttgatagaaagatcaaagatagactttcaagctgctactaggaaacttttgaccgctatagtttatggtgaattgatcatacctgatacaatcacatttaatgtatctcaatatctggcggtctgggtacaccagcctgatattgcaagttttttctcatctcaaaaaagggagagagagagaagtcttcaattttttccccaggtttcttgctgggtcctgttgatagaaatatgccaatatctttaggttgtgttccattcaggattttgtgttagtatgaattaagaggaatctttgatcatagatgttaaggctgtattctttttcctcatggcatcttgccattatattccatgagaaacaatagttctcacaaatcaataacatttgagcaaaatgtggcagcagttgacattcattttttttatgaattccaatatttgttgtgagcaaaccttaagcagctttaataacacgtcatcaaatttattaatcttgcataatttcttctgatcaggtgatgttcatggacagtattctgatctcctgaggctgtttgattatggtgggtatccacctcagtccaactatctcttcttgggcgattatgtggaccggggaaagcaaagccttgagacgatatgccttcttttggcttataagatcaagtaccctgaaaacttcttcctactcagaggcaaccatgaatgtgcatcggtcaaccgcatctatggattttatgacgagtgcaagcgcagattcagtgtaaaactctggaagacttttactgactgttttaactgcttaccagtggcagcattgatagatgaaaagattctttgtatgcacggaggtctttctccagagttgaataagctggatcaaatactcaannnnnnnnnnnnnnnnnnnnnnnnnnnnnnnnnnnnnnnnnnnnnnnnnnnnnnnnn

SEQ ID NO: 30490 - DNA, 703 bp, Oryza sativa
ggaaacaagaatcctgcaataacagattttcattagttgactgtttaattaattcctattgcaaagatgtaagtaaattcttgtcatacgtaatgatttgaatggtaaatgctttagatatttgccaatctggcaggaactgacaactagcaacaaacagacacaattgactctataatcttatctttattattactactatagttgccaccaagttttttcttcagttcttcaaccatatcaccttaattttaccaaaatcaatcccaaaacaagggaatccccttgtttccatatttcaatcttctcatacccccaaacacaagggaaaagggcgcagacgcagtgtaaacaaaatttgactgtagtggcagcagcaaccccggattcgagcctccaaccaccggcctctccaagtaaaacacacatccgcgagagtcatcaccaatatcgactagatttatccatgccgaaccaaaagagggagctaaagcaaaaaaaagtttgggggaatcacctcgggtggacgcgggcgcgggcgattgattcaggacgccggcaaggccgcggcgcaccagaggcagaaaccgagtggccatggcggcgaactgtcgaagcaggagaaggggaagggctggtcgccgccgccgccgcagccgcggggagccttcttcttcttgtcggcgaagaaacggtcgaagag

SEQ ID NO: 30491 - DNA, 672 bp, Oryza sativa
acgtgcattccttttcgtctggggcacggtgactgactgactgaaggactgacttaacatcccctgtctgctgctgctttacataagaatctgtacatttcaggccaccttcgttcaattatgtgtgactcaatacttcaattatggtgtgtactccatgtctccatttaggttaagacccagataaggtctaattatgcataaatgaaccagacacaagtccaacaagcactagtaatcaacaagatgctgccaaatatgtactacaccctctgatgcctgaactttgtttgcatcaggaaacggacgaacagatgatgcaggaattcaggcttcgatgatataaactgagatgttgttttcagactgcgagttccggtgcacatcgcgatcgctgatttacagatttgtaggatgcgtggccgggagattttggttctgattcagctgaaggtacaatatgcttgtgcagtagtggtccacctgttgctcttgctgttgttcggacgttgctgtcttccagttcatcatcactagagtagtactcttgcaacacgacatttgcagctccaagaatgggaagcaggagagcttgagggcactacgtctctccagtactagagaactgaagcttctcttgtaatgctcgtggaaccttcttgctgtcggtgg

SEQ ID NO: 30492 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnnactaattaattaagtttaataaaaactttcattatctaaaaataaatgactattactagctcagtattcccttcattttatattataagacgttttgatttttttcacatacaactttatttaagtttgattatacttattaaaaaattagcaaacatatataattttcatatatatattttttacactaatagtgcaaagtgagcacgtttaaatgcattgtacttcataaaaaaacatctaacttttacagacgaatctggataaatgcatatctaaattcatcctcaataattgattcttttgggaggagtgagtacaatgggttggtgcgctttgtccttggaccctacaataatgatgattgtttctttaacacatgggctatgtttatcccttcctgagcactgactaccgaggcaccgagtgtgagaggcaacggcggtcagggagcaggcgtggttcgtcggcgagcagctgcgggcaacggtgccttggcgtcacgcatccgccgtcactcaccttaagcttgcgggctctgcgaccaccctctcatagtcataggccacagaaggtgtagtaatacttcatacatttccagcagcttctttcaaattgagatgttttcgagcttctaatttttggatgcattagatagtgatgaaa

SEQ ID NO: 30493 - DNA, 788 bp, Oryza sativa
  unsure (1)..(788): unsure at all n locations
nnnnnnnnnnnnnnnnnnnnnnnnnnnnnnnnnnnnnnnnnnnnnnnnnnnnnnattcacacaactgaggggttgaaaatgactgttactcggaggacaaagccacctgtaatcccaaacctagagatgaaagtcatttctgattcaccagaaaacatgagtactactacatcaatgcccgtttctgctgctagtattgcttcaggagaagatcaacaagggcaagtctcagcaactcgaatctgagttatgacagcctcagcattgccacgacatacagattgagtatgttctttctccttgggtcttcctgagattgaaatagctacggttccttcagcttataatattaggttcattttttatctaaagatttgtcacattcgatattggtgtttgttgatttttttttttccatctatcttgattgacctgttgtggttctgggtataacacatttccatctttcctgttagtgctcagaagtggcaaaggaatagccgaataggcatatctcttgcatcggcattcctattttcttctgttaagtcctattgttctatgcatcctctgacaatgaaacttcaataaggtcacttttatatccatctttgaagcaccttggtggttttgttctgaaagataactaggcatattcattcatctatgttgttgtggagaccattcactaacgtaaattttttcacaggcatacaacactggaggtctcatagtgtgcttattgtacaaagaaaagctctccggttattttctcaggcttatcttgg

SEQ ID NO: 30494 - DNA, 1540 bp, Oryza sativa
atcatcatcaggatcaggtagggcagatttcaggaacagggggatcgccatggagctttgcctgctgctccgaccagtaggcctgtgcggcgagcacacggtccaggagttcctgtggaactggagctccccttctttgctgcggcgctatgctcgccgtgtgcaccagggtcttccacttgtcctggttcatcaaatattgtttcacaggttttcagatagtgcatcctgatcctgatagaaagaggcagatctgaagaaaaaacgagatagatttaggcttaccttcagatcaacataggtcctatgatgaacattttcaaatgcgcggaatttgacgtccctccacctagacaaccagatcaagaggtccacatgagacacgcgaactgcggtgatgatctcgtgcctataggaataaaactactggggcattgaagccacaaaccttcctgttccaaggtgctcgacggcttccaccagcaactccacttcagcaacagtgaaaggcctccttatccgtctttgcccaaaatctggtcgctttgacctagaaagcggcacattggccagcgccagtgagtttggatctgcaaaagggacgatggcttgggagcttgctgatgtttcttgtgtgctccattccacgggataatcaacagaaccaggatcactcaagctgcagcctggaaaatcttgcataagctgctggttctcagcaggttcttcgcatttcaccctggaaatggaatattaaaacccttagatgaccacatacagcaaaaatttatggtcgtgtagtttccgaaacttctgttgaacaacaacgttgacataaactatcagatgcatcctgacaatgttttctaatcatcacatgtaaatccaagcctcctgtctaataatgcaaggagaagatgctttcttgtaacctacgtagcagacttgtccacaacagatgcaccaacaaaatccatttcttctggcactattacaccagggtgagaatcttgcccagcttcacattccagagtaaagcctatgtcatttagttttttaccacggcaaatcccagcctgacgaagcgtcttgttgtcattttgaatattttttccttgaagaagtataccgacacggagaccgcgttcaattatagtagtaacagcatctgacacagttttctgaagacaaatagaaagaaataatgtggttcataagaaagccaatgtctatgcacagagataaatatttaagtgtaaagcactgacaggcagaaatattcaacatatataagattaaaataagtgtaacgaaaaggcaccaccttttcactatgtataagtacgttgcatcactaaaactagaaaactagatcagtcaaatacacattagcatggatcacagagcagcaaatacttgatatatttgagtttccaaaacagctgacacaggatacactaacgatactaagattattgacagcaaatggaaagagtatcaggatgcacacatgaatacatggttgccaactaataaatat

SEQ ID NO: 30495 - DNA, 11594 bp, Oryza sativa
gtgttacgaaaaggcaccaccttttcactatgtataagtacgttgcatcactaaaactagaaaactagatcagtcaaatacacattagcatggatcacagagcagcaaatacttgatatatttgagtttccaaaacagctgacacaggataacactaacgatactaagattattgacagcaaatggaaagagtatcaggatgcacacatgaatacatggttgccaactaataaatatatgttacagccaataacttttactgagaagatacacatatggtgttttaccttcaatgaaccaactgttgcattttcagggatctcaattagtagttcagggatgttgaaagatttgatggttaacttgactgaaaagagagaaaaaagtaagtcattgtgtttataaattaagcaatgattcttttaagtcaaccccaaaactaaaataaacatccaggacgccatcatagccctcagatgcacatgcggatttggatcacccatacaaaatggagttccactggcagaaatggcatgcccgtgtatttttaggaagtgtatcaaagcaggggttcagaatatccaatgctgtgtgtaagaaggattaagtcgtaccaactatgtgcaatgttacatcctggagcaatctaaataatttgtgacctttagatacaataagggaaacggacaacacaatacatactttcagttaggatctgagtttttaataaagcttccattatcaaaaaatactttcagttaggataccttcatcagatgatttttcggagtaaagttgagcaagtcttttcctcttcaaagttgtttgttgcactcttcggcgcgtagtgggcatcttcttttcacacaaactcagcttgttacctagttaaatgataaaaaacttggtcaatataaagtccaaatcctgctaactagctgaaaaataaaattaagtaggaaaagaaagtatcctctcttttcacaagctatggagctgtagaagagatgatattagcttgaaatacctttacaagacatctctccacatatcctgttgcgagctgccttccttaacctggaggcaaacaatctccttatcctgcggtcacctatataatgtggaatataaccacggttatttcctgaggtgcttggatgtacacacccagaagaattttcgtcatcatctctgtctgcagcatgctgcactttagccaaacacgagggatgggagttatgccccctgtcagggccgcagatgtgcactcctgagttactaccagagctagcctcagcaagaggtttggtgtccaaatccatggtctcgaccaaagcacatagagctgcagcatcactatcttcttgacttctgattgctgttggtctcgcccgatgcacttgtttaacctctgctgatcttgtggaccaaggttggcatactccaacagatccatactccggaattgtgccaagaccaaaacccaatcgacatgattttttactgctaacaaatgagtccttagccaacacatcaggctttgctgttagtgactctagtactgaatcagctagattttgagtcgacgagttttcagccaagcacatattagcttgtctgagaaagccacagatgcctgcacagcctactgtacaacctttgcagtcatcttttttcacagccacgcttctcaacggaaacgcttcatcaaactgttctgctttaactggtttcatgcttgtaacataaccttctggtgtttcatttatgttaggtccactagataaattgtcttgatcagccaacaatttttctgcagctgtcgcaagcaaatcaagtgcatacatctgctttttccttattcttgtggagcgtttaacctgaattacaatcgatcattaaaacttaccaaattatgtgggtagcacacttaacataagaacataacaaaaatgtaccggcgccaatgttgcgacacgtggcttaatgggagcacgatggccatgggatccatagtccaacctcttctgcaacaccatgtcttgtccttgactttaggaaatgtgttcagtgacagcaaggggaagtaaataaaacatgcgccatatttttctgcgtcgaataagcaagatttagcgaacattgatccaataccgaaagacatcctaatacagctcacaactaaaagaaaatgctgaattctatgcttctgaaatggaaagaattcatcattggtgagccccatcaaaaccgataatatctggcaagatgacattcgctgaaaccacagtctacttgtagtagtatatctttgctcttaaaaaggacaaattggggttgatggtgtgctctacaccccaccccgacatctgagatgatgttgtctggctagatctgtgtatacacaaaccgaatcaaacatgtttcggctcggcaattattcggttcacacctagagcataaaccccatcccgaaatgcaatcgagcatctcgcgtaactgacgagagggaagaatccgcattacccgtcgacgccgacgaagaggagggcctcgccgccagcgttgagatcgccgcagctcggctagggttttgcagctgcgtgttccgacagccgaccaaccggagcgggaggcgcagatcggggagcaccggagcacggcggaggggagcagatggcgcgcgccgccgcagcgctcgtcgcctaggattggttgacgacgacgacgacgatgcccatctgctgcttctgctgtgcatacaagaaacgaattttgcatataagtttccatttttttctccttttcttgaaaacatacaggagataatcagagcaggaaataaaatgaaataatcaggcaggttgtccgatcaagaagggtaaccttgtgggggatgggggaaggttccagaaggttcgagaagagcgggcggggaggaggaatcgctgcaagtggaaggcgcagggaggaggaggaggaggagagggagaggggaaaggattggaggagaaaaaccccgtggaagagaagaagcgaggattttccttgtgtttcttgctgttttttcttttcttttttttcttttttttttgatgatgggaagaaatggttttggggcagagtggttggttggaggtgggcttgcgcatgatgcatcacggcccattggatgatggatcggttgggcttaatttttgtttttggagcaaagcaatatgggccggcctggttatggcctggttatattcgaagatgggctgctctataactggaggcccaacctgtattatgggatgagatcccaaatgcaaaaatcacacaagtttgtcatgattttgtcgtaagatctgtccttttacgagtggaaatgaatagattcacgggccatggacttttctaacaatagattaacgccagcgcacacttcctgggctcctaaacaagtgcatttttttgcaaaaagaaaaagaaaaactttatatatatgaacttacttgtataatccattttccagctttacaatagttaattcattcgtttatacccttaatagttatcacaaatcattcggctattcaacaattaattaattaagcacaaacattcagggcggtgacaagatggggtctaccctgagaattatcctaagaacttggaagttcagggacccatgcacaagcaactttgagtttacgctacagttaattaatataaatcggaaaatatctctcaagaaattagaagtcaactaacacaaatcatattccccttatgatgcagttcttttctcccgttccattgtaggagtagtagctttcacttgatgcatctagcactgaatctacagcaaacggccaagctcgactgcaagttcagcaagcaacttggcagatgcatacacagcatcgaagcatccaagatcgatcgcccacctaacacggcgagctatctgttttccagcggcgaaagaaaccacgggcacggcgagtcggctcaccggccggccggtcggtactcagtaccaaaccaaaggtcaggatgatccggcttatccactgccacgtgacctgggcccaagagaatcccgccagccaatcgccgcgcgccacgtcgcccgctctgtccctgtagaacacacaatcatgtccgaattccacgtcagtccacatccaaacttggagaaatctgagagaattactcacactaacctgacttcttcactgatgaatgcaacccatcgtacttggtagtagtagtacatatccatataaccatatcctgtttcaggccttgtcagtgacaccttggttaaaaccacccatgcaccattctgctgctctcaaatcactatcctgaatacactaatctcaatctaattactaagtttcagccaaacctcagaatatgcaaaatagtcatcttcagcttgcaatttgcagatccataagttttgccatatgcatggactatgataaatgccacctctgaatctctgatagcagaaacaaatgatgatgagatactaacaagcactaatggagtattaaaaaagatctgagcatggatgaggtcaaagtccaccaataggatctgagcagtagcagtcattggtgggccagcacctcccatgcattcctatccacctcagctccctgacaatagacgcaagtatccagttcactataaatgaaggcctccggctacgatctgcaggagaaaaaacagtcagaagctaaggaagaaaaagtatagacacagtgatacaatggcctgcatcaacacattccagagctgctccgtcctcaagggagcaaagatcaatggtaccaagatcggaggagggaggggatcaccaaccttccggtgccgggcatcgacgttcatggacgggagcctccggctagagatcgacgagaaccctgaagccatcatctccggtgagtggccggagaacttctccctgctcagctacgacgatctccgcgcctacctccagtcacaggaggccgctgctcaagccgacaaccaggtgcactgatcacaccatatatacatagattcttcttcttcagatcaccaactgtcgatcttcttcttaagatcttgctaaactctgaactggttgcatggttggtgaattgaccagcgtgtggcgctcctgagtgaagccatgtcggcgcctgtgctggtagccactgccgagcagacgctggaggaggttgagtgccactttgagacggtctcaggtctcccagttatagatgccagcctcagatgtgttggagtgatcgtcaagagtgaccgggccagggcttctcatggggtcagctctctttctcctctcacacacacatacatgatacatatccctctcactcacgcacatactcaacaacaaaaataagtgctgatctattgcttcttgtaacagtcaaagacgaagattgcagaagtgatgacctctccagccatcactctaccatctgacaaaacagtaatgggtaatccatcgttgttttcgcccttattttttttggttattttccacttagctaccagttaagctaacaaggcatatgcaatgtctacagatgcggcagctctgatgctaaagaagaagatccacagattaccaattgtaaatcaggacagacaagtgataggtgagttttgagcagtggccaatacagaaaaaaaaagggctttcattttttccccttgattttataccatccttaacattgataattcagagtatgttgcatgctaaatggagttccaaacactattaacaggtatagttacccgtgctgacgttcttcgcgagttggaagccctgctggaggtttagacgtgcagtggtccatatgcttcggccttgttgtatatatgtaaatatatgccatggtgtttttgaatagcaggcatctctaatctgtaagagtgttgtagcgcgaatcaccaagataagcctgagaaaataaccggagagcttttctttgtacaataagcacactatgagacctccagtgttgtatgcctgtgaaaaaatttacgttagtgaatggtctccacaacaacatagatgaatgaatatgcctagttatctttcagaacaaaaccaccaaggtgcttcaaagatggatataaaagtgaccttattgaagtttcattgtcagaggatgcatagaacaataggacttaacagaagaaaataggaatgccgatgcaagagatatgcctattcggctattcctttgccacttctgagcactaacaggaaagatggaaatgtgttatacccagaaccacaacaggtcaatcaagatagatggaaaaaaaaaaatcaacaaacaccaatatcgaatgtgacaaatctttagataaaaaatgaacctaatattataagctgaaggaaccgtagctatttcaatctcaggaagacccaaggagaaagaacatactcaatctgtatgtcgtggcaatgctgaggctgtcataactcagattcgagttgctgagacttgcccttgttgatcttctcctgaagcaatactagcagcagaaacgggcattgatgtagtagtactcatgttttctggtgaatcagaaatgactttcatctctaggtttgggattacaggtggctttgtcctccgagtaacagtcattttcaacccctcagttgtgtgaatcgttgctccagttgtcatctcaacctatcatattgatacttcacagtgattatctgtatgttgataactatgaagaaccaggaagcagacagaaattataccggaggagctcctggagccatttgaaaatcaaagcgcctgacaagcattgcagttgccaccacagtctgcatacaagttccggcatatccatgttattagagttggaatcttgcatgctcaatagttattgtactacattatttatcatggcatgagatataatgtccttatggtagacaacagaaggctcaaggcaacaaggttcagtaagactggaccatacataagtttgctatgtttccttaaaatgacattttgaaattaaaagaagaaatccttcaaaaactaaaacaaattacctcgaaagtggcaaacatgtcacctacacatttccttggtccgccaccaaatggcaagtaactgagaattcaacagaacacgtgagtcccatttagctatgtagattcatcaaatatattaaattagccagtgaggcagtgacagctaacagatgctagccgcaatacacagaatgaaagctaccacagcctaaaattggagcttaaaaagtttgacatgccaactgaaaatcaataatttggatgttgtcttgaaagaaagatgtgttccgcagtgagttcaatctaagctgacaaaataatgggacatgtcatgtgccaagtaaatgcagattaccatttttaagtttcagtgtgatgcctaggagacttgctgtacattatagttgatgatacgttggttgtttttcaattaacatgatttgcaggtcacaggttttatgccgtgcatcaactccctgcaagactgcaacacggaagaagtttgtagtccagtcggaagtcttcattaactcaggatggcacgaattgttacgtcttctaatcaagtaaggattttgttcaaagcacctctgatgtttgttgatccatacaaagggttctgctgttgacatacttgctacaggtaaggaactcatacgacatactatcagtttatacaaaattactattccaagtactgtttctgcgtaaccagttaacagttctggcgatgtggtaaagttgaaaagtactttcaagcactatcagtttgaaagtacaatagcattttggcacatgttgcttatagccatatgaatatcattttaacatgattgtcataaactgtggtttagctcccaaaaccataaatttaggaatcaagtcatcacagttatctcatctttactgcttcaaaagaaaaaggtcccatttttctttatgttgttgtgactgccttatgcactttctaagattgtggctatgcacatgccagcattagcactaaattaatacgaatcacatgaagaaaatttgatgatttgcatcaaagaagaaaacgaaaatcagctagagtttttgtttttgttatctctagaataattacaacaggtgcatcgcatgaccaaataacttagtgttagtagatgtaaaaacgcaaacttctcgtcaaacaagaacacaactataccgagcataatcaaatgtctactgatttttgtagtagaaagcagaaactaataaaatgggggaattagagtgataaggtgcatccaaataaagagctaatgcatttcatagcattaatagagatggaacctgaaattttggtttgtttcatttggatttggtccatccaaaggccatctttctggattaaaaacatctgcaccatcccaatgctttgggcaatgatgtaggttccacacggatatgaaaatgtcttctcccctgggaaacaaagggaaaaaatatcttatcagaattataggtgaagttcaaatttgtactgaaatttttaaaaaggaacaattcagacaattaaatactctagagctacgaccagaaatggtatacaagcagaagacaaaaatatatcacacaagattgggaagatattctctaaaaaaagattggttagataacttatacttgcacatatcttaggccctctttgtttaggcttataagccagcttatgagctgaaaagtctaagcctaaacaaacaaacagcttttcgcatgttttttttaaaagccataaaccactattacactattaaggctcagcgaactgttacactattaagacaaaagctaggttggaaaaggttttttggcttatgtgagatagaggtatgactccaccattaaacttaggactttaaatccattggcttataaatcatataagccaaaaaaactgacttaaaatactaaaccaataaacttaagcctaaataaagaggcccttagactcagtttcaccagaactttactggtgtgatactaggcatgatctttctgttttcctattccaattgtaacaacagtcaacaggactacaggagagatttcctacacttgagaaataagttctgctagagttttctttaccggccaattgggtaccctcccagcatatcctcctcaatagagcgacgaattaaaactggtggctgtggatagagtctcaatgactgcaaaagtggtgattgaatgacatattcattcagtgatcatactcattgtttaatgaggtagcactgtttatcacttacttcgttaattactctagtagtatacttcaatttcttcacatcctcaattgttggtaaacggtcacctagaacagtatcagcctgtccataagtgagtgaaacaagtcatttgcaacttgtaagatgtagaagcacgtgcctctaaaaataacaatcctaaatgtaaaagcgaatttacctcatcttggagtttggccattacatttggatactgcaagttaccaatgccaagaaaggtaaaacatgagtggtttgacgtatacaatattcatcattacatattgctacattaatacatcaatgatttgagttgctgaacatattttcttttgggaacagctacggaacatattgataccttagatagaagataaaatgtccatgtcaagactgctgcagaggtctcatggccagcaatgagcattgtcatcagatcatcacggagttgcttgctggagacctaatgaagacaaattgaagcaatgtgaggaccagaatgtttggagatctataatattttaaactgcaggtacaccatacatcatctccagatgccaaaagaaagtggaggatactggggtcttgctcattcatgtattcttcatgaaactgcagatcttcttcctcgaccaatctctgcaagagtaacagcagccaatctaaaagccttgatttttttaaaaaataaataataaggtcagaacataagaaaagaagttcaccttgcagatgtcaattagttcatcaagagtcttatttatcagcgcaagagcttcattgaccttcttctgccgcggggaaatatctttccatatgggtatttcccaagttggtataggagaagtgctccgcatttctgcttctcgcagtgtcacatacactgcctgatcatcaatccaaaaaaaggtaaaattttaagaaaacaaacatgaacaaatagaatgtataatgaattccaaaattacagtacaagactgaatactaacctcaactattccattatcgtaagacaatgagtcgaaatcataattgaagactgccttcccaatgacatccagtgttagtcgagagaacaaagattccatctccacatcctccccatccgttgctgccttgtccaacttctggcagagccgatctgaagcatatccgaagagacttatcattgcggtaacgtactgcaaagcgaaattcagatcagttcaatcacaacccgaagatcaaatcatgctaaacctggtacagaaatgatgtagaaccttctggtgcattgctggtacaatggcgcgcctcctaacacgccaaatctccccatcagcagggatcaaacccgtacccatcacaaactctaaaatttctgccagaataccctgcacccaccacaatcaaaatgcaggccgttaatttctagagcacagcctagaacacgtctacatccaaaattgacaacacaaaaccttggaataagccttggagttgtccctcaggatgtgcttagctatagctggatcagagacaatgaggaaagactggggaaaacaagaaaagaacaaagtttaggccatcaataataacacaaaattgggagttgccgagttggagagcaaattggtctgattgtgcatcaccttagggccgaaattgaggcgaaagatgccgccataggtaaggaagagatcatagagcgggatgaagaaagcctgccctgtcaccgcactcatagaccccaccgcctgcggtatctccggtccgccgccaccggcgaccttggtgagcagcgcggcggcgagctcccccggtgggccgagcttggcaagccccaccgcgaggggagcaatccacctgaaaaagagagagggagctctccatcagatcatcaaaggaggaaggaaaggcggccgcaacgtgagagagagagagagagagaatgagcactgacgcggggccttgggcggtgaactcgccggacgcaatgcgcgccgccagctcagcctggcgccgccgccgccgctcctcaagaaccgggtcggagccggagccgtcgccaccaccgcctttcccgttgccgcccgaggcggcgcagcggaggagcaggcggcgacgagctgaagcagcagcagcagcagcagaaggaggaaggcgcaggtgtgcctgaccggagccgagtaagcggcacggaggtggagcagcggcggccgcagaggaggtagccgccatggcaaaggcactcactg

SEQ ID NO: 30496 - DNA, 16946 bp, Oryza sativa
  unsure (1)..(16946): unsure at all n locations
cagcatcctcctcttcttctccgttgctacaattgaattggcagctaggatcagtctcaactgataaaacatactccctccgtctctagatatttaacactggtgatttttttaaacatatttgactgtttatcttattcaaatttttttataaatattattcaaaaacttgagtagtaatagtatatttaagaacgaatcaaatgataggaaaagaattaacttttgaataagacgaacggtcaaacatgtttaaaaaaaaatcaacggcatcaaatatttagggatagagggagtactacatggaatagaagttatatcttatacttcatccatcctaaaatatactctatccgttttaggttataaaacgttttaactttggtcaaaatcatattgttttaagtttaactaagtttatagataaatataataatatttatagtactaaattaaatttatcaaatcaataattgaatatatttatttttttctacaaacttagttaaacttgaagcagtttgactttgaccaaagtcaaaacgtcttataacctgaaacgaagggagtagaagattttagataaatgtggcatatccttgaactataaatctatacaagttaagaaaaatgaatctagacaaggtaggatatgtaatatttaccaaaaaccacttatattttgggactgactgagcagtaactaggagcaagattttctttgaaaattgcactaccaaaagactgcagtgaagaatgggaaatcagaatatagagataactgcagactaatcatggtaaatttgatataccgacagaaagtgcaggttttcgtgtggcggcagttggggcttcaagataccgtgaattggatggtattggcatttttataccttcaagtgcaaacagcatttgtcctggagttggatgttgttgccagagtataaaattggaacacgctgtagcataacagtgatggcaacgtgtaaaacaatcataagaggttcgcattttaatttttttcattttgagatgatcaaaggaagatcatgtacctggtaggtataacacaggaaacagtctccatatcctatcagctgcagctccaattgaacattcagatgagatgaatccaagtgcagcctcttctagtacaaactgtacaagagcatgggggctctctgaagagatgattccaatgcaactctttgcaagttttcgaaggaagacattgacacgtccatttccatcatccaagtcatcgaatgcagccagaagaaaagtagttttcacaaggctccaactttgcattcttcctactaataaatggagcggaaatagagaggcaattttatgttatcttcaaggtggaatcaatcatgtcgtggagaaaagaaagccatctgtatgtgtttcaccttttttttttaaaaaaaaaaatctaattggtaactgaaggaacacggcgcatgtcgataagcatcctgcagcttggagccttgggcaaatcagctggccttcttcagataatgcttccctcctaggcattggcccattccgttaatcacctgaagaggacatcacctgaaggggacaatagtagttttaggaacaggttaagacttaagacgttcaaaaacttggaaagccaaatgcagtgagtccagatgagccgagctccgaaatatgtaccttcgaatttaaaacagttttcacattgaaattgatattttttttccacattcgcctcatctgattgtggacatgggtagaattggatcccatatccaagtacagaaagtgtgcaacatctgttggtagttacactaaagtgccccccagactgtttttaaagaataataacctctacagagaattggaacagtgaacatcagggaatgtcagtaaaatttaacagttgctgttgcaacagaaacaacatgttcagaagctcaatggctaaaaggatctagcactgcaacattgattcgacacgagtggaactagtgcgcgctagtggtggcgcagaagcttgaagcaaagaaaattcagcatatctcaacatctggtacgcacacgcacatcagctaatggaagaaaagccaaattaatgagcagtcatactgcacaaatcaaaccactcgcacacatttgttaagcaattattaacaattagtattaatttgcccagaatgtgttgttactgatccgaagtgcaaatgcacacagatttttgccgtgatccaaacaatagctaaatcggagcaccaaatcgaccacacccaccagattttgtagcagacacagcaaaagcagtaatgtaggagtaccttggaatgaaggagatcgatccatcgttgaagccctaggatgctattcccttcctcctccaccgcctcctcgctcgaaccgcatcgttgaagtaaatctacaagttcatggggtccgtgggcacctggctcgacggcggttacgtggagagacgccggggcgtcgcgccggaccgtgcagcctgcgggtgggaggagatagggggtttgggattcggagaagacgcaggaggagaaggagatcagttgcagttgcggatgcagcgagctggagcgattggaggaaggattccttcgagcttggtttcgtgggagggcgccatgggtgttcgacgaaatgctcgagcgaatcagaggaggctattttttttttcaaaaaaaatgaattaagaactcattaacgtataattaattaagttaatattgtttgtaaaatgattaatatgaatttaaaaaacaaattttctttatatatatatatattaaaaaaataatgtttaatagtttaaaaaacgtgcgtgagttgagttgggaaagtaaaagaaaacacagcggtcgaacggacttggcagagaacgaatacaatccatatcgctgaacttgtcaaaaaaaataataccgtatgtatatctccagaagaacaatggcaatgtagttcattagtacagcatcggcgtgtaccattcataagaaaaagagcagtattagttcatatccaaatctcatgctatagcttgacatcctagagaagtcttgctgccatagccccacatcttcaagaacaattatttgtgcaaacgttaatgtcgtctttaaaaattacatctacctgctatacaggatgatatcagctaggaatcacaatcctccagcagcagataaatggccatggattgcattgtcatatatgcatatatttacaaaatagcatgaacatggagcacagtcagctttgtcagccactgtaacaccgaaatcttgtgtgaatgaaatgggataataggcatataggattacttaaacgtcgtgggaacgctggaagattaggagcgctacatcagctattttttttataaaaacccttgcgctttcggttaattatgtgccggtccccgctgttgtccaccatccaatttcgccatagggtcgatctggccgtccacgtgtcccgttgtgccggcccttccacgcccgtgcgatcgtcggattatggatggacggcctggatttcgcgaaacggtacaaaccatagccgcccgtcctctcctctccccacgcgcgtcggttcgcccgcctcctccgctcgcgtgcgccgttgccgtcgcagctccctctcctctaccgtgctgccgccgccgctccctcccaatgagccgccggatctcccagtgaggaggctggggccgccggatccggtgaccccggtctcctcgccggcggatccggcgcccagacgcccaccttctccgtcgctgccacagctcccttctcctctaccgtgctgctccagccgccgccgtgtcactctgcggccgccacccttgctcccgatgccacacgacaaaagtggtggctccttcgccttcgcctcctccgctctgttcctctcctctctccaactctcctcaccctcttctcctcactttttctacacctttgttgacgagaaaatcgaacacatcggcctgggagatctacttagctcctgtgcaggtccaaagattaatgagatgcgggcgtgccagtcagtttgatcctgcaactgacaagatttgcaaataatagatcaaacagccgatcagctgacaagccgatggagtagttccagccgatagccgataatagatgatgccgataccagccgatggcgatagggtttaagcaatcggctatatgtccaatgtagataatgatataaaggcaatcggctgatgataatataatatagcaatataatctagtataaaccaatcggctaacaatatgaaatagtagaacaaatattgatctgtaggttaaagcacacatcggctgcaggtccgatgtcataagatccacaagattagattaaacagtgaaacctttgttgccatcggctaaatccaacttatatgtatatgcaatccctacaagccaatgcaacgtccagataacttatcggctagcaccccgataaaacattagcatgaacctatcagcttaacaagacttatattatcaacaacaatctagtagatcgaacctaaccgatgcagcatgagattgtatatgataatctaatactcgatgagccgatagatctgtctaatatgatggatataacaaatctatttagaaaaacattatgattgtagagatatatcggctaagacaggagatcaaacctaaccgagacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacatagccgacagattcacagggcccgacagaacgtaggacttaccccttcgctggagatcgaaagccaatgcagccctgcgtcaggtgcccaagttccgccggaagacaagtaaaaacctcagggaagagggtggcgatgtgccgagagtattattgatcgatagattgatagattacaatgaccccgggtgtacatatttatacccatagggagatactagtccttgtcggacaagaaagaaactaaaaaggaaaagataaagtccttatcgaacactaaacacactttcctaaagataaaaggaaactaacaaactatgcctaattaataaataactgtcatgtcgcatccttcttgaactcgaactcttctagataagcttcctttgattgatccgactccaccaagaacacgacatcgtggcgacttgactcccatcggctgattctagaactttgaagccgatactgactctaaatcgatggtaactttgggcttaccaaatttcactattaacaaccttcaacgttggctcgtcccgcatcctgtcgcctcgccccaccctttcacgctttccgccaccgccgccctctattcctctattccaccgccgtcgctgccctctcctccgatgtcgatcccgatgtcaccacctccgtccaaactgcctttgactgtgtgccaggcgtcggcacaagccgccggtggtacttgccgccgtcgatcctcaatcccactcttcccctccacaggttagccctaaactcccttgctccccatcctccatgtccctcttctctcttttccattggaggcaggtgcaaggagcatttgtttttgtttttttctcttcgcaattttgtaacatagaagataggatgactaaaccattgtggatcccataatattaaacatgccagttctattgaactttttatatcttgatgaatgtgtatgatgatttacttgatactactttgatcaaacacacatattgctatcatgggcttcttggatgctatattgctattggccaacttaagatgcttgaattaggtctttttaagacttcatcagaatagttgcacctaacaaagtaaaaaccagcaactttgatggtccctaaagatgtcgaatagccgtatccctaattcgtcacattaaatctgaatgcaataaaatttgtgaagagaacttgtggattaaggaagttgcgcttcattttgatccactatcgtggcctacccactcatgagtggactatatatatgtgtacatgatctaatttattatccttgtgattggctgctgtcattgtgctccatatggataacacaaaaacacacacacacacacacacacacacacacacacacacaaaacagaagcatcgccttgcagttgcacttgccaattattgtatcttctatttggaggtttcgatgctcttttgttgtaaatgtttaatactaagttgccaactattatagcttctatttggatgtttggacaacgaggttgacgctggcaaggccgtgctcgcggcgtcgcttcctggtacctccaatttcttctctggcccttacctcatctctgttgccaaagatttccttccaatcggcaacccttctttcgcagtgctaacaaggacgcccccatgtggttccccgcttgcagttgggcctttcctccatttaataaagcctaggatacctttcaaatgtatgcaatgattctctttgcttgccaaggtaaagttcctttttagactgctttgagattaatatttgtgcttcttcttttttgccagcataagatgtacacttagaaacacaaatagtgtggatccatctcaaagcctttaggatcataatataaatgccctactgtttttttattactgcttattaagcttctggtatccctccactgcatatgaagtgtgacatgtctatgtgagttctgtttttccaacatataaaattataaagtcatcatgacctatttaaaactgaaattttagctatcattgacctatgctgaagccatgtgactttttttggtttacaccaccttacatgaggtgcatattaaagtctgtgtaccttaatttggttcttcctcttagctagaggtatactaagacatactagctaggagggcctacaatccattgataatgtctcactgaatgcaaattaaaagagtcttaagtatctatacagatgtctccagattttaactatattgtgcaaagatagaattaactaatagaacaacaaattgatgtggagaaaatctctgtaataatcaatgtctgctgcaattgcttattataattcatgctctgtacttgcgcgtgatgatttaaatttcagaataagtgtacagaaaataagttgcggtgaactgtgatttaaccatgaccagtgcccgaagaacagcatggagattggagagatgactggtcagacaagagcctttataggaacaaaatgcaacaccgtttattgttgattgggtcatatacaaataatgcaatccgcttatggacaaaaatcaacaaggaagatgcagtacatactacattctggagaacttgatagaaacaagcaagcattttaggtcatcaacaccaccaacaacaacactactccagcacgtcgcagcagcagataacggctaacttgcaaaatgaatacccttatactatacttcctccgtttcacaatgtaaaactttctagcattgcccatatttatttagatgttaatgaatctagacatatttgtttagattcattaacatctatatacatatgggcaatgctagaaagtcttacattatgaaacggagtgagtactatactacctatgtatactacccatgctataagttcattagtatagagttaatctgaattgttggatcgatagtacaatccactataatatactccctccgtttctaaatcttttaacaccgttgactttttagcacatgtttgaccgttcgtcttattcaaaaaaaacttttgtgaaatatataaaactatatgtatacatataagtatatttaacaatgaatcaaatgattggaaaagaattaataattatttaaattttttgaataagataagtggtcaaacatatttaaaaaattcaacggcgtcaaatatttagaaacggagggagtgcgatggtatagagcaccgcaaagtaactctaagggagctcagttaggccatttacaatgcagtgatgtgtcattctccctcgccattccacgtcggcaaagcaggagggcacacgccacgtctgcttctaggcccaccagaatgaggttcgagtgtccaaagatggccactggttcttggcgaaaaagaggacgaatgaagctgggagacgacgctgcttccgcgttgtggagtgagtggcatcgccctccttcccatgccagccgtcgccctccagccagccgcctagcccaccgtcgctgtccgcagccatcgagctcgttctcgtccctgccatcggagctcgccggccacaccgcccccgatccgctcaacccgaagctcgccggccactccgtcgctcgattcacgccggtcggaggagagccagaggagaggggtcgcccccgtgggagccgaggtcgccggccgcgccggccttgcagggcccgaaaaggaggaggaggggaggcgctcaagcctccggttgcgagtggcattggagtgagaggcgccagcggtcgtgggggacaggaagggcgtgtcaccgccgcgtcgcccggagctcgccggccgctccgaggtcgccctgtaccgccagatctgcgttgccggcctggggaggagggcagcgcggcgacgaccatggtggcggcaacgaaactacggccgcaaccatcctcgcgccgcgcccggacgagccgtcgccactggatctggcaagctgccacgccgtcgtcgagactcgtcgctgccacgccatcttcgagactcgtccccgccatgcgagagcaggggaggccaagaagttcgccgccgtcgagcgccaagctcgccgccctgccaagaccgccgccgtcgtcgcctccttgctgccgagcgagtggcctccatgccaagaccgccgccatcgtctcctccttgccgccaccgccgtcgtccccagatccaccgacgctccgcccgggcaccccagcgccgtctccgctcgccactgctccgcccggccccgtcgccgtcgaggccgccgctccgctcgaacgcctcagtgccggctccgctcgagcgtgagagaagggaaggagcaacgttgggctcgaggaaagggagagagagagagagagcggaaaggtggagaaaaaaaaaggaaaactacatttttgtggaccccacttgaggtactgcattgtgcagcttgtgcctctcagtgttcctcagcatatgtggcagctcaggtccggcattttaggtgacgcattgctattgcccttaaaataaaataggttggtttggattccgagcaagctgttcccggattttcttcttcagttcaccttccttgcgccttgcttcctgttcctcttccgcccgggcagtctcataatcagcgcccgccgcgcgcgctgctcttatccttttctcatcgaagtgaaactcaaatctgagctggacttcgttgatgtttaggagaaactctagcccagaaaacccaatttcattttttattagcccttcgacctgcagccgctcaagtttgagcattgttccttcctcaaacttcactgatttggtgccccataaatctgcaagcttgagcaccttgaggcttccaaaagcagttccagtctgtggaggcttgaaatgaaattcttcaccctgaaacggtgaaatcactagaatttccagcttcggtagtttcccaaggaattccatagcaacatcgtgctccaatagcctagcgcccactagttttagcttcacgagatgctggagctccttgatccattccggcaacgttttcagattgccgtatagcttgaggctctgcaggttttccggaggcgaggatatatcatccaagcaaccacacaaacccgacatccctgctgaactcacagacagtgattccagcttgccgaggttggaaatggccaacctaaacgctcgtccattcttcttgttgatgccagccactcctaacttgtgtaatcctgtgagcattccgatgtctcgtaggatggcatttccccttccgatattcacgtcccttagtgtgtacaagtctttcagatttctgatcccctttggcaccatagtgccattttcttcatatactcccctcatgagagatgggaatttcacgcagcaagcgaaagtgcatgcatcacgcctggtaagggccttatggagagggccatcaatgtcccgaagaagaggaaggcaacatgttgcacatagataccccactttacaacgcctctccattaaatcatcctttatccccgttacagtctcttttgagcccaacatggatgtactgtagcttctgcagcttgatgatagtttttggcaaagcctctacatatgtacctctgatgtctagcatctggagttgcctcaggttgcccaaaaaatctggcagtagatcaataccagcgcatcctcggagagaaaggaattttaggtgaataagcttccaaatctgatcaaggtgatgatagtttaggcctctagtcccttcaaagtcgagcactcgtataaacctcatcttgctagaaaccaaaaatggctcccaatacccaaacagagatagcgatcgtattcgggacaggtccactatgcccttgaattaatccttatctcccttccagttgctacttatagcaagatgacgaattgcgccatggatgtacgagctgcagccttcctccatcctaaaaacaaggtttccctccattgactttgagatggcgatgtcacggatgagatcatggactttgcaagagtcaattgatttcctgctgcgagctgattgctggaatggtaaaatcatgcttctattcttgagttccatgaagtagtcgtcagctatttctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtgaaggatggttcatggctagttaatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatatacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatattgattacattcaccactgtcactggatcaaatcctattgtaaatatcatgtttattatcttgttattttggattaaaatatgccgaattatgaccaaatttccaacaatttcaacggcagacttcccatgggccgcagttgagtaaccttctgctgcccaccgatgcaccaaacgccttcgactaatgatctggtcttcaggaaaaatggacagatataaaaaacatgacttgagatggtagggtaaaccatcatagcttttttcaaggacggttcttatcattccaagctctggattcatttccaactcagcactgatattctcgttcaattttctccactcttctggggtctttggtcggtttgccaagaatccacctatgacaactatcgcaagggggagtccatcacacttctttaggatttgttttgcttctttaaccaactcaggattcttctgctcatctaaatatgtagccttctcaaatacctgacattgatacaatttaagctttattgtgctctaagtaaaacaaaaaaataattaagtttagaaatatgtctttactattaaaactagggaatgaagaccaccgtcacataccaaaacaaggtcacatctaacatccatccaatgcaggtcattttaggaagtgcatcgctatggttgtttttttacccaacccgctattgttgtgagaacagattaaattgtatatgcatcatgtgtatgctatttctgtctgcacaaatatcatcttgattggattactcaaatgaataaagaatatcaaaccaagaaaaatggagcacgcctatattaccttctcactcaagaggcacagtgcatcattaggtttaagaactagaaggttgtgcacagttccatttttccctgagcaatgattggcaatattttcttttcttgtagtcacaatgattaggcttgtcttttccaacagggggaataacattggttttatctggtcccattctgaggtatctgagaaatcatccagaacaatcaagcttcttttcttttctaaaagcctttccaattgcttagtcaactggtcaagctccatcgatgctagtgatttcttactgctgactctattttctaccagttcttctttcttagaagatccttcatgtagtcgcccagccaagctcctaaggagctctacaagattgaaaggacgcatgattgtgacaaaaacatacttgtcaaacttgtcgctcagctttgggctttgataaacacctccaactagggtggtttttccaaggccacccattccccacacagagatcacctgaacctgctggctattgtcttttaaaattaagtctattatttcagacatttctttctctcgcccaataagttgcgattcctccgaagcaccaacactcgtcctaatgcgagtaagactctttctaaccaccttcttctcatcagcatccatagattgatcatctataatatcaccatgggccactgtatgatcgtttgtacttgtggtggccacatccgagatagacactggcttcattgaatcctctccattttgggaaccctaaacaaaagagagcaatgattaagaacaacttttagccttaaaattttcatggacaatgtttagccttgttttcagtcatgaaagtatacaaaacaataatgataattcctttcattaatttgcagtatagtataaaccttagttttggatcctaatttgaaaaacttatatctgattgttcaataagatatgtattaatttaactttagaagaatgggataagtacactacatttaatccaaaggatgagaggatacatttgctagattagctcattttacaatcatctctctcagatagaggaaataaatttccgaattaaataaactgtgctaattggatatgaaatcaaatactccatatctaaattatttgtgaaataggagcttcaaaattttaattgtgcaaagaggactcgtgctacatttacatacttgtacaattntgtggannaatctgttagccaatctactacctccattatattctctaatcgaggcgatctntgctatccgatatatttcccttcgataccatcctttctactttcattagcattgaccgttcaaccttggaacataggatggattagaattcaaggtcgctggatatgaaggaatgccagcaattgcagtggcagatgagggagattgttttttatgaggcaaaagggaattttttttttgatgggacatatgagggaatcattatgtttttagtcgccgttttttgcatcgttgtcttacttgtaagcctgtattagaccatttatttttctagcatacatatttgttttgacaaatccaaatacatatatttgtggttgtagtcttaaaatgctgagcacatgcattcccaaaaaggcaaatgagagagagaactggagggggcacttgttagttgcattagctcatgtgcttctaatggaatggtaattcccacgcacttcaactggcctacacaactgaattagaaattacctaaggacataactgaattaaaaatgatatcaagcaaattttttcggggaagcgtctggtcttcgaacaaattttgcaaaatgttcagcgcttccaatccagtgcaatgagacggatctccaaactctccatgatgaattgccatgtcaggtcgcttccttcccttgcacatatctaggattgcctctgtccatcttccgcctgaagaaggaagacttgcagccactggttgacaaaatcgcgcgccgtttgccttcttggatgtctcacttgatgacgcctattggccggactaccatggtgaacgctgtactaagctcaattcccatctacctactcatggccatcaatgcaccgaagtgggttatcaaagggattgacaagatccgtcgcagctttctttgggctggaaaagcttctgcaaacggcggcgtctgttgggtcgcatgggctcgagtttgctcgcccaaggagtatggtggtttggggattcctgatctagagaggttgggaatcgccctgaggtcacgatggctctagcagcaaagaacttcaccggaaaagccgtggcaagggcttagtattccggtctcgcagaaggagcgcaatctagtatcgatttccatggtatgcttggtaggggatgggaattcagtgctgttctgggaggattgctagctgcagggttcctccattcggtcgctagcgccggctgtctatgctgcagtccctgctcgtctccggaatcgtcgcacggtggccgaggcaatgactgacagaagatggatccaggacatcagttccgcgttgggtattcaagcgatcctagagtatttcaagctttgggattgccttcggtcagtgcagctttccgaagagccggactctctatcttggcggtgggagacctcaggagaatactcttcccgctcggcttatcgtgttctcttttttggaagaactcgtctccagcacaagccaatttggcaatctttggcgccccctcgctgtcgctacttcctttggttggtagctcttaaccgttgctggacagcagaccgtctccggagtcgtggtttgtcacacctggatcgatgtgttctgtgtgatcaatgcgaagagacgattgatcatctcttggtcgcatgcccggagtcgtggcaactgtggtgggttgtgctcagagctatcgggcattcggagtgcttaccgctcaatgaacactctttcctctcatggttgtgcgactgtctcggtggattcacctttctggcttcacctttttggctctcgtgactgaaaggatgcatcacccttacccatgcatggcatgggaatctgatttgaacagctgggttctcgtaagctgtcctgattattgttgtttggcccatatcaccacttgttccccagaccgctatcactttaaggtcatgatcctccttgttgattagctggacgagatccactctctgattgtcctgttttgcggcacgccttgcatcatcaatgccgaatatggctgcagcaataacgctagattgctcagctgaggtgatggtggccttggagccggagcccttgatgaggtggtaccgcgcatttctctggctgacatcctcgaccttgttcctgagctccttcatctgcttggccacacggcgccgctcgagcagcgtgcgagggaatcgccaccaggatggcttcttcagatgaacagcaaaatcctggaggctgtcctcaacgtcataggcagtgtcacggacttgcttcacccaagtcttgaccactttgctgttatcttgctcctcgtgcgcctccatcatgaaagacctcatcatctcaagctcatctgcaacaaaggtgtggtctttttggataccaagctgcaaggccacctcctcggcaaatgcagattttgcgtagccaagcgctccattcagcacggatttgcccacactcagcgttgttgcctccattgttctgttgctaaagcatcaaaagcaacaagttttaaaataaaaaagaattatcgagaatttgcgtggctgaagctaaagcaactacttttaagaaagaaaataaatgacgagagtgagggagtcagagtaaagaaaaggacttggtgttgcttcctttgatcctttcagatgaccttcgttttccacctataggctgtagcatacagaaagcgtcgcctgcatcgatgaccactccgttcccggcggcccacctccacctccagcaacctaaggcccttttgccccccccccccccccaacaccaacacacacacacacaaaggaataagtccactatccctccctcaacatggccgtgtatgaataccatccctcaaccacaaaaccaggtataacccgtcccccaactccgaaaaccgttgcaaatcaactccccgggtggttttggaggcggttttgctctacgtggcatctttgaccctgttgacttgctgagtcagcaggtgggacccacctgtcagtggcaaggataaaagaaaaatggtggggcccactatcaaccccacttttttt

SEQ ID NO: 30497 - DNA, 5945 bp, Oryza sativa
atagcgtgattcgtgcggccggcctcgggggagacttggtgggggcagcgcgtgcgacggcggtggcaagaccaattgctgcaaaaattccatctccagttacatctacaaacggctccaggaagcaagcagtcagatataaaacaatgcgagatcaatgattatccagcaacaaagctgcagatagccaggtaccccaacaatagtatcaatcagaaaattgccgggtggcataccatgctgaccaaatttactaagctatcgatcagcaatttggtcgactgtattgtgatttttcaagcgtgtatgatactatgatgcctatgatcagcactcaatcactctgcccaagcacgcaaaacactgtcaccagagaatccccaatcgatttgcaaacccatatggcacgcaccagtgtaggcggcgaagccaagggggaaggccgtcgcgcacatggacgcggcggagaagacgggctggcccacctgcaggagaggccgttccacgtcccagggttgccggccagctccctcatctcgtttgccctcctctgctccggatctgaggagggggatggcggcagcggtgaagggggtagggtggagagtggaccggcaggcatgcaagctggagcggagcgtggcaccgaggggcgggcgagcaagagcgggggcgcggcctcgacggctggcggcggggtgaggcggcacgtcaccgccgggatcggccggaggagcgagagaagaagagaagtgtggttgacagtgggccccaccgtttttcttttatcattgtcactaacaggtgggtcccacctgctgactcaggaagtcaacaggatcaaagatgccacgtaggacaaaaccacctccaaaaccgcccggggagttgatttgcaacggttttcgaagttgggggatgggttatacccgattttgcggttgagggatgctattcacacacagccatgagttgagggagggaaagtggacttattcccacacaaatgtctctctggcccatcatcatggcccgctccttgccgcgcaccaccgctatagggaggagagcctggcctccagggtcggactctccccttctccatccctcctcgcttcttccccctcttcctcccctcacccctcctatctggagttcgtgcggtggccttgccgtgccccatgcctctttgcttcttcaaatagaatgacatgcaatgtttttgcgcgtacaaaaaaaaaagattccatcgtttctttctctcatgcaaaaccatgcatgtgactttcatatcatacgggtgctaaatgacaaaagaaggaaaattttgtcttcttgttttttacctttctagcgtatgataagaatgaatgctcattggatacacattctccatattatgctctagagagaactcgaacctccatgctcttttagcacgagattttgagtctcacatgtcttccatttcggcatcttaaaaatgaattatattccataaatatgacatcttgaaagggaattgtgttccagctacggcagctagtaaaatacagggaaaataacgcaaggggaaaaggagcaaatgggctggtgttcatccaggcaattggcagtacctgaatctgtgaacaccttcaaatcaggggtggatctataatcttcgcgtctgatgttcacgagtggaacagaccagcagcacgcacaaggcaaatgtgatgcaaaataggagtatgttctgactgtgagtaccaacactaaaattccaataagtcatattaccgactcttaggctttcatcactatctaatgcatcccaaaattagaagctcaaaaacaaacaatctgaaagaaactgctcgaaatgtatgaagtactactacaccttctgtggcctatgactatgagagggtggtcgcagagcccgcaagcttgaggtgagtgacggcggatgcgtgacgccaaggcaccgttgcccgcagctgctcgccgacgaaccacgcctgctccctgaccgccgttgcctctcacactcggtgcctcggtagtcagtgctcaggaagggataaacatagcccatgtgttaaagaaacaatcatcattattgtagggtccaaggacaaagcgcaccaacccattgtactcactcctcccaaaagaatcaattattgaggatgaatttagatatgcatttatccagattcgtctgtaaaagttagatgtttttttatgaagtacaatgcatttaaacgtgctcactttgcactattagtgtaaaaaatatatatatgaaaattatatatgtttgctaattttttaataagtataatcaaacttaaataaagttgtatgtgaaaaaaatcaaaacgtcttataatataaaatgaagggaatactgagctagtaatagtcatttatttttagataatgaaagtttttattaaacttaattaattagtacataaaaatgatacagtacctcagaacacttctaccttgcataactagtaatggccaataattgcaaactgtttcagtgtgttcatttgacagtggtaaagttgtttcagagaattggcatagtgaaaatcaggggatgacctgaacagaaactcacagttggagttggaacggaatcaacaagttcagaagctctcaatggctaatgaacagatttttttttctaagatgcaaaagcactactactataatggagtagtatagtaccttgaaatgggggatgccgatccatggttgaagccctaggatccgcttcccttcgtcctcctccgcctcctcgctcgatatgtcttctgggacaggacatccaatcgacttacaagtgcatgggggcgcctgcctcgggggtggagatagggtttggggtttggagaggacgggagatagggtttggggtttggagaggacgggggaggaggaggagatgtgcggacagtgcgaattcggcgccgtcacggtgttcgacgaaatgcgcgaacgaggcgtaggggacgacggggacgacggggacgacggaagcggagcagaggggatggcgagcccctccaggttgagactatggtcactaccattgttgccgatcgagcagattttccagagtaaaatagtcctacaatccaccgacgagaagtcaatgagctccccggtgatggcacggcggcggctcactcctcttgcaagccgccggcgatcatatgcactcaacatctcaaaaaatgtactagcactctgtgtatatcttcaccttcacatgaacaatgacagtgaagcatagtacaaattagcttgtacagtactccccctgtcccaaaaaagtccaattctaaggatgaatgtggagggaatactactcataagaagaaaaggtggagtacaacatcaactgggcaatactagtatggatcaaatttcatgcaagtttgacatccttaagaagtcttgcagccatagccccgcatcttctgatttcccagtcgtcgtccaagtagcctgcagttttggcttctgctgaatccactgagccagtacaaggtccaccactctcagctccaggatcttcatcatctcctggattggagacaacctcctcctcctcgttgttgccgttatcgctgacctcagggatcaatgtcgctttggggtccattatgtaaagatgaatactaggatgttggtatttcacatccatctgtgttagaattcaagaacagcgtgatggtagagaataccttttgcactgatgcagaaacagataaatgacaagggaagggagttctgataagatgaactctgaagtgtgtgtaccttcgatttcgagacggttttcacattaaaattgcttttccacatttgcatcatctgttcatggacagtggtagaacggatctcgtatcctagctgggtagaaagcaacaatatttacctcatatattgtcaataacaaaaacagaactgtttgaatggtggtgaaagcaattaccattatttttgttttaggaccagataatgcaatgattgtctccattagaggttgcaacagatgttctgaataaaccttcaaaaacacacagacaaaagagcagtaagccattgcattgtctctggactaccagtgctgttatcaattatttttggctattctgcatttctgctaaaaggctatcctctgcacttaaatttcaatccgtaaggcatgcctataacttacaaaatctagagaagcaagtgctcccgcacgtttgtaacataaccaagaagaaaagtttagtgactttgaggaaaacttcatttaggttaatatctgagagattcctcatgtaaaaattggcaacttattattacagcaagtgaccatgtgcaatgtcgattgctagctacactaaagtctctccagactctgttcttaaagaacaactgaaatatcatgacgcatgaaatttagcatatcagtaagtaggataagctatttgaggcaccaaactcaagctgccagcgcagaaaacttacaacatcagttccaatgatgtaatcgaatggaggatcaacagctcttatatgatctttgttaccccagtccaattctgcaacggtgacagagccgatggagcctgtttgccacgtaaaatcaattgttaggagaactagcaacgtccaattgttatgagaaacttccacaaacttaactaaccactaggcaccacttattgtcgcataagatctatgcatttgcaatgaccattgcgatgaccacatcttaagttcttaactctttcaaactatggctatggcatgtttcatgtataaagacaatggtaatgagtggacattcatttttgtacttagataacagacctgagtcagagtttgactgtgaaatccaagatttgttgcgttcaacattcctcaaaagcagcgggagcacctcaacttggtctgttgtaaccacgtcacaacccagcaaagccattcctggggagaagcgcaattttgttattgggcgagcaccatcaagattcagatagtatctctgaaggtaattcgacccatcttaccaagcccagctagaccacaaccagctcctagctcaatcaccctttttcctttcagtttagatggagaaaatctaccttttctgctattcttttcctggacaggatgggagtaaaaccttaaatgtcaagtgtactgacagtaataggagtataggactcaaagtcccaaacaagtaaagttactgaaatcaaaatctgaaaatcacaccaatgctaggaaataaagcttccaaagtgtaggaactgcgagattctatatatgttggatttgagggagcatcaccgaatagttccagcaatttgcatgattatcacatttatctgcttcaacttgtacaggatagctcagtagtccaaagagaagagattaccaagaacttgacgaacaccatggatgcatcccagaccgtggttccgaggtgcttcgagttaggatcctacaaataatatgcagcaatagaagcaaaaagaaaaatcaggctagcattcagcatcaccactccttcccacatagcattacagaacaagatgaagtgtttgcttctcttacctgagaaatgtgcagccgatggcccagcaactccagcgaaatcgcggacgtgctcggggagttcaaccttcaatcaggaaaatcaccatacatgaaagaagaacatatgttaggccagcatcgccatgtaatcactaatcaataatccgtttgcccaaatctcttgccactaaaaccaaactagatattgaaactgaaaggagggggatggggacttgggggaggaggaagaggttccaacgcggagaaggtttgcttgcctttcgtggtccatggcctccccggaactgcttcgcctgagctccgtcgaacggcggcggcgg

SEQ ID NO: 30498 - DNA, 16133 bp, Oryza sativa
gagccatgggacgccggtcaaagctgcggcgcggcggccgggccatcaccgccataccggggggattcctccacctctccctcctcgcctccctccgccgccgcccctcgctccaggcgcacgcgcagctgctcctcgtcggcctcccgctcccggcgccgaccgcctcccgcctcctctgcccgcacctccgctccgggaacccctccgccaccctccgcctcttcctccgcgtcctgcgcgaccgcgaccggcggccgtgtcccgtcgactcccaagaggatgtccccgactcaagctccttctccgccgccctcgccgcctgctcccaccatgcctcgccgtcgcccggattctctatccatgccttcctcctcaagtccggattcgcctccgacgtctttgctgccaattcactcctccacttctatggttccttcggtctccactccctcgcgcgcaacctgttcgatgaaatgccggctagggacaccgtctcgttcaacactctgatcagttcatatgtgcattcctgttgtagtagcgatgcattcgaggtattcaggattatggtggacagcgggttacggccggatgggtggaccgtcacggcgttgattggtgcatgcgctgagctgcaggacttaagggcagcaaaagcagtgcatggggttgccaggaggatgctagagccacgagtgtttcattcaggagaggtggcaaccagtttggtggatgcatatgtgaagtgcagaagcatggagcttgccaggcaggtgtttgatttggcaggggataatgcaaggaatgcgaggttatggacaaccatggtgtcagggtatgcaagagctcaggagtttgacatagctcaaagattatttcatgagatgcctgagaaggatacggtcgcgtggactgctttgataggtggctttgtccgggcagggaggtacaaggaggcagtggtgttgtttgaggagatggaagaggcagggtttgaggcagatgaagccacaatagttacagtgctttcagcttgtgttggttatggtaacatcgatctggcaaagaggcttcattgtcttgtggggcgtgatggtctgattaacagaaatgcaaagcttgctactacttttgtggacatgtatgcaaagcatgggtgcatacagacagctcagaaagtgttttctggtgttgatgatgattttaagacattggagttgttcaatgctatgataaatggacttgctcggtgtaaatttggcgagaaagccattgcactttttgatgaaatggggtcacttgggctccatcctgataagataacgtttgtgtgcgtcttgtctgcatgcagacacagcggcttggtatctcaagggtttcatatatttgattcaatggaggagaagtatggtgtcaaaccagagattgagcactacacttgcatggctgatcttcttgcaagggatggacaacttgacgatgcgtacatttttatccagaacatgcctttcaaagcaaattctgttgtgtggtcatctcttgtgagagcatgtatgctccacggaaatattaagatcagaaagcttgcagaggagcaacttctttggcttgatcccaactacaagcctgaaaatctccccttgtcaaacttattttctgagggaaaaagaaaagagcgaactgcaagggtgagaaagtttctgaaccacaagcctgtgtgtaagcataccaaataatagaacatagctaagactggaatatctgtaagtgctactcatacttcccaccctcagaccaagctgattaatttgatgcttgtcgggcagctgatctttacaggacgcggtatgagtggggataatactgttcaccacatagagatggttgccgtagcatttgggttcgtaagttcagcccctgaatcccctgtctaaccttgggattcatgacaaattttagtaatcatcaatcagtgttcaagaatctgttaaagattttcaacaaagatatatggctgaataacagggcaacctccatgaaatggaaacaagaggcatgcccttgcatggacaatggtgatgcatttgcagatcttgtgaacactggcagtgcgttctctagctgtggtttgccttttgtatacatggtgcacgcggaaactaagtttgtgctcagttcagtaaaaagatccagaagtccccaggttaatctgataacagaagtcatggcttctgaaattactgcacagcagcccagaagaaaaaaaaaggtcgcaggagaattttcagggctatgttcttccgtaagtattctattcacagtttagaagttttgcgagttttgcgagtgccctttctccatggtacctaagatatagtaattctgatgctgaatgtttaaaacccagcaccttgtcatggaaattagttagtagcttattgagatatgaggtcatcaaaatactgtgttctgttgacatgtatctagcctaattgagtttatcaaaaccaacaactcaccattgaatggagattgacagctgacctaactttgtcaagataaatgtctgaacattccacagtgtatgtgtagttgaattgctaaaataaaagcatagaagggagcttacagttgtagttgcaatgacaaactccagacttatctttcaaacccacgctatcagatctcttcttatcatcactttcctccagtactgattcactttttcacactggttttttccagttagattaagcatgagtcactcagtttatttattggaagctcttttcacccataagaatgtcaatgaggtgatggccaaccacagcaaaatctaactgttttgtttgttgctgtagcttttgctcagtataattatataagcatactcttcctgaagaattagagtatcataccaagcttaagcaacctatgagtgagcatgggaaaaatatgccctttccaatcatttaaattatacccattcatagtatcataatgcagttatttcttcgcacatgtgattgtgtgatgagtgcattcagtggcaagaacgttgcaaggctaatgggttaaagacttctgtattcagcgttgacatacactgcaagtgcaatggctgcatcaagaagatcaatgatggtatgaaaaggatcagcctttcagaaggtacatgaacttccataagcatctccttgtgatgttcttgtgtgtagtggtgcatatcttctgcttgcatttcattgatgagttatctaagtttagaccttggtatcacttattcactgatgaaggggtggagtgggctgatctgatgatggataaaagcagaggtggaagtggtcgggactacggatccagagaagctatgctgtctgttgcgtgaagtgacaaagaagcagacagaaaaacgtacagaaagcaccgtatctgaaggcggcactgcaacatctcagcaaaccaaaggcctactagttggccaggtaccaagggactgacttactggcaatttcagtcaaataagccgtttttcatcagaaggatccatgatacggattacggagtactaacatatcaccatttgtcgattcgaacgttattgaaacgtttttgtccaattcacgactgcgattctgaactggatagtatttcagggtcctttatgacttattttctctggagagctcaagtcgagtgacaccaagcgccccgctattggcagaaacatggaggcagcgggaccgtgccttcagagcgatgtgcatacgtttggcatatgtggatggcatctgacattactgggacattagcgatgtatgagctctaatctaagcagactgcatatgcttcaggagttcaggtcatctccgaatacataccgcgtattgattttcctttttctggtgaattttggagcatatgccatgccatccccgatcactggttgtctaggtttttgtgtaggtttatagccaaaaatatattttttagacggagatagtggtacttttgctatagtttgccatacgatgtgctgctaccagcttgaggtgtgtgctgaactttaggtttagtttgaatcagcttttcggtctgactactactttttacaaaaaaaaatctacatagaatttctcttaataaataaataaatacattttttaaaaaaaatgtaataattagtaataaattaacaatgtgttaatggttcttttcattttatgtgccacaaaaagtcccaacggaaatgctgtatcgaactgagttcactgttgcgcacttgcaggcttacttgagccaggcccgttcgaacctgatggatgaagattaattacgtgcaagtaaacgagaaaattattagcaaaattaataaggttttaattattttaaacttgaaaatggatttatcaaatagtttaaagcaattttaatatattaagttttcgtacaaaatacactgtctagtaatttgtaaaatgtagagtagtagtatatagaatgggccatagtactactataatatatattagtactccctcggtccgatagaacgctatgtccatattcgtctctaggattttgttttttattggatagaggaagttactatagtaccaaaattttagtaaaatagtaaaccaaacacttgaacattacctttgttacaaatttggttttacccataaacttatctcttagtagggtgtgtttaattcacgtcaaaattagaagtttgattgaaatgagaacgatgtaatgtaaaagttgaaagtatgtgtgtataaaagttttgatataatggaaaagttggaagtttgaaactaaaccaggcctagtatattttggtttcactttaaatcaacaaatttaattctaccctaccaaagtttagattagatagtgtgaaaagtgaaaactggctctaaatactcgtagtagatagactcgtagaataatacagtactccgtaggccgtagtagtactactacgagtactagtagtagtatctgcatttggaagttgttgattgcacaaatcaactcccagtcagatgaagtctgaatagccgtggcctgtgaagtgaagtaaatagccgtgacctgaggagtgaggaaggaggtaggaaaggggcgaaatgacgaggaaggatgagaggaaggttggtctagccctagcccgtgaaccacgcaacgacttggaacgacgccagcaccaacaccaacaccagcgtcaatgtgcacatggttgcactgctaccataatattggctcttggagcgtcaacgaacgctcacccgtatcttaatgttaactcctccaactgatatgtactctactcgtatatgttcacgcggtgcttaattatagtcaatgcctcgcaagtccctttttgtactgctattcttggcgcggttcgttaaggtgtatttttggcccctctctctgacagagcgaagtctccgtgtaaatcactgcacatgcattgctgatgctctactattgattcctactatcagcatccacatctcaatatattggatcatctacatctatcgtgaaatataatttattctagtattaccaacctactccctccgtctcattttaaatgcaaccatgagtttccgtgttcaactttagtcgtccgtcttatttgaaaattttttataattagtatttttgttgttatgagatgataaaatatgaacagcactttatgtgtgacttatgtgttttaatttttcttaaataaatttcaaataagacggacgatcaaagttgggcacggatattcatgcttgcacttaaaatgagacaaagggagtactacgtacgaatagtaattttgtttaggccctgtttagatctcaccctaaaatttttcaccctgtcacatcgaacgtttgaacacctacatcaagtattaaatataggctaaaaaataactaattatacagattgcgactaatttgcgagattaatcttttaaacctaattgctctatggtttgataatatggtgctacaacaaacatttgctaatgatggattaattaggcttaataaatttgtctcgtagtttactgacggattttgtaattaattttttaagtgcccgaacaccctatgcgatactctatataatacttaatgtggtacgccaaaggatgtgatcggcagtgctcgctgctgcagccgctgcggctgcaagacagcaagagcaaaaaaacgactacagcggcagcagttgaaacacagcagcagccatagcggctgtagtagccagcagttccaatcagcgccaaaactctacatccctggatctagacatccccttgaaatggaattagtaagtggctacctgctgcttgggctgtgtttagatccaaagtttggatccaaacttcagttctatttcatcacatcaacatgtcatacacacgtaacttttcagtcacgtcatctctaattttaaccaaaattcaactttgcgcttacccttagttatggtttggtttcttcgattgcaaggtaatcgagcatgcacgccactgcgcagtctttcagtgaagtgatttgacgcgagctattagtagctgtactgctgctttatgtactctatagagtactacttactgcgttcaaatcctaatttccgtgtccaacgtttaaccgttcattttatttaaaaaaattaaaaagataagtcacgcataaaatattaatcattttttatcatctaataacaataaaaatactaattataaaaaaatttcatataaaacggacagtcaaacgttggcacggaaacccagggtttgccttttttttagacggagggagcagtccatactccatactgccttcggataaaaataagtttatttttcacctattattatacacgtatcaatataaaaatagaaaaaactagaataactctatattatcaaattctaatataactattcatccatttatctatttctaacaaaactatttccaatgaaataaataataggagctaaaaataaacttgggacggatgaagtattatgatctgtttagtagatctttaactcttaaatctagcttcaaaagttgggttcggaatggagttgtggagcaggctaaacctaacttcacctctatagcttattttctaagaaagttcgtcctattttaaaataggaggtaaaattgtttacaagctgtgcagacatatcaatagggtgtgtttagttcccacacaaaaaaattacacactgcatcgtcgtattaaatgcatgctaaaaaataaatagattacgactaatttgcgagatgaattttttgagcctaattgctctatgatttaacatcgtggtactaatgatatattaattagacttaataaatttgtctcgcagtttacatgtggattctataatttttttttggttattagactacgtttaatattttaaatatgtgtagtataccttatctgagacggcaaaaatttttattcctatctgaacacagcctaatcactgagctcgcctagtgtgatggagtcgatctctttcacatcaatcgggttggagcagagagcatcaactccagtttgtcgggcctgccgttgactgacccgttgacacggccacacgcagtctccaacccaacccttgcagatcaaggagccgcgtcgtggcccccgcccaagcccagcttctcccttcccctcctctctataaaaagggctccccgtgtgctaagctagtagtcatctcacatctcatccattctttttctcatcttcttcttgcttccatcgcaacagcagcagagcagctactactagttgatctcacttgagagaaagggatccatccatccatccatcaagatggggaagaagagcaagaacggcggcggaggaggaggcgagaagaaggcgacgacgacggaggtggtgctgacggtggccatgcactgcaaatgcaatggctgcaaggacaagatccgtaatggcgtcaaggaactcgccctcgtcccaggtactacactactccactagcttagctgcctggatcgatcgatcgattgattgattgattgatcgggcggtgaagtgatggtgatgagtgattgattgatacaatgcaggggtggaggcggtggacaagtcggcggtggaaagcaaaggggaggtgaggctggtggtggcggccgcgacggcgaagcccgagaagctcaaggaccgcctccacagggtcaccggcaagaaagtcgacctcctcgtcatcgcgccgcccaagcctgccgccgccgccgacgacgacgacaaggccgccgccgccgaagcggttgccgcgctgatcaggcaggcgcaggcgcaggcgggcgtccacgtcgtcccgggcgcgtgggcgggcggcggcgcggtggcgtacccggcgtggggaatgcagcagccggagggcgggtactactactcgccgtcgacttaccctgcaggcggcttggtctacccctacgcggcggcgtatccacctcccggtcagcagctgctcggcaatggcggcggcgtggtgtcgccatggtacactcatggctactagcttagtagtacattaattcgtagtattagcgatgtttgttttgtaattagtgatacagtacgagctagtacttgtatccagatgagtatcagtagtggatcgagcaggagagtactccagttagtaatggtggttgtcatctatagttaattttggtggggtgatgaggctcatgtgtgtgcacatgtagtggtggttataacaagtgtgttaaatctctgtctcatcggaactgatggtattatacgtagaatcgcgatcgtattcggctggcagttgccaccttccccctgtttgaaatcatcatcatacaatgtgctagtatgctatacgacgaagcaaaaaaggcttttggattcggttcatggggttgcattggcaggcagtgtggcatgtacagtacactggccggagcggaagtagagcccaaaaagttgtttgatttggcctcctctgggaaacaattttaatcacctaggtgtacatccacctattcgttacatatcaactaaattggtataaaatatttaaaaaaatttgacaactaaattggtataaaagtattaaaaaaatttgacaggatagattcatatgtaatatatcaccccccacaaacatacaagttcaaattcaatttttacaagttataacaaaaacaacaaatcaaactctgattagtatacatatattcatagttaaatttgttatttttgttataacttataatagtgaattttaactgtgttacattatatatcattctatcttctatttttttaaaaaaaaaacttataattatttaattgacatgtattaaacaaatggacatccactcgagggattagaagcctatctccaggctcctctctctggtctggctggtttggcccggccagcttctttctacaggagtatcatcatctttgtgttctggctcctgtgttgtgctgcagcagcagcagcaggcaggggaattgaggccagatgaatcaaattgaccatggtggtggttgtggttgggttggtgtctgtcttttgtacttgaggctgatctcgctggtgccaatccgtccgtcgccacgatctcacgcaccgtatgttgccctacgtgctactactagtagttgtagaatcgtgcgtgattcacaacaccagcagcagcagcagcattaatttgttgatgatcgttgcggtgcctttactggagtgagtacgtacggaaggaaggaagggtcggtggggccccggtgtcagtctccacaccccaccactatcatcgtgcctgcatctgcatgtgtgtacgtactacgcgagaggaacggacggctccgatcgattcgcccgcctctcccccgaaaaacgaatcacccacacacgacttgcgtttttgtctctctgctctctgctgctgctgctgggtcccacactcccaccaccaccaccctggccgcaaaaaggcaaccaaaaccccatcacaattcacaagcctaaacccccccccccccaccccctctctctctcgccgtctcgccgccgcacacaacaccacacctcgccatcggagcagaggtcgaggaggaggcggaggagaagccgccatggcaaaggtaatctcctagctctaccctcccctctccctctcatcgcatcgcgctactcaccatctcagttgcagaagaagaagcgcaccggcggcggcgagcagccgaagcctgcgtccgacgtcgcggaggacaagcccgccgaggacacctcgcccgatgtgcagcagccgcacctcaacgccgccaccaccacggcggcgccggggacggacgacaaggacgcctccaccaaggccgacgaccccaagaaggacgccaaggagaaggagaagaagccggcggcgcttcccgtggtcaccgccgtgctcaatgtcgacatgcactgcgacggctgcgccaaacgcatccgcgcctccatccgccactacccaggtgagctctccctccatccatcatcctctgcttcgactccatctcttctaatcctcctctgctccatctccgtcgatcgaacaggtgtggagggcgtggcgatgaaggtggacaagggcaccatgacggtggtcggccgcttcgacgccaagaagctccgcgatcgcgtcgccaacaagaccaagaagaaggtcgacctcctccccaacaacaaaaaggctggagacgacaacgacaacaagaacaacaaggccaacgaatgcgacggcaagccggcggacaagaagcagcagcagcaggaggacgacggcgacgaggcggggaaggaagacaagaagaagaagaaggagaaggaggagcaagacgatcagaagaagaagaaggccaaggacaacaagaaacccgtcgtggtgcgtatgatactaataaccttcccttccgttcatgttcatcgtctaaattcgattctattcgatttgactgaattgttccccgttgttcgcgtgaatttcgttggagtttgtttcgatctgttccagcgaattttctgtgccacctatagtcctactagtaccatattctgccttgcttgcagaattccattgtgtcgtgttgctggttcatgtgttgctgcattctgatatgattctccacaaaaagctagcgtgagatgcagcggggagagagagagagagcgtccgtgtgttgcatgagcctttgctctcctttttcctccctgaaaagaaagaaagaaagctgtagtacgcagcagcagcagcagaatggttgcctgccttgtttgagcttttgccaccatgcaaaggaacagtaaaccacaccctctctacatgccaatgccatgcatgcatctgcatgtctcttccacactacagtacagtacaacccctgcaccatttttctttgtcttcttccttcttcttctctgctgctaccttcctttttcatctcaaagaaaaaaaacacacacagatacagtagatacattgtgtttggatgtttgactgcatctgcattgatctgcaacatgaatttgcacgtaccgtacgccaatgcagccggtgcctgggacggtggtgctcaagatcggcgccgtcggcctccactgcgacggctgcatgaaccgcatccgcaccaagctcttccacatccaaggtaaacaacctctcaattacttgtccatgatttcattattcagtttcagctaattaaactccagtgtgatctctgtgtggttttgcaggagtggagcaggtggccatggagatggccaagaaccaggtgacggtgaccgggaccatggacatcaaggccctgccggagaagctccgcaagaagctgcgccgccccgtcgacgtcgtgccgccgggcaagcagaaggacaaggacggcggcaaggacaaggacaaggagaagcaggacggtggcaaggacggcggcggcggcggcaaggacgcggcggcgaaggcgctgacggcggagaaggaggcgtggaaggcggcgttctacgaccagcaggcgctgctcgccaccgagttcatgctcagcgacgagaaccccaatgcctgctccatcgcctgatctcttttgctggtgattaacaaggcaaagcagtgcgagaaatctaatcagtgttctggtgatctgttggttggtagtgtttttttggtggcaagattaagatcatctttgacatgtgaaagactatttagattagcatctagggaactgaaagagagactgaaagataggaaggagtactagatatgatatgaaaagagaggaattgaatagggagggatgatagacagaaaagagagattcagaaaggaatctgtaactgcagttggccaagctgcttttttcttgggagctaatcgttgaggcattagcaatgctgatgctaagtactctttttttgttactgccacttgttaggagtaccaatgattaacacaaacacactagtgctactagtgtattatctgtttgtcatgtgttatctatgcagtgctgctgattctgcttgtgtgattgtgtgtcactgtggtgttgtgtgtgggctgtgacaaatggaacaagagaaggctgcaacacaacacaactatacacaagagaaagcagcagcgttttctttggctgtctgcactgcacttcactgcagtggagtagaagtaggagtatgtgcaaatttcatatactagagcagtgttggtagtggtccacggaaagcagctgccaccgcttgttttggccttcaccggagaggaaacccaaaacaaaacaaaaccagaaagcgagacctccgacctgctttcttcctgcacaaagtgcagatatgcagcagcagcagcagcctctgctgctctgtggctcagagcaggaggcactcaggcacaggaagctggttgccaatgcctttttccgtttggccctcctcttctcgtctgcatctcggaaaacatgcagagaagggaagtgagaggaaatcatcaggacagggcacgacgttcagggcaattaaactgggagatttcttttttcttcttactagtagatgaaattgtttgatctagacaagtgctcatactccagcacgaaaatccttcaatttgaagttgaaagttttgttagagctagcagtccacttcaaattcaaggtggtagtggtactcctcctagtatcactccctccgtatttcaatgtatgacgctgttgactttttgacaaatgtttgacctttcgtcttattcaaaaaatttatgtaattataattaattttattgtgacttgatttatcatcaaatgttctttaagcatgacataagtatttttatatttgcataaaatttttgaataagacgagttgtcaaacgttggttaaaaagtcaatagcgtcatacattaaaatatggagggagtactttttttacaagaacctaaaaccagacagggaagaaataggaaacacagatcatctgaaagaaaaaaatagagggtacgtggaaacagatttatggtccatgagctgctcgtgtcctctgtgtggttgttgggcttatgttgtgggcctagtgggctgggttagccatatctttttgggccccttatgtatgctcacttctgatccaatcacattccagagtttaacttcccagtatttttattttttcgcttccagcgatggagcaggaagaaatcaactactgtatcaattgaaggagttgtggtatcttcccctctctaataaataaataaataatgtatgtatgtatcttagagtattctttatagtgagatactgtacagtagtagtgtgcgtgtgtgaagaaggtaagtactacatacgtatatataaaaacgtgcgtgtgcgtttatgtatggaaattttttttcgccatctatctatgtaaaaggggttgaagtttaatatattccctcagtcttaaaatataataattttataacgagattagatatagggtatatctatattcgtagtaacgagtctaattatgttactaaattttgggactgaggtaatagtttatttagctccatttgagttttttttcttggatccgctcgtgcgcccatagtgtaatggtttcatttagaagtaattgattgtgagattgtggatgaatggatgggatcgcgaagaagcagcagcgagcagggtttcccaaaccgccggggccggggttaccgcgctctggcggtaagcatggttaccacgcggcaaccgtgaaaaatcgtacgaaaccgtgcaaaatttatcaaaaatctaattttttaaaaaattatttaaatttaaggaggttaccacagtatttctattaccgtaccctcatggtaaagacggtaaccgtgataaccaagcggttaccgacggtaatgtaaaccttggcagctagaggcctgcaagagggagggagaggaggcaggcaaacgagcggcggggggccacgggccatttgcactgcgccatcacatgcgcttgcagcagccactacttgcttaattgcactctcttactggggtcgatccatctgctcattaattactcatcacgctagctagcttctttcattttctgcctagctatatattggatcggagtaaattaaatattttcacgtacgcacggtacggccggcaagccggtaaaccgtttggacctggtcgatcgatctttggagcactgcatttgcatttgcatttgattttgcatgcggcgtagagatgacgaacgagatcgatcgatcagatcagagtgggtgccgtacctacatgcacgcgcgcgaccaattggacagaggcattaattaattattttttattatttatttgtctctttgtggatgcatggcgataccgaatactccctcgttccaatatgtagcaatctaatcctattctatgttcagattcgtagtttgttacatattggaacggaggaagtatataattaaggaagctagctagggagtgcgcggttgatcccaaaaccgatattcatctgcatttaattacatgtgtgtgtgtatagttaggttatgttgtaagtgtgttaattaacagacgatcaatctagattgggattttttttacggagggagtacgctctaatataagatgacatgggtgagctagcgagtggtggatctatgcagtttctaaagacacacaacatacaagtggagggaggggtgcatgagagagatcaagacaaacgaggatccggcctcccttgatatatatgttcatttaaaaaaaatcaagactacaaattataggtaggagaacggcattgtagcacgttggtagaggagctatatggtgttcttagtggtcaaagtttgagtttcctcaactttgattttctcaccattattttcttctctcttaataatctatgctaagtatcctacttttctctttttcaaaaacaaattatgaccatcaacttcttttctcttaataattgatgctaagtttcctacttttctcttttcaaaaacaaattatgggtaacctatatttaggacgaatcataggtaattaatgcatgtcaattagagttgagttgtgttgattgtataggttttctcgccatttcttctctcttaataattgataataattgatgctaagttcctatggatccacgaggatcctatcggtgaatcattggtaatgcatgtaggttagcactatcagagttgagttgtgtcttaataattgctataattaatgcttagttcctatggatccatgcatgaggatcctattgatcaatttctacaatgaaattcttggtcgccgtgtgatagcaagctgctaacttcgaaatccccagcgtttgtgatgatcctgcttgtctaggtaaacatatcttatgaccaagacctccggtcgtcagtagaaataggctaagggtggattttacaatgatttttttgggtgaattcgtcatatatcaatgccggattcattaagaatttaaagtctagatctgttgtagtac

SEQ ID NO: 30499 - DNA, 2142 bp, Oryza sativa
cattaagaatttaaagtctagatctgtcgtagtacaacgtgagtattttcataggcacgccccagtgttgacataacagacttggatagatatcttcaatccaacaaaggactttggcaatttagcttctcgacaccattttactagaagctcacccatataccctctagcaatcatcctagagaccatgtcattcttatgccagttcatccccacctcccatgaactcatctcgacaaccaagtcagtgttttgccggttggtctctcatctccccctcacatcctttgctccactacttcgctgcgttgccctctaccgagctcaatttaaccaatcgagtcccttttccccgctaccaaccctatccactcctctatcctaacgagcgttcagtgatgccaccatgtcctcgccatcactgctgagaccaattgctacccattgcctacaaccggccagctactccctacccctccaagcctaggcaatccggcctctaatttcctccctcagtggccctccctcccacccatccatccacctctctctcggaaccctaatccaacggtgagtggacacgtcgcacaactaccggttgaaacctgtttgcagggatgacgttgtcgcaaacgttcgcccgttagcatttccgtgtacatgcgcatgcatatatatcatgtatagtgatttactattgacatgattaactgagtgtaccatgggtagtacccttgagaacagtgagagattaggacagggcgatcgatgatcgagcattgctatataggagtatgacgaaaagatatcacaacgtttggatcgagcgatatccaccacacatagcgtaaggtataacgcaaagacaggtaagtacagtgcatgaattggacagggtccaccttaaactgaagtctgaacctagcgctgttcgatcgtacgtacgagagccctagctgtgaccacatctcatgcatttcatcatgcactagcactgtacgtacactgtcagctagctgctagtagagctacttgaattattaatttctgctgtatatatatacattctttgtccaaaagaaagtcaatttttaacttcaaatttacccccagaagttagttacgtttctttctataacgtagcgtattcctcccttcatattcagatttatggtcatagaatatgtcacatccatctaatatcttttatattttgagcccgaaggagtatctagtagcgaattacgactaattatttatacatttattgtgtcggcatatatggatatataggcatgagtttctcatctcagcacctcagcagccttcatctgaagcagaagcatgcgcatgcatatattgaagtagtaactgatgatctgtacatatgaggagatcgataaatgatcagacactcaaacacacacatgaattaatatacgtcagatgagatatgatcattgcaactttcatcagatttcaatcgatccatgcatgcatatgaattgatcgatcttattagctagctgctgactgaagccctgaagtttcaatcagctgcagggcatgcattgcatagtgcagcatgcatgcatgcagcagcagaagccgctcgcattcaacatctatctgaatgtcgtctgatgatctgaaagctagagagagcatgcattgtcgtcagcaagtcagcaactaattaagctcatcagcagctctagctcgtcgtattgggcgcccacattggcgttattcagttaaatttgcagccttgcagttgcagtactgaagcatgaatgactgcaggccgacatatgtgtacatacacttgcatgctagcctagttgcagctgttacttactgcccggcactgaaatagttactcctcctactgatcctaactccattgcagtagtaaaactcaatcgatacagggctaactacagcaacagcactagttcatgactttcatgtgctagtagtactattaattaatcataccagagtggagtgtacttcttaatcaagaggaggaacatatatgtgtgctagctcacagtaatatgtacgtatactgatctgaaatgcaatatgtagcatcgtactacagatcaattaggactgcaatagctgattaactagtag

SEQ ID NO: 30500 - DNA, 9735 bp, Oryza sativa
  unsure (1)..(9735): unsure at all n locations
atcgacttagatcgatcgatatgatgtgatttagacagagatgatccacatcaatgtgtatgcaagaatgcaagaaactgttcttgattcgagaactcatgcccaatcgaccatggctgcctgcctgtccctagctagctaccacatcctttgcctctacacagtacacacactacatgagctagatatatagatcaaaagatttactgcctccattctaaaagttgatcgattcatgtaaaaaatttgatttattttgggacaaaaggagttcatttgtaagatcagacatatgcatatatatgttgtctgatccttccagttcatatatatcaaaagagacatgtacacctacttctttcttgaagatggcacagtagtctataccacatctgttactatatgatgatgttttaatttagctttgacatgcatgctcaaagagaagaatggagcaggagaagctgaaagtatgcagtggcaagcaaacatacacatatggagtacttaattgttaactaagctggccttccattaatgaaagcaagaatgttgtttggatatatatatagcccaattcagggtgtatagtggtgtactacatgtgttgctttgatgatgtactacactatataacaacagagaatatatgcagcatatatatatcagttaactggagtggcacagcacatcatatcccaactaatgatgataggaatatttacatcgatcgagcatattatctgcagcgtcaaccagatactagcagccagtgctgtataagaaataaagtatgcatatatctgcatgattgattaaggaatacttgtgtacttaattaatcaactagctaactgagtactgcccagtgtatagtacttataaaagcagctaactggaagaattaattgagcttgcaggtgattagtgaaacataattaaggaacaagagtacgtgtctgaatgggagaggatgaagctagctaactgaaatgtaagtcagtgtgcacgtatacgtgcagatgatagataaagctgatcgatgatgttgagcatctgggacagcttagttagtcaattagtctctaattaatatataccttgaaattaagcttctatatatagaacaagtgtacagatgatgccaagggaactgacgttgagctagctctcctgcatcacgagagagggaagaagagctagctaacttccaatcgaaatgatatttatgtcataaaatcatggtgtacctgaataatcatcatgtttcttggtccattaattcctgcctgtgtaccagaaaagacgaaaccacatgcatactggaagactgggaacattcataggacaagatgaggagagcatgaacaataaattaaattaaccaaacaacgacctaattaaaacaatggtagatcatcaccttgttttgactagctcccaccatgactttattatgagaaaatttaaacgaaaactcaaaaatatattaattcttaaatactccgtaaaggagtagtgctaattgaggattccacatatatatatttgaagaagaaagaaaagaaaatgtgcttagaagaaaggagtttaagctgaaacaattagccaagctcaaatatataggaaggggaaagctagctataggaactgtacctgaagattaatttctagtctccaataatcaaagcaggccatggatcgagacgagtagtcgagcgtttgctgatgcagcatcatcaagattctcatcacatatagtcagccaacctcgatctcgtttagggatgaactcgatgtgaatcttgatggtgctgcacctgcaagcaccgactgtttgctactagctccatatatgcatcgatccatgcctctcatcctcgccaatttgtgccaatttgtgagatcgatgcatatatatggtgcatacactaccagaagaatggatagtatatatggagaatggagctagagggagatcgattaggaaagggattaattcttcctcatctatgaatggataatgagatatagtatggatcaatcatatcaagatcgatcgaagaggatatatatatattatctgtggaaacaacagattaatttggtccctacttaaagtaacaacaagaaaagaaccacatacgccaaacagatatccatgaggaaaagagagagagagaaattaaaagaatcaagaaccagtagcagagactaaacgatccatccgatggatcgccgccgcagctcgccggaccagaaacgaagacctcaccggagatattatctccggatcgatcgatgtatggatggaggaggtggaggaggaagaagaagaataagaggaagaaggtaaggagagattggggttggcatgggtggccacacacctctcacaacatagtgagtgagaaagatgacctcctaggtaggtagcaagctagctatatataagcttagctagctagagccagctagtagctagctacaagaggaggaggatgggggaagcaaaaaccctagctaatagtgatgcatcttgagaagagatggcatagctctagctctagcccccaaataattaaggttttttagcttcttggagctagctatggtagcagctgcatgcttttctctcaagctccatggaaagctagccagatgatgagagtgagagagagagagagagagagagatgatgaggtttagaggcactgaaagggtgattaataagaaattaactagttaatggaaaggaaggagatggaaggaagaggccggccggagcagttgctggttgagctgagaccaagcaattcatcgcggggctagctgctgctgctgctgacatgtaatgccacttttgcttctgattggtccactccatcgttttcacaggtgtacatgacagcgccacccccacgcaattactactaattaattagttaacaactattaatctccgatccatctcttgttcttaactaactttgcaaattcacttgaattgatattttctttctttctttctatgtgcatgttagctgatccttaggcaatacgcgccggctaactcatatatttttttcgagaacggttggatgattaactggcatctctctcttacaatacagacaatctttgatacgaatctacgtggtgacgactcggactagacggtctttttattaaacaaattaatttaatatctctaggtctaattaagtttttggcatgagcagccatgtgagagcatctggccggttggtagaagagccatatcttttacatatgaaacaatttcatgagaaaaaccacaccaacccctggtttggtcatataagaatatggttgggatgttcttaagctaccaacaacataactaatgtatatgtactccaacgaaattaacttagatgtctcaactattttgtagttgtgaattttaatttgttcatggataaataaagtaataaaaaggacaaataatttgctgagcccactaataataaatgagtaataaaactgtacccctacccctggtactgactgtctaattcctcatcacacacactgacttgttgggagggtgccaatgtgcatgggtgggacatactccatagtactagcagtagatgatggtggccaacaatttgcaagggaaaatggctaatgagctagtccatcagtcacaacaggagagactgggacaggcaggggccagtctgtgtctaaagctcaaggcccacccctgaaaaaattttcccactgacgtgatggtgtgacatggagatgtgtgtgtcatactgccaatctgtcatacacacactcacaaagatcataagccattgttttgcccgtaatgagttcagatcatgctaatagctgcatttctcagcaggagacctttggatcttgtttggggagtttttagcggctgcaagcttctccttgaatctcaatctcttctaaagacccaaacggttcagattttaagaacatatgtctataaattatagaaaatgaactagaaatcagtaggtatgagactaagatttttcagatccgcagaaactagctatcaatcatttgttttttaaaggcttatcaaatatgactcttgattaaccaattaatatatcattagtacactagtacagctactaattaatccagctagctcaagctatacactgtgtgtgagagagtgagtgatagagagagagatgagatttggaaaaggtggtgagtggtggagaaaagagagagggggcaactgcaagagcctgctgcatcagcaaggcagctcattgggtggcggcagagcagcctgagctgtttgttcggtggcactgtactgtactgctgccatggccaccatggatggtcccctgaaacaacatgcccctacggtaacactagttacatagtatacactcactagctagctctaagtaaggtcattaagcaatataattgccccttgcaagctagctaaccgctccactctaactaattgttactattgatcaaccatcaatcatgtaatcctaactcctaactcctaaatgtcttgtttatcgagcgggagattctaatatgtaagtagtcagctgatcagaataaaaaagttgggcttcccagtttctaacttctactttattttgtagattttattgctactgattctcataatctaaatgaaaatctagttgctagaaattgtagagttatcattttttagaccgtttgtagagttgaagattttaggaagaattgtagttgccataagcttccttaaacatgactaagtttctaaccaatggatcaatgattaatttcttctcaaacttcttctaatgttaattaggatttcttcaggaacttctatacattctaaacttacatgctgcccaaagtaatttcatcagaattctttatgccttcggcatggactgtggaaattcatgagctcgaatctcgatgtaggcagtacacagctggctgtcgactcagtatggactggtgtaattaactagtgttattagtagattaagcatgatacttagggttaaataaaacatgcactagtatctgcgtgcgtatctgttattttgttagtaagcaacgctcctggtttctgccattgatgtcggcatccacctcacactccttaagtcaactcatcttcctgctctgtcagttcagaaaaaaaagaatttaaacattaatcatgtgtatataactgttataaagtctaccattgcatctacttagtactaacctaactacttcttccacgaaccattgaccactgaaacttgtcatttttaatggagatattacacagtaagtgtgtttaatttgcaggcagttttagctgtaattttgtgttctgagataaatatgagacaaggatctatatatgtttttttttcatgaataatgttactcattcagtaggacagctagctgaaagtttagaattgatggtgtgatcagaaacaaggcctatgcatgcatgctaacgattaatatgatcaagaatctatagtttctgaactcatcattatcaaatgagccatctttatccactaaaaaatgtttattaaaagtcacctgaataaggttacctcgaaataatgtaaagtgaactagctaccttgaacagtctttaaattttctccaccttaatttcccctcaaattaaaaagagagaactcctactttaatagttgcaggtttggcggtgtactagctactacagtgcatatggatgacataaaaagttaattaacttaatactctcatacaaggatagatgcagagattggacatcaaacatgcatagattaattaattatgcaaagggcatgtacggatcgaatacgatttgattttttgcaggttattggtcgattgtgagtgcagtgatgagattagtttaatcatccacgacgaaaaatataaatatagcatctgatgtacctcccctcccgaaagattcctggtctcgatctcaggcaggttgtttctacaaaatgttttttttttgttattagtattcattgagtttctaaaaaaaatactgatcgaaatcatcctatatgtaagtatatatgtgcagcaagcagttaagaaaaaatagattctctcaccttggagaggtatataagtataactccccatatttgagatatacctcgatctccataaaaggagataccaaaaattactcttataggttagtatatgggttgaaacctatctttataaatatttgaaatagaaggtaccaaaattcagtttacattacaatttttagaggtatgatatttgtgctaattaagaggtatatgtgcctccaccctagaggtatatatctccgaactaacactataaagtatatatatacctacctcacatgcaacgactagaaaggtcttaccggtgctaatcataaacttgttttctattcagttaaactgtctattttttacctattaaattgtgaggaggtatatacctctctaaagatgggagaaattatctcaaagtcgagccaggatagaatttctttgaagtaagaagattgaaatttataaaaaccatgcatgttttatagacaatgttgtggaactacagtactcgttatagtttgtggcaaattaataactcaattatcatggtttcaaggtttcacaaaaatgaaaaatccgttaaactccaaacaatgtaatataacacttatttactttagagtaaattttataaaaccccacctattatggtctaaattgtacaaaaccacatggattttagcaagtgtcacataaccccatctattatagtcctaaagtttcacaaaaccacactattgatcattttgaatttgacacaccacacttttgagttctatagtcacatctcaaatttatgaggattttatccatcatataaatgttacatgtgttttttttattttactataggagtatgtaaaaatggttaatggtgcggttttgtgaaactttaggatcatatataatacccgagattatgtaccacgtgccaaaatcattgtggttttgtgcaacttaaaccataatagatggaattttatgaaatttactcttttttattttatctaagtgtcgttaaattaattgcatgatcaagttgataaattaaattagttaatgttcaaacaacattattatataaaagatgatgaatttaagtcagattttactagaagtggggtcttatgaaatcttatcccaaatgctacaactcaaaataccatatttcgaaaatttcaaccaaataacttaaggctttttttctaaaacttactccagtaaatttaatataactaaagtgcaatgtgtgcatatatactactacatccgtttcaggttataagactttctagcattgcccatattcatatagatgttaatgaatctaggcatacatatatgtctagatatatattaatgtgagcaatactgaaaagttttataatataaaatggaggaagtagtaaactcccatttatgtatttcataaaagtacggctgatcgtttggcctatgaccgataagtcgtaaaatgacatgcaagaaaaaaatatacgtaaattttatatttatttgaaaattcatctttttttggcagcggcttattattgtgcgggtggtagcagataattaaccatacataagctacgtacgaatagtcaataagactagctagctggatatatagctccaaattaataaggtatacttgattgcgctggaagatgcataggtacttgattcctggttagctagcatacatacattaattaagaaccttttcttttggaattgcctccaagactagtacacatgcatatatattatatatatatatatatatatatatatatgtttatgttatcctaatggaaagcaatgggagagctccacctgaaaggtaagcttgcattctgaaaatgcagagattcttcctccaaacatagtcaattggctggctggggacacatcacatagacaaggaataaaggagccatgtaatttagctagctcaagctatagcttttgttggcaagttaattaaaattaacaacaaatgaaagcaagttcctaagcatgcaacaaacgaaaataattaatggtacctcccgttcaaagaaaaagagtaacctcgggccctttcgtggtgcacacttcatcatgcatcgatttttcttttgagcaccaataattcgacatggaaattaaatacccaacagaaaaaaataaatgcaattacaatttatactttactcgtgtgtaaaacttcaagctaaaaaaaatcaaggaaacactacgtacataaatcaaggtactatatatccgtaggacatttatcactcgtttttaatttgatttgtataacaaaattttgattttacacctaattaataaaagaactctagaacacaatatatattattnnnnnnnnnnnnnnnnnnnnnnnnnnnnnnnnnatcttcagacattatcttaataagatcaatcatcttcatcttcatttttccctcatccccatgctaacatgaaagttgattgcatgattgcaaacacacacactcattgcataataacataatcctatgttacctttcaagaaaaaggcaaaacatgagtagcaaagttaggacaccatcacacacgcaaccgacaaaaatgcatggttttagttagttgcaccaaaaagcaaggattgattactaaattaattggccattgttgcgagtagaaaggttgaaaagaaaaaactacaattaaagaaaactaccttaaaagttgcaaagtttaagcccctggattctgtggagttgtgtgatgagtccaaaagaattgtgatcctcgattccaacgcccacgggaatcaccatacatacagctcgatcgatcgatctccatccatagtgatttgatttaagtatactatatgattgtttgtttatttcaaggcaaaaagaaaggacagctagcctacctagtacgaggaggaagaaggaaacctcccaagagagcttaacctatcatgtggctggcttctgccctactactgtactacgttgtacgagtaatacattagcatgatcactttgcatctctatttgtgagctagctacaatacccacaaatggtaaaacctaggagaacatcttagcatcggactaaccatttctaggatgagtattctctccaatcagaacgtgtcttggtgattagtttctacgaatggttttacgggcttttaaattaaagttttcttagccaagttgaaaaggctataagaaggcaacaataacatgtgagacggtgtaccgccaaaaggagtgacgtggatcagtaatagtgcttgacataaattgtttgaaaattacagatctaatcgtacaagatattatagatgacaataacacgtgaccagtgtgatggcactactacagagatatcaatgctttgtaacagaaatatgtacgaacggcgaatatttggtgagatacctgctagttggatctaggtgtgtagttaacacttaataggtacactaacacttttcttaggagccactttagctcttgctcaaagagatattaaaagaagcttagcctattctacaatgtctcaattacaagttgcgtgacctttccggtcaatatccacagct

SEQ ID NO: 30501 - DNA, 4193 bp, Oryza sativa
atagtctacgtgactagccaccatttaatcatacaagaggtttattttttttgagtgccgaatccaaaccgtgagcaagcctgctatgtggtcgcagatgttttgacaaaacaaaaaagttagcaagctaataagtggctagctcacttatagattcataattttaatggagagtgcaaaactatgttaaaagtggtctactacgttcgagagatgtatggctatgaaaattaatcatttttgtgatggaagcaaaggtgagttgagtcagtgatggatggatgggtggtggtgggtcccgggtgcctgtgatgtgggcaacaacctagtaccgatcccattgagcccaatgcaagtgggcccccaccacccagactttcacgagctatagtcacagtcttcgtctacctctgctgatcagcttgctgctccaatcaaaccgcccaaccaatctcttgctccattgctgctgctgttcttgcagatgttgctttgctactagtatgaagtatctctgttcagagttcaggctagtagtgacaaagaattaaggcagctgcctgaatctgaatatatatattgatttatcgtctgaactaatgttcgtgacgacgatggcgtacaattaatggcaattgattaattaattaatccatgttgcgaaaaatgaagaactggtcctgcatagtaaatgatctgtagctcatagttttcattggtgtacatgtaatcgatcgcacactcctattcctagctaattcatgtcggatcgatcgttcgatcatttcactgatcaccaatggcgatcgacatggatagtacaagtgctgtattttacactgttcgatcttagggagaaaataaaaagggacaaagacatgtgcaatattattgtacgtatatgtacgcatggatgtgatgttagatttgttctatgtttcatggatgatgcagtgacagttgatatgcacatttatatgtttcatggagtatgttctattttttgcatgttcttctgttgttgtttttgtgtatgcgtttacgaaagaactatagtaatacatatcacttagatactatccttctataataattgagacaacaagagctcttaaccattaatacattaaaataatatttttattacttttattttcttttcttcactcctactatacaataaaatttctttaataaatactaggagttactttgagccggtgtgtagcaatgatgtttctttttttctccatcaccaaatttacttacttacatagtaacatatagagcttgtaaatcaataaacaatgtgggacatgtctctttggtgtgtgactccatcgtttgattgatagtggggtggggtaaatttattgtcaactactataaacttagagcaagttttatagtggaggtgaatatcacctctaatttaaaacatatcatctactcattaattaagaggtgacaagtataacatatcgcatctaactcaaaaatttcaatattagttcactctcacaccactttacacttttcttaaagattaagcgaaggttgctccttgaatgaggggtgactgattttctctcctatattttatcacctaattctatatatatgataaatttagaggtaacgtgtagaggtttatagtgcttgctcttagttcttcagtttgctttttgtgtgattggttgaggactagtttttgtacgcatgtcggcatgtgtaaccgtgtgtgactggatcgattgcgggtacatgggtaaattaattgccaactactataaaattagttgaattgtacgttttgtatacctgggtaacggccatacattttgatccagctgctagccacatcataccaattaattacatgtttggtggatccaatgttgactattcaaacttgatactgtgagtaatgtgacctgtacttggtacctaattagccttaaagatttattattgtcagtatatatatgacaacgaccaatggtacccaaaatgtggtagcaaacgacaatagtacaatattattagtgttaatccataaacattctatccttttccaagttttttcaaggacctcggtgcaatttctttatctttcctgggttgcacttataaacctaggagtagtagtgcagtcgagatcctagtacttcatccattccaatttaatcatcacccatgcatatcggtagaaatcaataatacatctatcctttttcttaatatgctaaatcaattgttcttttttctttgtgggggctaaatcaattgttcaatttgattgctaaatcaaaatcgattttgctatacatgtgtcaccacattttatcattggaattggttgaatttttggtcggtttatccgcattgagatttgttcctggatctccacgtcttgactactaccacggagtagcttttgctccctatctagttccacatataaaagggcttgttcagataattcccataaaaaaatcgagaaaattaggaccatatataatccactccaaatcagcttgattgatggattatcccaaacaagaccttataagtaaccttccgatcccttcttcgtggtaaccaaaggactttctagctattttcacattatttttcgttgaagttacatcctataaacaattgtaactttttggtcaactgtagtttttcttttcaatatatgtaacttttgttttaattattcaatgcaaaggtactccgtattgtttttagtcatttttacagtcttttttttattgaagttgcatactatataagattgtagcttttgttgtttcagtgtttttagtcatttctacagtctctttgtattgaagttacatactaccccctccgtcatattttaaatataatgcaaccataattttccgtgcctaactttgattgtccattttatttgaaatttttttataatagtatttttattgttatgagatgataaaacatgaataggactttatgcgtgacttatgtttcaaaaaaattcaaatcattttcaaataagactgacgatcaaaattgtacatggaaaatcatggctgcacttaaaatgggatggatggagtatataagattgtagcatatgtatgatctgatatttttttagtgttgtcaaagttgctagttatttgttagcgatctttttgagagagaaaatatatatcaactaatatatactccttcataaaaaagttaagcttattttattttctggttttttaaatgagatatacatatttataatcactagtcccggccaagcatctaagacttgaaaaaatggcttgtcttttagttttgtagtgctaaattaaattgttgaccgaaacctaagctggcatttaatactaattgatttcttgtatgcatatagttacttggtttttgttacatgtaggatgagttaatttctccttggttttgataatctctactattataaaaattaaagatgtttccgcggtccatcatccgtgtttgagttggttataaaaattgaaaatgtttccgcggttcgtaatccgtgtttgagtcagttttaattttatgttttggttttaatctatatctcttctctatctctactattataaaaattgaagatgtttggtacgtcatccatgtatgagtcggtttttaagttcgtttgcttttacatatctgtatttgagtcaatttttaagatcgtttacttttggtaatacagaaggaatcatataagaaatatgtttaaaaaactcacatgctaacttgagacgatcagactcctaactgcatctcatgattttctgaaaatatatatatccaagcgaactcccacaatgaatttcatcttaactaaaccatataacaataataagattaaaatagacttcacccgttgcaacgcacgtccatttttttctagtaaaagaaaaaaaaagagatctcccttagcctgtgttgtttaggcccaataaatattggcccagttggtgtcgcactccgtatgaaagcccacataagattcggcccattaaggctcaatagggagtaaaaggggaggcaaaggttgaagaagaagtgaggccggagagctcggagaagggcccgacgaagcgcaggtggggatcacctcgccggcgatggcgcggaggaggggaagcgcggcg

SEQ ID NO: 30502 - DNA, 3740 bp, Oryza sativa
gcccccgacgccgaggacccgcagcggcaggtctgagatgagatctatcttcttttaccgcttccttggattttaggattcttgtgttagactgtagcggcattcccaaccataagctaagctaacgtagattttttttccactccaaattatccaatcttatttggaatccatctaaccgtttagtttcttgattccatcatcacacaatgcttagttaggacttcgatgcatcggttggtagtttggagcattccaaaattttagttaccaaagcagttgatttgcaaccactgggatgctgcgagaatacccttcatggtagccttttttttttcttttgtttctgcagggattaaaatcgaggtattgcgataaatgctgcatgtacaaaccttctcgaactcaccattgcaaggtgtgcaaaaggtgtgttcttaaaatggtaagtgtggctaatgtttgtcggtataggttctgttggttgcaaaatgaagcttttgttagaaatacttggtaacaagttttaattataattgcaggaccatcactgtgtctggattaacaactgcgtgggctatgcaaactacaaatcatttatcatctgtgttctaaatgcaaccatcgggtctctttactcatttgtaagtgatatcagttggaataaaatttgggaaattcttcgccaagcatcattcacggtcattccatttttctccaggtggtatttctatttgatctcttccagacagaacatgaatacgatgttccttatgtgaaggtcatacatgtaagtgcactggcctttcttctgaattaatatttcactatacagtcaggaattctccaccctgctactgcgctgcataaataatgagtatatgtttactcttatttttagttatcaaccattactaacctttggcacacagcacactacattgtttttcccactgtgttgtcttaagagtcaataagaaattttttgaggaatccctgtttgttgtatcatgccagaagtagatagtttgttttagatctcttatgagttttgagtttggatttcaactcaattgaaagtgcttattatgtatttactgcagaaacatcaaagacatgatagatgggaataatccaaaattgcagataaaactcatggaataataatgaaaactgtgggttttcctttctgctggtctaacaagggagtttatagttaaaataatgattttgaattttaaaagatggaattcttggagaccttgcaataacgtggtggaatatttggctagaacgaaacagaaggattttctgtcactcttcacaaaacgagaaccaggtggcctccttaatcaaggaaaatataagccaaattaatttgtccagatgttaaatgttgttgttctttaagttgcttgtatcctgaggtttttgcctagttgacaagcctctccgttcgaccgctagacggtctctgcgtttctgtttatgtattctgaccttttattccctctaatatattcggcaagtcttttgccgcttttcgtttcaattttttttttttaaaaaagatggagtttcatgtatcgagtggtgtcactgagatattgtggataaacatgtcacgcagatatgcatttgctctcggttttagttttgtggtacttttccccccccaattttcctttgttccttcctataagaatcatgattctctcatcaaaatcctgtcatgcacttactcggtaatgtatttttttttgggtatagttcccccttttttctggtctaactactaacaaatgactaacgaatgaagaaatgcaggtcttggtcggtgttcttttgttcttcttaagcttgacaataggttctctgttatgctggcacatatatctcttatgtcataacatgacaacaatagaggtaaattactctttggacaaacacatttttttcttggtgggtttatgccatgtttgatttttactgtcacctttacttcagtaccgagaggcaactagagcgaaatggcttgcacagaagagtggacagaagtatcggcaccgctttgatcttggcacacgaaagaatattcaaatggtacgaaatcacgaatagtgcataagatcagatcttccttctccatcatcattcatgataactgctacactttcaagaacttcaacactgaagattctttatgttcaattttattccgttgtcactccatttagctgatacttttgggtccttttgtaacagatcatgggcccaaacatcctgtgctggctttgccctactgcaacggggcatctcaaggatggcactgagttccagatcacaaacaactgatcggatcaacaaggaagcaattgctgcacacgtacatacttcatacatacattgtagatttgcgagtttatttggcgaccaaagttcttggccgttccatttgcttgttgcagtagagagctccacatttgtcaccagaatctttgtatgacagcatgtgaaatgttccatttccctcctaatctccatgtattctcttgcttcaatttatttgtgtgcagagctgtagatagatcaagtgatttgagttttgagcattgtgtactgacatattgaacggcaaaactatcaatttgaccagaattttcatgtcaatttcgcttattcggggaataaacgaaacgacatatttgcaaacgaaatacaatttgtgaataaaatttttatatatgtgttcttagcgatttaaaagtaaatgctgaaaaataaacttcgatgaaaaaactctaaaaacaactttaaatttaaagttgaaaatttaaattttggctgataatcataagccgaaagaggaggccgttgatttggaaatggttcagtacactctctcggttttgcgtctctctggtggttgggccccacctgcagtgtcacgtgtccgccacaaagaacacaaacctgacgacttggtgtcagctagtattgcagacggcttccttcttcggttcttcctgccgccgccgccgcctctcgccgtcgccggcggcttctacctctcgtttgcccttctggtgcgcccgatctcttgcatagcctacgacaatggccacctccgcctacgcagccaccgtcgccggggaagcagcggcggcggcggcgtcgccgtcccgtcgtgtccttgccggtggccgacctcctccgccctgcatctccttcctctccaaatcgccgtcctggtgcgcctcgatctctctccctccagggccccgccgcgccgccgccgcggccgaggagagggtggaggaggaggagccgacctgggtggagctggagccgatcggcagcgagcagcagctggagcgtgccctcgcggaggcgcagcagctcggcctccccatcgtccttctctggtaatactaataccctcctctctttgattgtgatgagcagtaaattttgtttcatttgataaatgcatcgttgtagcaacaccaatcctggatcttggatgacatggttactgggtagtagtactactagtactatcctgcaagttcagtttgtttttttggatggaaattggtcagtttagagttgaatttggtagtgttctgaatgaaattcaggggctcgattaggtgattgttcattcggtgcatctgaccttattaggtgaagtgggctagatcatcatcttgcttgaaatgattgtttcgcctttcatt

SEQ ID NO: 30503 - DNA, 10927 bp, Oryza sativa
aagcttcatcatctttttttttccatattgtgtaaaagagttaatgaatcttttttatccatttaaacaattggctgcttatgtatattaagatatctgagattgtggacaaaatgataaattaagtaccggtgtcacattgtttttcacatagcactcttcagtcttgcaccaggataatgcttagcttttgcaatttgtaggatggcaagctggtgcaggaagtgtatatatttgaagcctaaactagagaatttggcagcagaatgctatccaaggttagggattattttccagtaaagtaggcaccgctggagctcgccaaattgatgatctctgtcagtacttgtgttatgcagaattcggttctactgtgtcgatgtcaatgctgttcctcaaaagcttgtcaatcgtgcaggagtaacagtaagtctagccatgcttaatcattggtcattcaatgtttgttttatccttagtaaacaatgaacagaaatcattcttcctctcaccgtaattgtgcttcatagttcttaaaggtattctaaggcacttttagacatttcatttaaaaagaagtgctatttgtagaagtttttagagatcctttattgtgcttctttccctgttttagaggaaatagcttcctcttgagcccctggaaactttgttgctagttgccggctttctgcaatttgtatctaagtttttgttagctctatcctttagctttggtaacagagtaccatatcaatgatggacccttcatttatttggcctcgttgctatcttgtcgtgcaacaatattcattaggcaacttgttggaccccaagtatatattaatctacacatctaatgccttcttttgtccaatatatgtgatctgttacgcggaactcgtgcagaagatgccttcaatacaggtacaagcttttgtttgtttctctatgtattgacattgtatatccttaagatggtttttttttgggtcatgtacagctgtggagtgactctcaaaaacaggctgaggtgattggtggacacaaatcctggctagtaattgacgatgttcggaggatgatcgatcaggaggaatgatccattatgtcctttagtgcaaatgatgatgtgatgatgtccaacaggaagaatctttcagtatagcaaatggagaaatcagaaatcaaaagccagtatgaactcctttcaagagatcgagccatatatttaagtatcgaatcgacgaaattactacctctacagtcaaataggcactactacacaaggcagcatttcaatcgtgttctctccaaatttggggtcgacagaatttcacaacctgtggctgcattcctgtggtgtccttgatgtatccatgtgtcttgtttggaaatctatgcaattaaaggcaaagacttcttgctcatgtactgtcacagtacgggcaagcatttaaattagtcattagatgacaataatatttagtcaatgagccttcagagggcatgttgaaagtgttatggttccaaatccatatgctgcacaactgtgattgacttgaactactagtactacaaaagatagctacagtgtcagccttttgcaaagcaggtgttgctagttttgttcagaatagaaaaacaagcatgtatgtatatgttcctgctgaacaaagtatagttatccttaaagttaattgggattagtggaagcaagttccctcttataagctcaactagttgcccacatgcttcagcattgggtactgggggactaatactactttttttcaaccacaaacaacatgaaatgcttttgttttcgtatattaaaacgatttcttaatttgatcgcaacctcagcactttcttgtgtctggcactttaaaaaacacggcaaaagcactatctttacaccttctgcttctgcagtttagagaaagaaaacacacaaatcccagactgaaggacttgttaatctctctttttttttctccacttaatctgctggtttgactagacaatcaatagtagtcaatgaaaacaaactctttgtgattggatagtggccagggcatatagaatagagggcccacatgtcagtcaccgcaagagagagtgaggatgatcaccacagtttcgtgaaagaagatcagaatcagatcagccatggtggtataaccgtccttcctgaaaccatgcaacgcatgagaccggagaaaaataacaaacttgagagatgtcaggttgttagggttgggaattcaggtcagatattcagaattcagcaactgcatttgtcagtcaaacactgaggcatatgaacctgatctcgaaaagaggaaggaaaaaaaggcttctctttttttttttcaagttgaggtcctgttatcctccaataagtgtaacaacagataaatgcatatgtttttaatttagtttccaactttataatattcaaatcgctcatttttaccctaaaatagttattgccacaaaccatctaccaattcaggcacaaaagaggaaggaaggaagaaaaaaggaaaaaaaaaagatctcctcctgagctgttcgttgtcgccgccggtgtgaaccgaccttgtgtttgtttgtgcatgctaaagctaggtcatataatcttatcatgccactcctacacacggtgcattgagattcgtgcgggggtgggatcggacggtggggagtggtccaagaggagagaaaagaagaagcaaacgcgtcgctttcagctgtgggggcgtcgtcttctcccttctctcgcgtctcgcgtctcgacctcctttcccattcgctaatccttcctcctcctcctcctccgcagtagcagcagccgcctccagaaattccccaatccccaaaccctaaataaatcacccccacccccacctcctcccccgtacacgaatccaacccaatccgatacgatacgattcaatccctcccaggagacgctgctctttctggatgtcgattccgtaggggggagtctctctggtgttcctcctcatcaaggtgaggtttgtttttttgttattattattgctgttcgatcgaatcgttggtagatgaggagggaggcggaggggattctggcgatggtttgtttgttgttttgtgtgatgattcctttagtctggggcataggaaaatgttttggttgttttccttccaccccgtggggattgggtgcgattctttcccggtgtttcaatctgagttgtgactggattcgtctcaaagtttgggtttttcttttttgtttgcctgttttcttcgtgctcccgcaacttgatgctggagtctccttaaaggtgggactttggggggttttttttccgactctgctgagggagaagaattcgtaggaagaaactggtggaatttgtttctttgttctttattactaggttgcagttctgtgaaaggaaggtgtctctgatcgttctttttatgtactagttatctaaacaaaaacttcagatttctccctagattaccatacatatttagtatcaatcagtatatatatatgaatatatgagtcatatattggtgttggtttaggttttgcgaggagaagaaggcgagaaagaaagaagtaggttgtgacgaaggaaaccgcagaagccgcagccatggcgccatctcctgcggcagcggctggccccactttcgaggaccttgagcgcgacctgcaggcagtattgatggaccagaaccactcggcaaccgccgatgagctcagcatgttccgcagtggcagtgctcctcccactgttcagggtgctcgcactgccgttggttccctcttctctgctgcgcctgttcacgtcgacagctttgttgatcccagcaatggtggtgttggtgatgtgctctctgacgaggagataaggtctcacccagcctacctgtcgtactactattccaatgagcacctcaatccaaggttgccaccaccaatggtgtcgaaggaggattggcgtgtcgctcagcgagtacaggctgtttcaggaggggtaggggataggaggaggaggccctcggatgtggggggtggaagctcgctgttttcggtgcagccgggggcacggcatggtaatggagaggatttactggtgaatgataggatgggcggaggagaaagaaacgggctcacgcgtcagcaatcatcagagtggcttgggagtggtgcagatgggctcattgggctatcggattccagtggtcttgggtcccgtcgcaagagctttgctgatgccttgcaggtcaggaaaatctcctcgaattgattttttatcttttcttaaatcaccgtatatttaaacctcgactagaacatatgctctattctatttttcatgaatctccatgagtacaaacagacagctattgctaaattgatttatggtatacctatcatgttgtgttctttagatcactcagacagctctcatttatgtttggtaaccttgggaatgagaaccaccatagatatgcctatacctgaattgcattcatgacatgttgattgtatttttcactcgataattcagtgtggaacttctttcagagatactgttatgccactactacagtgcatcaccattctcctattgcagcatagttttctgtcacattgtttttcttatcatttggaatgttttttcatgacaggaaaatattagtcgtcctgcttctgcggccagtcatctttcacggtctaatagccggaatgctttcgacagcccaaatccaattagacctgattcatcaagagcgcaactgcagagcagatcagaatccatgaatggcttgcgatctggatccacttcacccagtcttgtcagggtccaaagtttaggttcttcaatctctcataactttgcttctgcagtaggctcctctatctcaagaagcaccacccctgacccccagttgattcggaggactccaagtccttgccttcctccagttggagttaggatgggaagtactgataagaaggttgatggctcggctgttgcttcacataatcatgatactgctgacattgcggcggctctatcttctatgaacctttctggtagcaagatggccagtttagaagctgaagttcaaaatcgtgcataccagaactttggtgatcaaacagatgtactctttagcgttccaaaggagcgcagacaattatctcagcagaagttagctcaaaatgctgatgaagaatcgataaatgccttggaatatgcagcttttccaaatggtagcggtaacttcaataattcaaatatgagcaagctgtcagttgatagcaggagcaagtttcctatacaatcaccgcatggtaatgccaataataaaggatctcttgtgagccccactggatctgtgtctctctaccagaaccttaatggtgataactccaacattgatgtatctgtacggaataataagatccgttcaagtagctttggttcatccatgctgaacaatcaactgagtgctggtacctctctcttttctttttctccaatctatcccctcctattattgtttgagttttgacccttttttttcctgtgcagatggtgaatatgttaatcttctttcgaatcaagggggatctggttttcagggccaaccaatggagtcaatgtatgctccatacttgcaggcaaactctgactctccccttggtgcagccacaaatttgaatccattccaaggaagcagcttttctggttcagtgcccctagatagccctggataccaaaaagcttatattgcctcattactcgctcagcagaagctacagtatggcgtgccatacctgggcaagtctggtagtcttagcccgaatatttatggcagtgaccctgcatttggcattgggggaatggcatatttatcgagtccaacatctaccccttttatctcatctcctcagggccatgttaggcaaggagataggctagctcgtatctcatctgtgggtaagaccactactggagggcctatgggatcttggaattcagataatggtctaattgataatggttatggatcttctctgctggaggaatttaagaccaacaaaaccagatcttttgagctgttagatattgtaggtcatgtggtcgagttcaggtaattttctcatagtatatccatcagagtaaagttgctgttttcagatatgatgcttgatacacccaaacctcctgttgcagctcggaccagtatggaagtcgctttatacaacagaaactagaaacggcttctgctgaagagaaggacaccatttttccagagattcttcctcaagcacgaactctgatgactgatgtttttggaaactatgttatacagaaagtgagcagccctactattccatcagtattcggaaaaaaatgatgtttttttagtgatatgtaaaaatgttatcatttactggttctctctaattacttgtgcttggcagttctttgaatatgggactgaaccacagaagaaacaactggctagcttactcaagggctatgtattgcagctgtctcttcaaatgtatggttgccgggtgattcagaaggtatgtgtattgtcccctcatattatcactagaaatgagttgaaagaccgactctgttcagttagcaacaccttttatctctgaagagactcagatgcacactattctgctgtaggctttagaaatggttgaggtggaacaacaaacccaaatggctttggagcttgatggaaatattatgaaatgtgtccgtgatcagaatggcaaccatgtaatccagaaatgcatagaatgcatccctcaagaaaggatacggttcattatatctgccttttatggacacgtggttgagctttccactcatccatatggttgccgtgttattcaggtgctatgctaatgtatatctagttttgcttgaaatattacttttgcaacttgctaaatgtacttgcctgtaatttgataccaccagcgtgtcttggagcactgtaacgatgaaaatacgcagagcaccatgatggaagagatcatgcagtctgtggttctgttgacactagaccagtatggcaattatgttatccaggtaactgcctattgattttatgttatctgtcgaaacttcaatttcacctgtacttgtttaagcattgggacgtatttcctatgttaagacttctcatctgccaaattgggcagatacgctccatgtgatgtactttctcttgttttcgtttataccattggagttactttacttttgtgtcccatttattcaaagagcttccttgtttatatttgtagcatgtcttgcaacacgggaaaccagatgaacgttctgctattattaagcaactggctgggcagattgtgaagatgagccaacagaaatttgcttccaatgttgttgagaagtgcctttccttcggtagtcctgaggagcgccagattctaattaatgaaatgcttggcacaactgacgagaatgagccattacaggtatgttttgatccagttacgtaagtgtatcgtttccgttcgtagaattttcatgagttttaggctttgctgtgataatatattaatatggttagtgtttcttgaaacatactgcttggaataagatattgcttttctaaaatgataccggtgctgtggtggatatcatggctcacattcctctaaaatgattaaagcaaatgtttcttctccaggcaatgatgaaagaccagtttgctaactacgtggtgcagaaggttttggagacttgtgatgaccagaaccgtgaattgatcctttcacgtatcaaagtacatttgaatgcactaaagagatacacctatgggaaacatattgttgcacgggttgagaagcttattgctgcaggaggtgaatttcgcagtccatgttcatgcatagtacagttcatccactctcttttacatgtttcctggttattactgactcgtttgtttgttgcttctgtaaatatatttcagaaaggcgcagtggagtgtcttcgtcatcttcgtgagattgcaatggttagtttgacagaataacacctgtacagacaaatagcgaggctagccttacctgtagtcttgttgggttaaatcggaaaagctaagctttgaaagcctttgatgtaaataaaggagggcctctggaaataaaaaggagagagtgtgcttgttcttaagaaagaagctgtatatttgtacgtttttcccctcttcgagtaagataaaaagaaggaagaaaggcaaagcatggaagaaattagtgcaaagatttaggatagatgatgggaagcaaggacacctgtagatccttttgccttgaatttcatcagtgtataaggtttcatgaggtttcatctctgtaaaggttttctacttaactcacattttgcagaaatcaaatgcatgtctctgtttatcagaattgtcttcagctctaaaagtatgaatatttgtgttcactgcgttccccttctcatttctcttcttataaaattcgtggatataaaattcatggtcccaccgattggcacgcctggtgggaccacgaattttatatccacatgtctgaagaagtcaatgccaagatcattcaatcttggctcggggggcaagcacatcagtatcagctcatgaaagctgattacaagatcagacagaagagaattttggagcatgagtcctcatactccaaaactgggggggcatgtgttaacagtgaaatttggtaatttagtaatcggcaaagacgtcatcggcttagaatcattatcggctgcagcatctcggaatcagccgatgggagttattaagtcgccaattagtcggattcctgctatattcggttaatgaaatcaatctactaaagaaaacttatccctaagtgaccgagtttaaagaggatgcggcatggcagtttatctattaattagaaatagtttgttagtttccttttatctttaggaaagtgtgtttagtgtccgataaggactttatatttttccttttatctttaggttagtttctttcttgtccaataaggacttgtatcaacccatgggtataaatatgtacacccggggtctatgtaatctatcttcacgatcaatacaattcggcgcatcgccaccctttttacttctacttttgtttttacgttccggtgagacttggcacccgacgcggggctgcatcgtcttcgatctccggcgaagggataagtccaatgttccgccggtccaggcaattgtatcgtctacatcggcgtcgttcaggctgcatcagtacattcgacctcttggattgctctggtttggatgatatatttgcctacctatttatgatatgtttatgttaatctagtcttagcatgtcaatttagctctatcggctgcttctcgttttagggtttctgccggtatcggctaaatcacgttgctagattagattagcttagacatctaccaccctgaaaactcagtcaacggcttgattgtctaggtattatgtttcttttcatacttagtgttgcatcagttaagtttgatctactaagtcatgcttagaaccataatctctagcctgcttcttgattgccaataagggtttcatcggggtttcagccggtgagttatctggatgttgcatcggctcataatgattgcatatacatataagttggatttagccgatgacaataaaggtttcattgtttaatctaatcttgtggatttcatgatatcggacctccagctgatgtgtgctttaaccctcggatcggtgcttatttatcatatcattgctagccgattggtttatacaggactatattgttattttattatatcatcatcagccgattgcctttatatcattatctacattggatatatagccgattgcttaaaccctatcgctatcggcatcggctgttatcggctatcggctggaactactccatcggcttgttagccgatcggctgttttgatctgctatttgcatatcttgtcagttgcaagatcaaactgactggcacgcccgtatctcatcaatctttggatctgcacaggagctaagcagatctcccaggccggtgtgttcgatttttttcgtcaacagatatatatttttatttactgagaaatacgtaatatatagttcacaagttattaaaccatatggatttttacaaattaataataaaaaatagcacacttagaataaactaatttaaaacggaggggagggagcattatcttttgtatgatgatggttgctgaattgttgggtttttagcacgatagatttgaaagcatatataatgtccacatttatttacactaccatttttttcccttcttgagaagatgttctatttctataccactgtggtttagtgacttgtgatgtgaataaggtggtggcaccaccatacccacgaagatgtacagacaaaactagcgaaaaccttaaaagagtttctcccggatgcaatctccaactttgtatcaaactatttattcaccctttattatttcatcttttcaagagttattggattacacggattctaagtgatctgtattgcttagacaagcagcagatcctctcttacagttacagtcatggaggtaagctcatcaggatacataacaaccgagttcagagcacatctggaccaacaacagttgctttgacaccggaggcactatgcacacggcagttctgtggcggctactttcttggacatcttcaggaagaaggccagattgtggtgaaacctgtcattgcaactgccttcatcatcaacaacatcaccatcagctgctccatggatgttcttctcct

SEQ ID NO: 30504 - DNA, 16627 bp, Oryza sativa
  unsure (1)..(16627): unsure at all n locations
cagttaggtcttcgtcagttccagcatcaggaggatcatcagcatcttcttcgctaccaaaaactgaataatcatcctccataagctgaaaagtcagggtctttgttaggtcgaatttatggcatcaccaatctactcaaaccagtgttaaggcagtgttgtatcacatgtaattaataataaaacattcgtgcgaatatagacgagcatctaatgctagctcgtccaatttttgcactatatgctggaatatcaaatgcaaatgatgaaacaaacatatgtaaggattgaatagatccatgtctgcgatggcagcatgtttctcctatcatactgtaaacacaccaatgcatacctcttttgaagggcaatctgacacctttggtgaactgcagcatgaggaataatatctgccgcccgtttcaatgccatcagctctcaagtcatctacacttcctgtatggctggtgccacctgtgtcactcatccatgcactgatcccgaaagatccgaactggagattgactggctccgccttcccaaatgtatcatacatgggattttttgttgatttgtcactgcttgtaccatcgagacttccattgccattgtttttatccacatgccaagctttggtgacactaccgtcagtattaaggatagccatcaaatttcttgaagatccctgtctttgtatcaactgaaacattcccttggaacccagtgagttagcagcacgctggttcctgtattcctcattcactacagctacagtgtttgtgttgaggtcatacaactgctccccagcttctcgcctgcgaagacagctgaaaaccgtggcgtgtatggccgccacactctggtcaacattagtattgttaatcttgggcaccagatgcttgtctgcacggttacaaaggtagtcctggattgctctgatgttccggatgtatttgatatatctgttcttcgctgggtctagtgtcatgtactttgcacgtacagcgaatcgctccatgtgtttctcctcattcgcaatgtataccataaatggtattatggaagggtgtttcttcattagccccatctgttggaaaatgaaaatagaaaaggctacatcagttctctagtatgcaacaaagtataagtaattgatgcaaatatctaactagtacgcaacgcaccacaaaattgaggcttagatgaactccctcaacaattacagattgtttctgctcctcccaggacgtaattaatctgtccaggctgtctattaccatctcgctttgcgccttgaacccttctattgccatttgcttgctgccgatcaactccgttctaggaggcaattcggaggatccatgatgagctttatcatctgaagtgtcgtctctgccttcattggtattaggatgagaaacaatgtcaagcttctgtgccttccgttttgcctttgcctgagcaactgcaacagggtctaagcattcgcctgcatgataggttgatgcatagagaagaggattttgcttctcatccgtaaagcctctcatcatatggcgtatggaatcagtagaaactactgtcgtgatacccaatctactaccctgagaaaaacagacagaccatatcaagtattaatcaagacccagaatcattcattgttcggtaagcgatacaatcttctgaaagcaatgaggtaattgataggtctagaaaggattttttttttcaagtggattttgttctacagacgttttgcattatactttaacatgtaacaaactactactatgttgctggtacagtagagcattcactcatccggaattgtatggttcgcgtaagtgataaacataccaacaaagatgatagcgtagatttgccgcatccgctagtcccacataagagtactgtcactgattcctttctctccttaattctgaacagaacaattggaaaatgcacagttgcacaaaaccattgttatttcaatgcattcaggtagctttccattggctgtaatgaactgatgattggtaactcattgtaacttctgaatttataaatgcagaaacaaggaaaaacatgttacctgcaagcaagaagaaagtcagccttctggtttggccccacatacttgtatgaagagagggcatcacatacaacacttaggaacttctccctagaaacaacgatggttgtttgggtcttgtataactcgaagggtatgctactaagagttgcttccaaaattttgggcttcagcatctcaacatcttttacaagggaaggggcattttcttcattatctgcagtatctgatttggatgcatccaagaattcactcctcatcacattgaacaccctcttgctaatctgatgatgccaaagaaagatgaaaaagaaacttcttatcttcacaagtcaagagagaaataaaaaaggacactttgtgcagtctgatctacagaagtaggcatcagcaattagtttcttttgcagctagccaaattgtgccttcagagaaaggaaaaagatgtcaaacagccatgaccaagtcagggaagaacaacgcataccgagtgggaacccatgaccaactcaagtcaattgctagatactttctagaatggcaacccatcaaactacaggcccaaggcaaaaagatcaagcaaggcaaacaggtctacatcatacagcatggtgttgtctttgtcgatagaacataataataccaagaaaggtacagtaattctcatcagctaggcaacagtttgcatggcagtatatctctgacaatgactcgtcacaaacaagtatatttccgaaaggacaagttcagtatgcaacaagaacatatcttgaaagatatgctgggtttttggacataaaaattgcgcggaatcagaaccaagtgaggcgctgggtgctcgaatttgacaaaggttccggtttcccctgcaaagaacgccctcgcgcaaaaagatatcgaaaatgatgtgagagagtttgatcaaatcaacagcagtgtgtgtaaagacctgacttgagagagtctggatgtgagctaagaacaaatctgcacatcaatcactaaaacccgtcacctttctttgtcaagatcatccatccccccccccaaaaaaaaaaaacatacaacatccagatactatactcggcatgcaattctatcaattaaaccaagaacaagcaagcaattcacagaaaggagcaaaaggatctatcacatcagcacgtgcaaaccatacacaacgctggatacgagaagcagcaaaatttccagtcgaatcgaagcggaagaatcacgagagagccaatcagatcgccaccagttggatcggggccagattaggcagaaattaagcgggagagagagagagagagagagcaggcacagtttttccattgttgggatcaagatgaacaagaagatagaaagatagataggtattataccttgaaggcatggcgagccttgcatcccatgagttggagggtgccctgaagcacggggcgcgtgtagcggaaggcgcggcgagcggcggcgtctgagacggcaatgtagaggagcttgggcggcggcggcggcggcggcgcctcctccgccatgtcgtcccctacctgcaaaatcaagaatcaagaagaggcctcccgcggcggcggatcaaagcaaggcaagaagcggcagcggcggtggcaaacctcgtgctcgtggggatgaggaggaggaggaggagaagggggttttgaggaggcgcattgcggcggcatgggcatggcgatggcggtgcgcgggcggcggcaggtgtcacgacgtccacgcagcgcacgcccatggcgtacacatggcctcacccctctgccgctctcggcgtcctcttctacccttcttcttcttcttcttcttctctctcttgtttctctctctatctgtgcttgctttctctctctctctctcttgtcttggtttgattaaccttcttcctcttgggtcttcgcttttggatttgtttttcgcctaattttctcctaattttaagggggggtcattaaatctagtggagttgtgtgtgtgtcctaccttattcttcttctacctcttctcttctcttcttctttgttccgcttttatagtgttctgttctcccttccttgttttggattctttgcttccttgcatcaatcaaatgcttccttccttgcatgtgtcgatgcctaatgtgtgtgtgctccaccctttggattagatataacatgcaattcgagctcaaatatattacttttatgtatccactctttttttaaaaaaaagaaagctttacagattgaattgtactattgccctgtttattttagctaataattattacgagcacgttttacaagccgttaattagtgcgatttttatattaaaaaactattgaacacttttttgggctattttttcaaatttttaatatttatttcgattgtttatggccttaagtaattgtcatgaaattagaatacgtatgtcaaacggcgtaggggaaaaaaaggaatatatgcaggtttcactttttttggtgaaagtagccggtcaaaaacgtactctctctctctctttgtttgacaaaatgttaatgcaccatgttatgtatggcattacaatgtcaattctacgacggtgcaaggatttgaccgtgcaatgcttgttccaatggtcctctagcttccttgatgatactagctgtttttgctaggcttttctacaagggaatccaagaaagtctttagcttaattagcctcgtctattcttctcttcttagttgttgttaatattaaacagcaatgttaacagttggtcaatgtctttggtgtataggacacaccttggctcgttgttcttgattgctccaattaatagcacaagatatatagtaatactaagagttaagtaaaaaaaaaaagtctctggatgaagaagcggttgcagctgcacaacgtgatgaggagcactcttgtgttaatccaaagacgtggacaagacaaatcttttggatttgtttatctggcgctacggtttctattactgccattcaattgtttgttagtgccactactactccagttagcgtacacactgagtcatggatgatgtgtaatcagcttctgattgctagcagtggtattccagatttttctttaaaaaatggcatctctatatgttcaattgctcaattcaaaattttcacgtctgtttgaaaaacaaaatcatttggcaaatatctagatataccgattcattcttgaattagcttagaggggtatagtgtgggtgcatgtatatgaacaggtgtgtgtgtcagtgtttcgtaatttttttttttttgcaaaattggaaaaaaaaacctttccaaatattcttttaaaaattgaaaccttagatttttttttctatatgcatcattcgttttatagtaatagatcatatcaaatttataaggtttgtagtctcacaattttatttcattgaatttttcgtataaactagtgtctctgaaaataaaggaaacaagggggaaaaaaaggaaagagagagaaaggagagcgggtcgcggggggtgcagaccgcgtccgagcccagtgcgcgccaaaaaaaaggcgatcaacggtcgccgcggcgcgccgcgttgggtgggcccacccaccttcgtctccgttggttagtttactgtcttgctcttcttccccagcttagcttagcttagcttagattagctcgccatgaatcaccttttttcttcactcatcagaatatcaggccagcaaaacaaaaccaaaaacttgatacgcaattagtcctttatcagctgatcgaaaagacgaaaccaaagagctaggataggagtactggtagacagtagacggtggacgaagaatccaactctctctctctctctctctctctctctgcgtctttctttgttttctttccttctttcttttcttaaaaaaaactaaaagaaaaattatactacctgaaatccaactgcttttgctagctaatgtgtacgcgaatattgggaggattgataaaattgtgtactgtcagattctctgatttatctgatccagcaacgaaggagattaagcaaagcaactatcaataacatacttcttctcctagatggatggattgtatatatgctctctcctttttttttcggcaatcagttggctttaatttttgctcttctgctataagaataagaatactattcttccttcataaccttcgtttcagactttcaggattattaaaaaaaaaagaggattctgggaggaaattaaagtgatcgtatgcaacagtacaaattttacacgtgtgcggtgcggttgccgccatttcttttgacattctccgttcttcttcttgttcattcatgtcaggctcgacttcctacagcagcatcgtgagatgagcaggattcctcctgtttaatgctttgcgttagccagaatctcttttttttttctttgtttcctttcttcaaaaatcaaagcaaaataagaagacccaatgaaaggaaatccagagagatattaagtaattatagcaagcaatggcacaaatgtatgtgtaattgtgtttgccgcaaagggtcaggcctgaatcctgaagaccggagccaaagaaaagggggcttttaactatttgccactcttacgaatggtgcttaatgatttgtcactaggcccacatatcattgacagggtgtgtggcaaatatttaattgccatgtcacaagagtggtaaatagttaaatttcccaaagaaaggagcagagatggttaagcaacttgtaagccgaactgtgaagaaaccatggttatgcaaattctcgttaaccatagatatccatggatataaaatctttgtttttatggtgatatttttaagtagttttcttgcttttagttaagctgtgattttgttatttggagtcgttcgtcttgcatcatctataataaattgtttgtaatttttttgaagtaaagattagaatgaattcttttattaaagaaaaaaagtatataataaattgattgtaattttttgaagtaaagattagaatgaattctattattaaagaaaaaaaaagtagagcagagatatacaaagactagtaggatggtcggtctacaagagcggtgacggtgcctgaactgactgaccgaccatttcaacattcaaactgcctgcttcacacgttcatttattcagaaatcaattatcaataggaagattatattacagataggctaacatgttcatctgtgattggataagagtagtacgtaacccttgaccatgcagttcaacattgtactactcctctacctcctagtccttgccgacctctctacagaagagcagccccttcagaaaacgaaaggttgttcttttcttttcagatgagaaaacaaagagtttggactttggagtaatagcttgatctttttttctcctctcttgtctatctcagatgggtacagagaccttattagttgtgatcacactgtgctggtagagcatatatcacctgctgctacagttaagggagcaacaaatgttcagaatttcagaacaggaaatcaacttgagttcaaacacagggaatgacaacttgggggtgtttagatccaccaccggcaaaaaatttttgccccgttatatcgaacgtaacacatgtatggagcattaaatattaacgaaaaaataactaattatacagtttgtgtgtaaattacgagacgaatcttttaaacctaattacactatgatttgataatgttgtgctacagtaaacatttggaaagggatgccatactgtgccatatgagctttgggcccaatagtaaacaaatgggcctccattattgaatactcctctcgtagtctcatctcatgtcagttgatgctgctccatgaacaaactgtaggagtatgtcaattatcattatcattattggtattatatggtggcattcgttccgaatgaataattgtagcctcattccggcaaaatttttgagaaataataatacaggtgaggtgattgataattgattcagggaatgcaatgcagtgcagtgcagctcagcagcagctatatacgggaccggaccggactaagacgaaattattccttccatggattccatatttccatgtatcttctatatcatttggagatatataatcatcaccacaatgtcctcctcctactatcagatgtccatgattgtcatcagaccaacaagacaatgagcaccagctttctttctgggtcatcttgatcaacctgggtcatcttgatcaaggaagaaaagctttgcagcccaggcatcaatggtggtgatggtggtggttgtgagagaacggccaccatctcctcttcctcgtcgtctgcgacctcggcgcatctgatgtacaaaaagaatcaagaaacaacagcagcttcagattgattcttgaggcgaacaagacagcagcagcttgtgtaatggtggttgcatacgctggcgacgaagaccggacatgcattgcatcgtatgccaatggcaggcagggcctactcaccgttctgcggatatatggagttgtagtgaacctccgcccaaaagctcaacagcaccactgcaatcaatcaagtcaaatggggagcatcagatcaagccaaacctgtcatcatctatgatctatccactatgatcacttgccatgtgcatattagtacctttgttggacttctgaacctttggttggatctcaatgtagcacgtatccttgaacgatgtcatcacgaaaatcttaactccatactgcagcagattgtagcgttacattagaacggctttggaaatagaaaagactagtctttgtcagctctgatttgtaatgccatgaatgagacagcagggagagagatttgtataaacaccttgtcagcagcagcctgtagagtcacatggtcaccccattcaccatttctgttagtttatgcactaaaacatctgttaggcaagcattcacatgcacttggtttgtattaacaacaaatgattgaattgctgtggaacatactgtgatactttctccaagtaatcgtcatatgccatggggacatatccatcgtaggcatcacggttacttttaagctgggagacggatggttcatcagaaggaagagagatggaaggatgcaaaataaagcctgaaactagggatcctggagcaaagattaatgcagatatttacctggctcataatctgctgcctcacaaactcatggtgatcgggactttgatacagttgatctgatagtgcccgaaactggggaggttgaggaaacacaatcagcatcaattgatacgtctttcacaacgcatgtttaacagcagtaatgaaactttatactaatattcaagcacatgaactaccccaaccgctgatatggtaatgctaaaacttcactattaacactataggataaccatgtgccaaagcagagggggtaaaggaaagatatttttaggggaaaaatggtttaatagggaaaagagccaagcatcatggtgaggttgttagttggtactaacctgacagttgccatctcctttcaccttgtgctcaactagttcatacaacctcaacctacaagattacataaatacaaatttaaaaactcaacatagatacagcatgtatagtaaaaaaaaagttaaggaaaaactgaatcatatgttagtaacttggcccatcacagaaagcgcaattctttcagaggcatttgtaacacaaacagggtatgataaggtgtgaggcttgcatatataacacaaaagcagtatatcacttagaactgaaactaagttgacctttctgtcagcctttcatggtccatggtagcttcatcgactgaagggatctctccattaattttaggaacatgctggacaaggcagaaacaagtactttaaccaaatgtgagaatgtagagagagacgccaaactaattcacagtaggttcatttccatctgatttctgaacaattattggaaaagaaaaggacagtagctctactgctatgcaacagtataacactgtgggataatactagtttaaagcaataactagcatggttttagttatttgagaagttctgaacttcagataactgttgtgccttgaaattatgctgatactatgcactttgtgcatttatgttttctcaggatacacacaacatgggcaagcaataacatatggcaaccacaatgacacaaggaattcagtatacatggcttgaaagcaaaactcaatccacaaaacttggacaaaaacagaccaaagaatatccaaatttaattgttctttcaatgtacctaaagactcatggaagcatttggtgtcacatccgttatttaagtccaatggcatttaaaggaagtggtccaattgacaacgatataaagcgatactccctctcaatgagattttagccatggattaataaacatataaaggtgttttgtaaatatattagctactatcgaccctgcttagtagctactaataacttaataataaagcaactgcccatgtttcatttggtgaattgaacagatgttaggtccttcctagtttcctttgaagcaaaacttcctatcttctggtggttcctgatgcagatcaaaaatcataacaacactacttattaacctggcttcaaagggtcaatagacttacgggaactggcaccatggggtaaaacctctttcctacttcttcatccattgggaaactgtcgtcagtgtctgggcatgaattggaactagtcggctctatatagactgtgtcatggtcatgctcaccagcatttcctgcaccacaccaaaagcattagggggaaaggcagaaggaacaaatattttgcgagtcaaattacagatattttcactaccaggatggtagatgcctactgatgggttgtacaaatcatatgtcagtgcagaagaatgcaagtgcgtctcatccagatgtgatgcatctgcagaaccaaaatcatatacatgaggaacactatctcatttttcatagtttttttctgtaaatacatgcatgtcattccacaaaactacctctagcataatggaggtcacaatagttgccatcaccgtaaccatgaggaggtccatagtacccgataggagcaaaagggtcacggaaaaggtcataaccccagtggaaattttgatctttctcacacatgttcatccgttgaaatcaagctctgtcaaaaacactcccctggcaagaagattacgatttaagcgtcagggtattaacaccagatagagagagcaaaaaaaaaaaggctgatattctcggtttcatcaaagttgagctctggtgactggtgagacttgacagaaatgcgtcatttcatcatcacattaaatgtgcgatgataagaatggcagattgcagacagctaacgaatcattacacagtcctccagggaccacggtggaattattagatactctagcgcgtcctgtgtatcactccaagcaaccaaatcagcaacctaatactaataagcaagaacaaaacatttttcgttcgctgcacactgactgaaagggtccaatatcgttatccccaccacaccaacaaactaaaggttgcaacggtctaacaattcagtccaagccaatccaatacttttctttagcaaacttaaaatagcctactgctttgtaactacatctgatatgtgcgtttaaccttttgatacgaacaattaagctagtattaattaaaaaataactatacctgtatctaggtatattgcttttccgcacagctattgtctcaaggagaaccaatgatgaaaaagttgcaaaagtattataatccaacaagcttttcccaatcgaagacaaacaaagaaacaaacacgcggttttgacctaaagtgtagcttcaacgatcatgaaccaaactgctgctaccttaacatgcaagattgcagctttcttcctttcggttcatggacctaatcatttccaataaagaaaggggaaaaacataaaaaaaaaaaagcaaccctttttgttgcaccactgccagttcataagcttacaaaatcaccagacagcgcgataatccggcctagaaactcccccccctccccccccccccaaaaaaaaaacgcaatatgaaaagagatgataaccaaaacaaaaaaaatcagtacacgaacatctcaagatcacacaaagtttttccctcctgcaaccgcatcgatcagcaaagctatgggagtaaataaacttaaattagaaaaaaaataagaggaatattcgaggaaaggactaaccgcgtgtgctccacctacgacgaaattcctcgcgtccgtgaggggattctgcagtcgaaaaaaattggatcctttcgacggcgagccctgcgattccccggaatacgatcctgagcgcggataggagttggggacgcgagggtagaagagggatcgagaggtcgaggaaaaaccggagcagattacgtcgccgcggcagatccacggccactctacgagtccacaccacacggggcagaactcaccgctcggctcgccgccggcgaggcacgtccgcggcggaggagcggcggcggtggtggatgacaacgccgatgagcggcagcggcggcggcgagggatcgttcgggaggaggcgggcaaccacccggccgcatgaaatcgacgcgcgaaggagtcgagagcagccagccaccggagaattcgtggtgggattgacggcggcgagagagagagagattgctgcgtgcaagaagcgcggcgagagggagaagaagaagatgagacgggcaaaaaaaactgcttcttttttcttgtgttcttgagttttttttttttttttgaggtggcatatgctcttgtgtttatagcgtggtgcgtgtgtgttttgtggataggaccttgaaattttgttgtttgtttgtgggggttggagtgaacaagatggccttctcctcttgtgtggcggcaaggacgacggctctttgaaatttttttggttgttttatttatgacattttgttgaccttttgtttgaatttgatgagaaaaaattgacctaggaattaggtaggagtatgccagaattgattttaaagactggtgattaataaaatgaattggtttttaatactacgtctcagacagtgtgctcgtttgattaaataaagtcgtcatgtaatttgaccggtttttttctatgttgttctttttctaccttttttgtcgagttgtgcagagttcattgtaggttttagaagctaacttattatagtgatttaaaatggatacatattgataaaatatggttcacctttcttcgtagccacatgattttgccatgtttgacatggaaaatataaggtcttttttaatccaaataaaagagttgttgtataagttatgtatgttttcaatttttttgttaaattgtgctaagttcattgcaagtttttaaaagctaacttcgtatgtgctagtatttaaaattgataaatattgagaaaaatatggtttatctttcttcgtggccacttgctttgtcgatgttgacatttgtagcatggcaaacatatggcccataacaacaatagtaccactagctataactaacataatagaccgcactgtgttggaggaatggaaggactgaaacatagatatcgataatattgtgataacacaggctttctgcgtaatgggttaggcaaaaaagaactcgtgtctcaagagtttccttttgtagacaatgaattgattcaatttagagaaaacaaggaaattggtgataaaactctactacagtttgttcaaaatgcactagtcataatcccttgagaatattctagtaccctatttctaatagaagaggtacctactgaaaatcgctccaacaaatccgcttaagaaaaattacaaagttttgaactcagaggtttttccaagggatgcatgttgtttcaacctctcaccaaaacagacaagaggtatatcactgaaaattaatacccagccatatgggtatatgcagtgcgcgaatacgtttataccccacccaattagaataagaggaaataaaacataaatggagaaagttctcgtgataagatcagccaatagaagaaaaaagtctctaatttttcaaaccattctaagcatgtgaaaggtcaatagcctaaaaataaaaaaacctctactttgtgcaagtgataagagagaatatgaaagattttcctatttttcttgattttcttaagatttttttaacctgaccatgaatagacttatatatctcgatatatacatatataatgtatattatagacttatgtatgttttcaatttttttttgttaaattgtgctaagctcattgcaagttttaaaatatatttttgtatgtgctagtatttaaaattgataaatattgagaaaagatggtttatctttcttcgtggccacatgctttgtcgatgttgacatttgtagcatggcaaaacatgacccataacagcaatggtagctataactaagataatagaccacaatgcgttggaggaatggaagaattaaaacatggatatcaataatatcgtgataacacaggctttttgtgtaatgggttaggcaaaaaaaagaaaacaagtgcatcaagagtttccttttgtaaacatattgttagatatgtatgaattggttgaattttagagaaagagaatatagcttagaattgatatcaacctaaacctaactaggctcaggattggtctgataacccgcaaagactcaataatacctgcactattatttcctccactctcaataaatactcctaagtaattacgagttgtatggttatatataagacgttacacatttcgatgatataacatacttgcaagtaatttcagtaaaacaagaccagcatccaaggtataaacttaaacatcgtcattatctacttcaataacggagggagcactactgccatgatcaagctaaaacgagtacaactaactaagtggtggtgattaggaaaagcactgcattgcgttggaattttttttttaaaaaaaatcactgtactgactgggtgatgaatcacgctgcatttccattttctccatttgggtggcagtgagcccatgaagtaaaaaaagtaaatatggttaattagaagaaaacagaggggcaaggtgaaaagcggcagcgcggcgcaccgtcgaccagtggatcgcgtcagcgggtagtggggccccacgtgagcagtgggggcgttgacgtcagcggtacgcgagtgaaggggaggggggggctcgcgttccgagggaatctgagcgctctgttgggcatctgacggctgtcagggggcggtgggtcccacggggggatcgtacccccggatgcgtccaactggagggctttggctttcagtttcagaggggtctgggcgaattgcgtgagtccaaacctctctctctctcttgtttttgtccttcaacatcaaccccaatttactcatagaatttctcgtttttttaatctatactatgtactgtactcctactaccgctatatgaagtggtatatatttattattttattttaatggtgacagagaggatacacgtggacacattactatacacgtaaaccacaaagatttaccatttccatcctataaaaaacctaatacttgtgtgtccaggttcaatgctagaaataatttttttaagggcagagaagtatgactatcgtctatcacaagtgcacgacctgtgtatagatgaagagtaggatcaaatcatgaaccttactaaagtataaaagtaaagcttccgttggctgcgtggttaggggtgtttgattatcggtcacaatttatcacgtttaaatttagatatgtttaatcaacttgacaactgttttgttgtagccacaaaccatataaattaagttccacacatcaaggataaaaaaaagtgtagcttgctaattaaggtatggccaaaaatttgattgtcttaacttagataaacatagcattatttatccgcaaatgatgataaagtatgggcaaaccacttcctctgagtctcatttgtacctttatcttattacttttccttttttattcatttcatttgtttgattattttctagtattctttttcgattatggaatatatggaaaacatatgtgcaccgtctgctagtatccatcaaaacactacccgtgttaccgtgtaatatctttttaacacgcttaaaaaagctatagaggatgaataagagggataaattcgtgaaactcactaagttctcgagtgaaagtaaatataccttatgtgtttggacctcatacaaagatcgtgttttttccacgtctaaaatacttttnnnnnnnnnnnnnnnnnnnnnnnnnnnnnnnnnnnnnnnnnnnnnnnnnnnnnnn

SEQ ID NO: 30505 - DNA, 7757 bp, Oryza sativa
aaaaaaagtgtagcttgctaattaaggtatggccaaaaatttgattgtcttaacttagataaacatagcattatttatccgcaaatgatgataaagtatggttgcaaaccacttcctctgagtctcatttgtacctttatcttattacttttccttttttattcatttcatttgtttgattattttctagtattctttttcgattatggaatatatggaaaacatatgtgcaccgtctgctagtatccatcaaaacactacccgtgttaccgtgtaatatctttttaacacgcttaaaaaagctatagaggatgaataagagggataaattcgtgaaactcactaagttctcgagtgaaagtaaatataccttatgtgtttggacctcatacaaagatcgtgttttttccacgtctctaaaatactttttaactttaaaagaaatattttactgtattgcttattatatcgtttggttaaactatgccaaacaataattgttgttgcatcccggccatgcatgatgggcttgaattaaaaccattatcctctctaccattagtcatatcttcccgtcgtcatcaacaggtagattaattggatctctaaaccttctgaatgttcatctccacacctaaatgatactactatgatagaagtagtctttatattctggaaggtgatttgtactccctccgtcctaaaataaacacagccatgagtttttgtgtctaactttaatcgtccgtcttatttgtttttttcttgaaaaactaaaaaatataagtcatgcataaaatactattcatattttataatctaataacaataaaaatactaatcataaaaaaaaattatataaaacggccgattaaaattggacacgaaaattcatggttgtgtttattttgggacggaggtagtaggtttttactaggtatgtatatgttgcttcagctacacccccttgctgttctctttcacggtacctgattgatatacagagatgatggctggaattaattgtggtggtcatgctcaagcctgtgcttttcactatttgtgatagggaaaacaaacagagaaaatcattactgatccgtgaagaggaaaaaaagtattatttaggctaaaaaaagtaggctcacagatcataatcatgatgacttggatgagatgcttgtgcaattaggcacctccaaaagctggacattcggatggtagatagattgagtgaccccagcaaaatgatcataaatataaagcttccaaatataagtcgaactcacttgcgcacacaccacactcatgtttataaagagattgggcttatccttaccattaaatgcacccacgtgtatatgaaatacttttgaggttaaatctaaaaaaaatacgagcatcagtagaaagtctagaacttcaattaagtagaaaagtttcattacatgaagcttaaaaagatattcactgttgttcatgtcaattcatctgaaagcttatgttcagaaagggaagataagtatatacgagaaagaaacatccaacatgacgactgggttttttacaatgtgaaaaaagaacttttcagaacataacaaaactagtgatgcttggacggttttaacttttacacaggaaaatgattccaagtatatatgacaaaaccgaaaggaaaaactgaaagggtcatgaatggtgtcacatccttggccttgataggcgatgatgccaccatcttcagatagaaacaggttggaaaattcaggagttatgaactcttcttcccatgaaaatctacagtcgtttgattttcaaccgatgaaacaatatcagattttcagtaattcatccttgtgacagcaagttaattctactttcagtcttttcctaactgggttcgcaagctgtataaatcaatggagattctgaatccagctagctaaaacagtgagactggtacaagcagcagcacaaaatacacagatgggagatgggcgtgttgttgcttcagaatgcaggcagacttcgccatcagctgcaactggcaaataccaggcgatggaatggagtggatgtgtgtgaagaggacaaggcaaaccatgtgccctgcaccgcatctcaggcagaatttctaggccagaaacatgcatgtgtttgcttgcttccctggaaatcaaacacaccagaagaatattttttttggaaacacgatacaaacacaaacgctcacatacgtgcgtacacacatcctattcccatgaacacatccaagagattgaaccagtgtgtcttgagatcgatgaagttagcacagatacctcgctccgcctctaatcactaaaagaaaaataagccgtgaatataaacattaatatcaagtctagagtttaaaccgggataggtaaggtctaccataagggacctaactaaatgagctacacttggtaccagaagaatatttttgctagacagtagtacagttgagaactttgctgcactgtcaatttagggtgaaaaagatggcatctttgctgctgtaacaatggggacacgatcacaaggttgatagccacacaccatgtgcagatctctgaagatgatagtgaacagggagaaagaaatcctccccttttttcccctctgcatcaacgtgggaattaagcctgaactcttgttagccaggagttgtagcagcaacttagcaagcactttcgtttcggcacgcgaaccgagacggatcggttttttgtcaaaattgaaaggtgcccaacaatggcatgcctaccaccaaaatctgccgaaatttctgctcggttatatcatatcacgaaaaagttgagaagatgacgtttcatggaatggaagaaagtctgaagaattcctttgcttccagtcactcacagtgcttttctacagaagccacaagaaggtgaccaccacaaccagaaaagtattcagagaaatttgtcaccacaccaggatgctctctgcacagaatcttcaccatgaattgaaccatcttggataggaaaccatcatgcagcctgcctgttggacttggatcctggacagacaaattgacttgtattttcagtttctgaagctcaaattgtgcaaaatctgcatatttagttttcccaattggaagaagggtctctttcaatctgcgccgccgagtcttatcttaatcaaaagaatggctagcatgtaacgccggccatcggatcgttctgaaatcgaggttgagataagctacaatattccgattggccggcggcaaatccatcattcaggccacatcttgcctcaatctgaatcatccccagcaatccaatccccttttctttcatacaagaaagctcatctttttttttctttcatattgcacaaacaagatctatattacatgatgaggaaagccacagggattatactgaaaacacatggaatctacaccctcaagatgcatcacacagaaccctataagataaaaagcttcacactgcaactcaagtactcaactgtgtgcccgaaatgggatcagatcaccccaaggacaggaagcatacagaggaagaagagctttatccctatgaacaacttagctatatacttacaggcaggaagctactgtattctctcagcaagtctttatgatctcaggcttccagctccgccatacaatctgccggcaaccgaatttgaattcttggaaccttctcttcagtgaccccttctttggccgctttgagcccggttcagaaaccgacccatggtagtgcagaggaggctgtggtgtgccggtctcaatgctggccacaatcttctgaaccatctcatacacctcactcatctttgggcgcgactttggtagccggacgagacagcggttcgccacactagccagctttgtcatggacttgaggttgtagtgcccctctagccgtgggtctatgatgatggggaaccgcttgatatcagatatgtatggtttcacccaatccaggagcttctgctcaccctttgggcggttccggtcaatgggacggcggccggtgatgagctcataaaggagcacaccatagccccatatgtcactcttggcagtgaggcgtccggtctgcatgtactccggagctgcatacccaagagttcccacgacctgtgaatttcagatgttagttcagtgaaagaacaaagaagtgaggctttgaaatttagtacagggagaatctacttggaaatttagtgcagggagaatctacttggaaatttagtgcagggagaatctatatattatatcatttgtaatattataaagcatgcttagcatcaacactttaaactgaactttcactacatggtgttggctttttgtaaacgagtgatgggtccattttcccttttattttggttaaatatatgaatgctgcattcctagatgctagtgctttttgactgcttcagaaactatgatacataaatcagagatcaattatgtgtccaaggcaattctacaattggttgtggagcaactgagtgtccaacttcgttggtataaaaaatggatcctgttatagatgtgaaacagaaccaacttactaaatgcacatacaccatcaattatcatcgagattttctttatcttaatttctcttaggtcatcatgcatttttttttcccaatacaccaagttaaagactctgggggcagaaaatccagtcacaatacaaaagtgcaaaatggttctctatttttttaaaaaaaatgtgggcagtgtaaaatggttcttggtatatcaatgcacataccgctgtagagacatgggtcaggccttctgatggtccatgcctagccaatccaaagtcagacaactttgcattccagttctcatctaacagaatgttagatgtttttaggtcacggaagataacctgcatgtatatattaagtttagcaccatagatatagcagacaaaaaaacctaaagaagtgcatctttcaacatttcattgcagataggaagtgatgcaacattgcacaactgtttcaggtacaactggtagcagttttcatcatcagagagcaaaagagttacctgaaattccatctcttcatgcagatacttcagtccccgagcagcgtccagagctacttttagtctcattggccatgatagagttgaatttgacctacttgacaagtgatcatccacgcttccattaggcatgtattcgtatactaggagacgctgtacgcccctttcatcatcttcagcgcagtagccaattagtttgacgaggtttggatgctctacaatcccaagcacattcagttctgttaaccattctttctgcccctgaaaaacatgataatttattagaacccaaattagaggataaggctagattcctgcataagtgacttaaaaaggattcatcaagcaaggtgcacttgagaggaatttcttatgccatgcttgactgtaaattgtcgtgcgggtttcctgaataaagtaatggtttcttttctgaagaaaatagaactggtgactagaaaatgctggtttattttcgctccttttaaatgtgggaaaaaaaacataatgtaagatatgcagtacaagtagaaggaagttgctatgtgcattgaaagcttgtaatcggtacagttcagacgagaaataacttgcctgaagtcctttgcgattcagctgtttaacagcaatctcggtgcgctcagttggttcatcggaattcttgatgacacccctatacacacatccaaacccaccctcaccaaccataagagaccggctaaaattgcgagtggcattcttcagctcagagaaagagaacaccctgaggttactgggccgatcagtgaagctgggatactgtgtcctccgtattgattcggcactcatgtcagagacattcaaggagttgaagtcggagccggaccggacatcccgctccgtcgatgttgtgctcaacgaccggacagaagccgacttgttgacgggatcctcctctttggaatctccatgcaagaaaggcaggcacctcattgctgcaatgcagtgggaacaaattaggagctaattcatgcttcctccatgcaacacaaacacaaatagagaattggaccgagaagatccattaggaatggctgctaactactgtgaattagaacaggtataaaactatcaattactttcttaagtttcctgactaggaaatgctttcccttgcttcaagcaataattttagtactgaaataaggacagaaaaaactttggagcctgaattatgcaaaatgacaccagctaacatgtgtgaagggaagatcttatcatgaactgacaagtatatcaaatctaaaaaaacaagcatttttactgttccaggatccaattacagcaacaatcaacaggaagtaggacaaaaactgggcctttacaccccagggacagaaattgagtgctgagagaattctgtaaatgcaaacatgcctaagctcaagattggggaaaacagcatgacgagggcgaaatagcaccaggcctgatgaaaccatacagtcatacataccgcaactagcgttaattaaaccgaatcatcaaccaaccttaatcctaccaaaactaccgctattcctgacaacaaatcaggaaggaaaaaacatggcaagatgtacgattccaaagtcaaaacactctcgaacgcaaaacgcaacaagaacaagtacagttatcacctaccctagttagcatacatacacaacatctcaaccaaaaaaaaaaagaaaagagatggaaaagaaaagatgataccttgccaatcttgcagaggcgaagatgatccgagaggggaagcaccactccgcctgcgagggatctctttgtgtgtgcgatccaggcaggaagcgacggggaaaggggagagaagaaggcagatgagcacggagatggagatggggggaggtcggaggaggaagaaagacttggacttgggctaagcagcagtcaaagttgggagctttgcctcatattgatttgttttatccctctccctctcatcagtctcaggttctcccctttctctctcacagtcacacacacctactgatatttttttaatatttttttaattttaacttacttatcgttttagtttattagtattagtctaaacctaaggtggtgtttgaatctcctgaatatgaagatgaaaacgtatatgaagattaagtgtttcacgcaaaacgaggtactaataacatgtgattaattgagttttaattattacaaacttgaaaaatggattaatctgatattttggaataacttttatatataaatttttcgcacgaaatacaccgtttagcggtttaaaaagcatgccacgaaaatccaaaatttcatctgtagtggaaacgatcaggacctgtcacacacacctactgaacatttttaaatatatttttaattttaacttacttatcgttttaattagtttattataagtctaaacctaagtcaagtataatttttaactgttaatatttttaaatccactaaaagaaaatagttttattataatttatatgttgttaaactctacggaattttaaaaattaatggacaaaaatagttatgtttgacttaggagaaacttagaatgacaagaaatctaaaacgaaatatcactattaagcagtttgcactcttattctagaaggaataatactag

SEQ ID NO: 30506 - DNA, 7997 bp, Oryza sativa
  unsure (1)..(7997): unsure at all n locations
cttgtgaacaacatggaagcctgaaaggaagaagactggactttagactgatgacctgatgagtgatgacgagcaaagcagaaaattaaactcgattgtttctaaatacagttttttatttttagtatatttctctgttttccaagcattagtttaaattgatcacaattctgtttattttagaattagaaaaacaataactagctttttcgtcggttggtgaggattaggaaagcaaagaagttgcctggctcaccaaacaactaccccaactataataactgcgttttggtgtgcccctttgtccaaaaactcactggagtatacataccgctttaaggttgatatgactagcttcattttttttctcaaaaaaagtgcgcatggtatggcccctatggttctgcttattcgtggaataaaccaaacgatatatctacaaacaaaaaataatttgtgaataaaacttatatatatatatattcttagcgatttaaaagtaaaaactgaaaataaactttgatgaaaaaaaccccaaaatcaacttcaaatataacgttgaaaatttaaattttggctgataagcataagcatgtctcctggcttagaaaaaaaagagaacatgtaaatttcatgatattttcatagaaggaaatttagttcctgtataaacgagcaaactgcatttcaaagagtgctcagtagtaaaaattacagatatttgctactgataaaagaaaaaaagacactcgtgtggatataagaaaaagggaaagcaaaaggggtagagaagaatttaatgggagggagttacgtggcaggtcaggtggttaagaccaatgatgtgttatgcaagagctcacaggcttaacacactttatgttagtatcgtcattttgtagtcacatgcaagataagaccagtatgatgatttcctagataactcttgaacgaacttaatctcctggatcagtgagcatgtgagtgtgacagtgagcatttaactaacctgacactgcatttgcatccatcataggcggttattgtatacttttccgttaaagctgtgtttagttcacgttaaaattagaagtttaattaaaattggaacgatgtgatagaagagttgaaagtttgtgtgtgtagaaaagttttgacgtgatagaaaagttaaaagtttgaagaaaaagttggtaactaaatcaggcctaagaaaaaaacaagaagaaacgaatgacgaggagtaaaatattactggctgtgttgatccgagacattaattcaagagatcaagatgatcaaagcatccatgtgttggtgaagagatgataattgtatatgatcttgttgaatcatgacagatgttggagacttggagtgtaccccactatccgtaatctctgcagtaccttcgcatcatgctgtttctgtaattctgttagcactaattaaactagagattcagagcgcagttgcttatgattgatttaggtcatgttctttttatattatctatcaaattattgtcgtagattatttgttaattccatgcttttaaaaatatatcttcttgaaaaatatttttttatttgtttggtttattatgcataacattgaaccgattcctataatcaactagatcatcgaacactaactaccttaatcttggagggatcgagttgtatagggtatgaagataaccagcatgtggcaaacaagactgtcagattgtgcaattacattgatgatgaaacgtgggtgctaggtacgacccatgcacggtctagttgttaaaatcaaagaaaaatagtaatgatccaacctggctgcccaccgaccatcgtataatcgtagcaacttgcctagcatgttattacgtcgtacgtagtacggactacggagtactacatttgttatattaattccatgaagaaaatgatttcgtagagtacaatgaacagttaactcttaactgtaactgtaactgatgccgttctcttttgtagaaatcagtaatcactcatgatactgaaatggcaagtattcccctcattttttaatatataccatcaacaacattttaacgaaagtttaatcatccgttttattcactcttttttacaaatataaaaaagtttgtcatacttaaataacacttatcacttatcgataaatcaaatcacaataaaataagtaataattatataatattttaataaaataaatggtcaaatatttatcgaaaggtaaatgatagtcgtatattgaaaaacgccgtatattgaaagcgaaggtgttgataacgtagatggtatggaattgagagttgccccttggtggacggcatgcagcttgcaataatcaggtggagatgcatttgaaatgtacagtactccatctattcctaaatataaggtttttttttattggatataacacctgtttgttttagtttaagattattgcaatctaaattattgaggcagaatatcatgagctggattataataaaccaacatagaataagcagtcagctgttgtttctctggattattaattgtttgttagatgttaatcacccaattatcttaaaaagtacatttagagtggattaccagattatagtaatgctatctgtttgttttaacttacttctaataatttagattataataatcctaacctgaattaaaccgggtcttagtataacgaagtaccgtctaaattccgttgtattagaatgtgtcacgtttgggcaaaatcttttatattttaggacgaatagagtataataaataatagtcgtacatgcccctgttttgtgtcaccatctggctgcagttgcagatgatgatccatcatcgtcatccatcagttttgatggcagtgtggaagcggaccatgattaatttgatttattgatcaccaattcgccgtagtgagacggatggcttgactttgacttggactttgacctcatcctcgaagtcggcaagcccatatatgggcccactccatattggtcaatgtctcaatgggccgggcagtctctccacagagccgaagaatccatccaaccatccacgtgtcccttcaaaacatcaggaccgtctacgttgttcactgtgagatttgcagctcttcctttccagtagcaaacttctcgtactttcaggtcaaattgcaggtaacacgactacatagtacagtatgtatacagatgagaaacattcccataataactactccatctgtcccaaaatataagcatttttagacttaaacacggtctccgagatgctactttgaccaacaatatctataaaagtaatatgttttaaataaaaagacttacatattatgataatttgtttaatgataagtctagtaacatcaattttacatgattgatctttttttattaatagttaaagttgaaaatgtttaacttatcactatgctaaaaatgcttatattttgggacagagggagtagtagtttggtcaagagcatcacagaacatgaaactatgacacaaaacctagtacagaatcaggttgtccaccacaatataaaactactagcgtgatatgtggacttagcctcaatgtagtgactttcttgtttcaaagaaaaaagttgtgactttcagcaaggccagtacactgcaatcgcatcataagttcataatcataactaacaagtgtaaaaagttggactacaccttgacaagcgatgacattgagcaaatcgcatcataagttcataatcataactaacaagtgtaaaaagttggactactccaccttgacaagcgatgacattgagcaaaaaacttgtgaacttctgtgagatggaatgtacaatagagcctcttccgttatgccacaggtaatgtacttgagagcagattctttaatatcatatcaagcaactgataatacatatagaggcaccatcagtttcagactagctgataatacataccaaaagaaacatctcgagtttcacttgttgcctcagcgtgaggttgtaaaaagtgaatatcagattacttgttggttcttccctgtgagatttgcatctctttccagtaaacatttcatactttgaaatcaaatggtacttcctccagtaaacatttcccgtaagactttctagcattgtccatattcatttagatgttaataaatctaaacacatatatatgtctagattcattaacagctatatgtatgtgggcaatgctagaaagtcttacattgtgaaacggagggagtagctaacatgacaatatagtgattcaaagggaaacatttccataattagttttgttacttttgtcaagaacatcacaaaactatgacacacagcctagtacataatcgggtcgtgtccactacaataaatttaccaaagccacacggtggacttagccacaaggttgagaattgacaattacactgcaataacatcagaactaacaagtgcaaaaagttggactactccaccttgagaagtcatgatatcgagtaaaaaacttgtggatttccttaggagttaaccttttttaagttgtcttgacccaaagccatactgaagagaaatctattttttatcagaagggcccttatcattagcctgagacccaaccaagtcctcaagagtgaagttaagagtatctgttgagcctttcttcacctcctctccttgttcggctagaaagtcttcgatgcttcctggctccccaaaccagccaagcctatccgcgatcaggtggaaattattgcagccgccgcaacgagcgaccaccactcctttctcatatgattccttgctcgccatcttcatagacctggtctcgcaaaccttgcacgtaaagatcatggcgaggtcgtgtcnnnnnnnnnnnnnnnnnnnnnatgtatctctaactttgaagccggaatccgatgaagggaccgtagctggcacggtgtcggttttggaatcctctatgtcctggttacggtcatctgaagcattattgcttgcttccatgatagtttgcagagatcttatgccagcagtcacaggtgcaggaaacaagaatcctgcaataacagattttcattagttgactgtttaattaattcctattgcaaagatgtaagtaaattcttgtcatacgtaatgatttgaatggtaaatgctttagatatttgccaatctggcaggaactgacaactagcaacaaacagacacaattgactctataatcttatctttattattactactatagttgccaccaagttttttcttcagttcttcaaccatatcaccttaattttaccaaaatcaatcccaaaacagggaatccccttgtttccatatttcaatcttctcatacccccaaacacaagggaaaagggcgcagacgcagtgtaaacaaaatttgactgtagtggcagcagcaaccccggattcgagcctccaaccaccggcctctccaagtaaaacacacatccgcgagagtcatcaccaatatcgactagatttatccatgccgaaccaaaagagggagctaaagcaaaaaaaagtttgggggaatcacctcgggtggacgcgggcgcgggcgattgattcaggacgccggcaaggccgcggcgcaccagaggcagaaaccgagtggccatggcggcgaactgtcgaagcaggagaaggggaagggctggtcgccgccgccgccgcagccgcggggagccttcttcttcttgtcggcgaagaaacggtcgaagagaagaataagagagagaggcaacaagacaaggggagcgtgtgggccttgcttttataattgggccctagttttactttagttgagatgaggcccaatacagcccatccagatttggatctaccaattgttcctcaaactgggccgagcacaaggcagttgtgggccgaccggactatgggcctaggccggattcatagcccaagaggttcttgtcataattgggcctaatgtaacttgaatggaaatttagcccaatatctgatggcgaaccaattcggcccaaactaggatcgctaccattggttactgggcctaggcggtgactggatgactcgctcgttttgcggctcaaattgggccgtaagatctgtaaatggctgcgatcgatagccgtccgttagagagcgaacggcccagatttgtgacatattttgctctcccttcgctgccggagacgtcgtcttctccggcgacagcctccgccgccggccgacatcatcggcaaagaaaacgaggcagaggacgtcgagaaaaaaactttggtagaagcaacggaaaccgatccagcacacgccgaatcgatcgcttcttgcttgatttcatcctgatttgcttctgcgttttccttcatccgtgtgagaactgagaagtcatgcatggaatctgagactggacagcatcaactgcatcacgccattatttgatgcatcttcattaatcgaggaacataaagcaaacagatgctggacatgcagatcttgagcaaagctggaacagctagatcaagaaccaagctgcacatgcatggatcgcatccaaaattcatccatccattcaggccatgccaatcatactgaaccttctagtagtactgcattaatctttttgctagtatttgggtttaatgcagtactactagtactatgcaaattcattttcttttccttcggaatcagttaatatgtttattctatagaaatgaaataagattcagacattcagaatatcaggcaaagcactttgccaccagaaattaacccaaatgctagcaaaaagattattacaagtctttgtagcaaactctgaatgaacttttgtgtagtgatgaagcaagagagaatgagcctggcaagttccttaatttgtacaagtttctctgccacattttttgactgttcacttcagacagtatattggtccttgtaggcgtcctgctgttagtcctccatactaaaccatttgagttgtgtttttgtgcacgtttttgtttgtggattgttgttgactgagatgtattgtagacatttcactctcaattttttttgatcgagcagcacgagacagtgttcactctcagattcgatagtattctagtattatactatgaatagatgacatcttttcagtttcagataacaaattgttcattttctgatgaaatgactgtgaacaatcttagtagaattgtgcaaaattaagagccaggtcctaattaactagctgactccgagaggcggctaagatgaggttgagcaaagcagcacgcaatgttttagagagagtaatcttgcactaccagttcaacataaaaacctgcctctgatgcgtcattgcgtctgtattattttgacctgtgaattactcctaccagctagagtagcatgcttttgttggtgcatccttcggacgaattggccaacatttacatacgaaatggaggatcaaaattaacataattacagagacatcttaatcggatgatcatcactacacggtccaagtgtgaatgctgatgctgtaggagtatcattcacattatgcagaggctggacacagcagagcatgacgaaagaggcgtcgctgtcatatggtggcttaagctgccttctttcctttgtttccatcctgtgacgaggcgaattaaggaggcagaatcatctactctcggagacaaaatcaaagcagaaaagaattgttaattcttctccgctgttctgcttggagtcgtctagtagtagctaattacgcagcacgcatcatcatttgtttgtttaatcaatcgatcttggctcgtggacgatactacatgcagtcacgtcgctgtacaccatgcctgttgtctatagctcgcatgctgtttaattgcatttaccagcacaattaattatcccgatggagtcaaccgatcgatcctttcttaattttctctctattt

SEQ ID NO: 30507 - DNA, 2294 bp, Oryza sativa
  unsure (1)..(2294): unsure at all n locations
cgcatcatcatttgtttgtttaatcaatcgatcttggctcgtggacgatactacatgcagtcacgtcgctgtacaccatgcctgttgtctatagctcgcatgctgtttaattgcatttaccagcacaattaattatcccgatggagtcaaccgatcgatcctttccttaattttctctctattttagtctagatgtgtgcatgcaaatattgggattttttgagagaaactaccctaactgggaagttgttcgtgctgaataattgggagtttttgatcgacttaattaggtactagagatgacagatgacttggtaatattattccacgtagtaatttacatttgcagtgcaacttgaagctagttgcatcataatcgatggatcgtgcatgcgtgcctgccgaagacggcagccagtcggcatcgatcgatcgatcatcaattgggttgaatttcagacagccagaggtcggtcaggtcagaattggatgagccacttgatcgatcacttactcatttctatgctttcagatcgatctagtgcactgcatacataaggcaggcatttttttttcagacagtggatgaagctaggaagaggtccgattaactgaaaaaataatgagtaataataagtatatactaattaactacaccattcattgtattgcaggcaaatgcagttcaacttgtgttccagcaaagatgcaagtgacagtatactactacagtaagcggcagcgcactagtcgtcgtcgttggcccaaagggtcaactagatagctatagggatactgtgattcaattgtctcctcttcagggttcagacgagctagctagtcggtgaaaggaccattgttctactgaaaataagcacacggatcaatagagacggcatatatcccttccttcaaacccgatcaacaagatccatgggatttttcatactttgtttcatttatcatttgttgcaaaagaaaatgatttgtagagattctgaatttaacttgtatgccatagtttacttgcaatacctaataattaaactaatcttttgatgcagatcatatgatgagcctaggcatttaaagatgcacaaaaatcgaaagtttgactaaaagcgtatctaaaacgacaattataccccatgaggagtgtgtttggcttcaaccaagaaaaggtaagcatgtgatttgtgggaatgttgggccctagcacaatatgtttaattccatagcaattaaacatctcgcaaagcacaaaaagatcagtagccgtttagaaaaacaaacagcgaatcaatcactagaaaaaaaaacattatcctcttgtttttcaactggaatgaaccaccaacaaagaaaaaacaacattggcaactatgctctcatgaatgaaattatagttgaaacttatgcactcctacagtcctactccctccgttaggtaataagttcatttttaattccttttatttattccaaaataaattcacttttaaattaatcaatactacatcgaaatttgtaaagtaaagaaataattacattaaaagtagagtagataaagtgatgaatagttacatcttggatttaataaagatgagtattttagtcttttgttgtattagcatgtgtgaaataaataaaaagtaaacttagacctgatttagttcctaactttttttcaaactttcctagacacgtaaacttttaatttttctgtcacatcgttttaatttcaatcaaattttaaattttagcgtgaactaaacacaccactattttggaaggtagcagtgaaaaacaaagattgcaatgcaaaattgcaacatgccaatatccagttgggcacatttgacctgtctctgacctgacaaccctccttgtccatcatcatcttcttcctcccctcccctcccctccctctcatcaagggcaaaggacaaaggcgcaagctttattagctggccgcaattcaactctccacagcagcagccgcctcccgatctgggcggccactagctcaaccaatcaagcaaccaagcaagcgagctcggagctcgtcgcctcgcccatggttaccctctggaagcggaaacccaagcccaatccggagccggaggagaaggagaaggaggaggagaaggatcatcggatgtgcaagaccaagagctccgtcgccaccgccttcatggccgncttcgccttcaccggcaccaacccaagaaagcatcagcatcagcatcagcggtcggcttgcgccacggcaacccagtacttcaccaccttct

SEQ ID NO: 30508 - DNA, 3828 bp, Oryza sativa
cggtgggtggaccggaggctgagggactcgttcccggtggaggcggcggaggcgatgacggcggtggcgctgcggtgcgtggcgagggacgcggcggcgcggccggacatgtcgtgggtcgccgccaaggtgtccaagctcttcctggaggcgcaggattggtccgataagttccgcatccccaccgacatctccatctccatcgctcccaggtgaaggtgaaaccccacccacctcgccggagactcactcaccgcccaccgcacctcgccggagactgactgaccaccgccgcatcgcatgcatcctcacagtaaaaaaaaaagatgcaatttttttttacagtaaaagatgcatttttttttgacagtgtaaaggatgcttttttcttcttttgtggttttgttgttcatcaggcgatgtatatagatagatgttgctgtagttgatgtgcagcgcgattgagatcctcctatgtagatctgtgggtccatatgttagtgacaacggtacggtgcagtcgactgcagaggatcgtgatcctcacttctagtacaaatttatttattagtactgttaatgtaggagatttagcctaacagtggttgacacgatgtgattgtgagtgaggtaggaattgttaggcgaaaatgcaatcacacatgctaacatttgaaacagagcctgatgatttctggatgtacatatatactatgcgtgaatggaacatagcagtcaattggatgatgaatacttaaaatctaaactcgaaaactatcaatgtcatgaaaccaattttcctatagtttttaatggtgcccgtagaaagttttaaagacttgcaattgcatccttttttccagcgtttgatgtggacgtgtctggtaaatctggttttgaattcttcgtcgttccaacggagagaaatttgcgttgcctcctgatcatccatccctctttgatagtgcgcgtgtcgtaacaacgaatctgattctcatctcgagcaagatttttatttttctttttccgcttgcttgtcatatccacagttcatgatctcgtccagcgaacatattctgacgctttaacaacgatcgaatattagactgaagtggtaaaaggttgagaataataataataactcttactccatccgttttacaatgtaagtcattctagcatttcccatatttatattgttgttaatgaatctagacatatatatctaaatagattcattaacatcaatacaaatgtagaaaatactagaatgacttacattatgaaacagaggaagtataaaggaaggatcacaattcagcccatgctatcctctcctttttcattttaatcgatccaaaggcaagcactttgaaaccttaaactgagctttacaacgcatagaatcaaacattcattctgattagctcagatgagacgtcaggttatcagatcaacgcaataagaaacaacagtttccacaagaagaacccaccgattcttcaaccaccgaaagcacagatgcaagcagacacaagaggataaaaagggcagaaaaattcagtaatagcaggttcaatgggactacctcttgggatataactatgttagcactggtgctcactggatggaaatttggttcaaaagcattcgattctagctatttttattggagtccttctgtctgaacttttctgaatttaggggggaggacgggagaacagttttcattcacatcctctcatatgataagagatccgcatggtaaaaccaataatacattacaacaagtgttaatccaacatgaacgatgatgtacagttccatcggctggaaagttgtacacatttctatctgcttcgctgtttatggacccgagctgtaggcgaaaatgccggttagtcgcagccgctgtagaagacatgcgccagcagatcagatcacagctttgctcatcgtcaccaccctctcagtgactaatcaaacaggggagaaatggaggttagatacatttcagcattagtgtcattcatttattcaagaatatattgttgatatttcaagaatgtagataattctaatgtaatgcagaattatgctcttgtactagttttttacatctgatctagcctcaaaaagtggacctgtacttacctaaccaacttcctatctttgtattgatactgccacgcgcgcttagtgggggacaaaacaaagtaggtcaaaggcaatagggtgtaacatcagatatgggttgaactgttctgtgaggtcaatgtctaacaccaacttcgtcctctatgattacaacatgcattgccatggcatacactggaaatgtaatctatcgaggaagaaatcgaattgtctgaatgtattatatagcaacctcgtgaatttttcatacaaccagaaacaaataggatatcaccaaaaatggttggcgtgcgaatttcaattgtaagagctaataattagtattgctgagcattgtatttctatggcaatttaatcagagtggaagtcaaattgttggtaaagtaggcagttgcaggagataagcttaagcacacaatcacctcagccaactgaaacctgccacttcattctgttaaaaaaaagagcaataagtgccctaacttctggaattatcaagtgcacaggaattcctgagcaggtttggtggtcagacaagtgctcagttaataatattacattgagtgcaaatctttctttaaaatgttccatgaacgtcacgctaccagttcaaatcattttcacattttttaaaaaatatgaaaataaatcgaaacggaacaactatacagagcaacagtggcatgtagagagcaaatatcagcatgtcccttttttttggaagggacactgcagggaatcgctatatattgtataaataataaaaatatctgtcacttgcatactactagttatgcataccttgaagccggatttggaattcgtggaaccacccaacattttcctcgctggttttagtatttgaaaagagcacatcagtgtatcatctacactcatcatggcaccagcattatcaaattctccacagtaattaggggccgagaatattgttacaagttggcggttagcaaagaactcgtacccatcttcgacaacctgaattccaacaaggcaagaataactgataaatcaattcacttggtaagaaaaataaaaaggtcaggtaattgtgagcatggggcacctgatgggctcgacagatgaggtctaaatcatgcttctcaagaaattcagacactttgtctggcccgaatgtatatgagacacctcgatcattcatagcccacccttgtgcgtcattggatggatcggaccaaaggagatcacaaagtaacccagtatcaggcacatccgtggggcggttgaggttgagtatttgatccagcttattcaactctggagaaagacctccgtgcatacaaagaatcttttcatctatcaatgctgccactggtaagcagttaaaacagtcagtaaaagtcttccagagttttacactgaatctgcgcttgcactcgtcataaaatccatagatgcggttgaccgatgcacattcatggttgcctctgagtaggaagaagttttcagggtacttgatcttataagccaaaagaaggcatatcgtctcaaggctttgctttccccggtccacataatcgcccaagaagagatagttggactgaggtggatacccaccataatcaaacagcctcaggagatcagaatactgtccatgaacatcacctgatcagaagaaattatgcaagatta

SEQ ID NO: 30509 - DNA, 12575 bp, Oryza sativa
atatcaggctggtgtacccagaccgccagatattgagatacattaaatgtgattgtatcaggtatgatcaattcaccataaactatagcggtcaaaagtttcctagtagcagcttgaaagtctatctttgatctttctatcaacaaatcgcctcacaaaatagcagctttcaatcagcaaatatagtcggtatggttcagttgtactgaaccactgagaaatctagatataaccatcgtctgcctcacggagtataagctttctatgagcaaacatatagtcggaaatactgaatcacatgattcattaggaagtatgtggtaaacctctgttcgagtcgataaccggatcatcaagcgacaaaacacctaaaaagctggataatatctggctatcaatcaaaagatcgggtatagtacattaagcaagtgcatccaaacagcacgacgcagtcacttgctacccgttgaccaaccaagcaaatccccaagatgacattttcgagggcagccaacatcaaagatattgctcacgcgtgacaagaaacagggaaattaccgcagattttgatgggggcctcgagctcgagcaggttgggctgattcaggaagatctccttggaggttgcgcagagctgcttaatctccgactccgaaagctgcgcgttcttccccggcttcagattcttcacctcgataagcctccggatgatgtcgtccagcaacaccggatccatccccttctctccaagttcttgaactctcctccctctcctctcgaaacttctcaaaaacgcacgagcagtaacagttaagaaaaaagaacagacttcacagcaagaaactcgagcagagatcgaagaaaaatcttgcttgctttgctctccgtaagaggggattggagaaggctgaggcggcctctcgttttgcgaccagtgtgtatttgggggggagggagagatgaaaggtagtaccttttcttggtcttcttctcctcctcctttatcccctaatgttctaggatgctctcttgttcttgttcttggagatggaggagattgtttggtgggtttttggaggggattcggattggattttttgcttgggctctctgatttcttgttcttggcattggtatgggtctctctctctttctctctcctgcctgtgccaattccccaaagacttgtattggactttggaataaaagcataagctttttttgtatcaaaccccctgagtattagacatactatgtatgggtccttgctccttggttggagattttaggaacatttttgtggggttacttctatttctctttcctttcattttctcccttgtacatctgactcttttttgttgttgtttttatgcactctgaattttgtttgtttgtatgaaaagtgtggatgtttttggatggatggaagatggccaaagggcagagtaagtgcaatgctgatatttgtagttgtagaaaaaaatagcattggaagtatttatgagttggggagactttttcttacttcctttcactgcatttgtcatatcaaaaatggtgattgtaaccgtaataatggcgtgagcttcacacggattggtacaaaattcatgactgtgtgttttctaccgtactaattgttgaagatcataaaaacaacatgtttatcttcaaaagataaatacaacatgtaccaacaaatgaacttatttctacgctcctggatattcatcgagaaaatacgcgcatagtacaaaatttgtttccacaagacaacgtgtggcgattaagaaaaaaaactagagtcaaataaatacaacatgtaccaacaaataatcgaagctcactttatagagtgtcaaattataggatctttccttaaactagtaggcgagctagcattataatactgctaaactgtgaatcaactgttgttttctacctaccacagtgaacacagtgattaaattagctcacatttgcacttatccaatcctagtaagtagtgacatttgttactatgtcgctaacccagtgatgagtgaaccaaatcactctttcagtgatgcaagctttgggtttccatgcttcctgatgttgtctttggacacttttgatttacctaatctcttggtgctttcaacaacaagtaggtgcttactgatcatggcgcacaatatgcataggtagaatccaatagaattttgggtggtggatggcggcttcctccttgtcatccacccttcctttggaatctttcagacaagaggacgatcagcttgccatggaaaagtcctgtcagtgaatggcccccactgatcattggctgcagtgaactgaatggttaaaccttttttttttaattaaggaggcccagggtattatgtaccggattattgcgtgaattatctacttaggtatagagataaattaaacctttttttttaaaaaagaacttaacaaataggtctaaaatactacctccattccaaaatgtttgacgctgttgactttttaaaaaatatttgaccgttcgtcttattcaaaaaatttaagtaattattaatttttttctatcatttaatttattgttaaatatacttttatgtatacatatagttttacacatatcataaaagtttttgaataaaatgaacggtcaaacatgtttaaaaaagtcaacggtgtcaaacatttagggaaggagggagtaagtggtactccctccgtagttataagatgttttgactttggttaaagtcaaataactttaaatttaactaaacttatagacaaatatagtaatatttataatatcaaattagtttcattaaatcaataattgaatatattttcataataaatttgtcttgtgttgaaaatattattattattttctacaaacttagttaagtttgaagcagtttgactttgattaaagtcaaaacgttttataacgtgaaacggatggattattaagtattaacaacgtagtagaagagagtttaagcgtacaacaaataatctagtgaaaaaatagttgagattagcggcaccagcgtcgtcaaagctggctgctcaatttcagaagagtcttctcctgtcttcgcatggattcagacgatatctatgcatactaatcatgcgaaggtcattgacacgggtttcattcttcagaaacacgagcagaacgcgaaagtaatgtgatttttagtttattactgtgtgctgagacagcgtggtttctgtagatttcaaggagtttagaggatgcatctgctaatataattttctgcagttaaggagtagctggctgatctgcacgcatgtatattgcttccggcccagatgcttaatcccaattcgctgctctgacattttactaatcccttcgttgttggtgacaaccaactggctatatatatgcatgattctatctggattctcttcatattcttataataatgttgagtcctcattatattagtgaccctgctctgcaaaatgtaagcagaatatatatgatcgtggcaagaagtaaatcgtccaaatagattaatggatgcatcatgcatgagtggatcgaaggaaaattatatgtgcatctacctcttcttctgaagaaggcaaaatcttgtagcgtatttgattgtttaagcaaagtgaccaggccaagtcccaaatctgaagaaaaatataccatcatccagaatcagatcagaaaaactatacgtatcgaataaaccatagtgtaaaaatatagttttattttccttggagaatatgaaattcatgactaatgccaccgaaaagtagtatactactttgcctgcaataccattgagcccactgaacaaatcaagaatcgatatttttttaagacaaaatagaagtcagagtatgatgtgagatcacacatgttctcaataccacgacaaaaaagtggatattttccagctgtacttcaaagtccccgaactgaaagatgcatctgctcactgtcgcaaataaaattcagagatcgacaaaacatcccaagctaagctggaggaagctgatcaggagatggcagaaactctgtccaatataagcaaccaccaatcagtagcttggcgaatgcttcatcttcacatagcacaagctgccatgtagtcttctctgcgatccatgcaaggcagatgcaaggcagcggcggcaatggcagaagttgatctcagtggagaggaagacgacggcaagattgcccggcaaaggccctatttagtttccaacttttttcttcgaacttctaacttttccgtcacatcgaactttcatacacacaaacttctaacttttctatcacatcgttctaattttttcaaacttccaattttgtcgtggatctaaacatagccaaaattggaagacaacgacaagattgcccggcaaaattaatggtcaatggaggcaaggccggagggagttgggttggtttctttcaggtgcgtctgatcttagatcttcagtaacttggttttagtgctagtcactgtccgatgatctgaaggagattatacgcaaccagtttcaactaatatcatgaactggccattatttctcctgatccttcttggatgcaaaatcaaaggttgcttgtctgaatttgaactccaattgagcatcacgcatcaattcatgaatatattcattcttgcttgatcctgattctgatcatccgtagcaactggcgcaacatgaagtgcagactgctttactatcaaccattcttttagataaggaagctttttcttaaaaaaaaactcagacaattacatcaatatgatagaaccgtgctgagatctcttatagcctctgcataactgaggtgcataactgatgcacacaaacacacataataaacgtttattacaaatgaagaagcaggaaatgcggaccatcaatcctcagactacattgccaccaatatcccttggtaaaaacagtttctgaccacctgcagactatcaaccatggcgctctactccaccgacagcaagaaggttccacgagcaagacaagagaagcttcagttctctagtactggagagacgtagtgccctcaagctctcctgcttcccattcttggagctgcaaatgtcgtgttgcaagagtactactctagtgatgatgaactggaagacagcaacgtccgaacaacagcaagagcaacaggtggaccactactgcacaagcatattgtaccttcagctgaatcagaaccaaaatctcccggccacgcatcctacaaatctgtaaatcagcgatcgcgatgtgcaccggaactcgcagtctgaaaacaacatctcagtttatatcatcgaagcctgaattcctgcatcatctgttcgtccgtttcctgatgcaaacaaagttcaggcatcagagggtgtagtacatatttggcagcatcttgttgattactagtgcttgttggacttgtgtctggttcatttatgcataattagaccttatctgggtcttaacctaaatggagacatggagtacacaccataattgaagtattgagtcacacataattgaacgaaggtggcctgaaatgtacagattcttatgtaaagcagcagcagacaggggatgttaagtcagtccttcagtcagtcagtcaccgtgccccagacgaaaaggaatgcacgtactgacaagaccaaaagcaagcaagcgtcagattagttgactagcaagctactcctagtacaggttagacaagaaacagaccaagaaagaaattaccactactaaagcctaacagtacaaggaagcagcaagcgtaggccggccgggaacaccggcggcgtgcggcatccgtcgcactcgcacatgaaaaaaaagggggaagcaaaagctcacctccaaagccgcgttcctgtcactcggccacacttcaatcgcatccaaaacatcaagccgccatcaccaccagtgccgtgatcatcatacacagcatctccatctctgcagggagtgtgtgcaaacctgcaagctgctgcaaattaaggatagctgtgtgctgacagttcattttccttgtgttgtgctgttgtgcaagcaactattgctcctactgctgctgtcctgctcttgctcttgctctgcaggttgggtttctttccttcctcaatttctttcacaactccactgcattttccaacctgatcgggtgctgccttttcattcttccctcctacctcgttggccactacattgagcatcaccatttggtctcaccattcatacctgaaaaccagtatatatgttgcatcagcagcatcatcaaacctggtctatctagctcagtagctcacctgcttgtgtgcttaagctcgtgtttgcagcaaaccatggatgcagacagggaccccatcttcccggtgcaacagatgccatcactgctgttcccgccaccgccgccacggccattggcactcgactccacttcttcagcatcttcttcttttgtgcctcaccatccatccatcacgagcttcccaatactggtgctcaccgtcctgggcatcctcaccacctccgtcctcctgctcacctactacatctttgtcatccgctgctgcctcaactggaacagcagcagctcctccgacacgcggacggctggcctcatctcccgccgtcgacgcggtgccgcctccagcagcctcccggcagtggccgagccgcgtgggctggaggaggcggccatccaatcattgccggcgttcaggtacaggaaggccatcaaggacactactgctgattccagcgagtgtgcagtgtgtatcagtgagttccaagaagaggagagggtcaggctcctgcccagctgcctccatgtcttccatgttgactgcatcgacacttggctccagggcaacgccaactgtccactctgcagggcagccatagccaccaacgacagccagcttccattggatcagttcgtgagacctgaggtggtagtcattcaggtgatcactggcgcggaagaagaaggtgcacaagcaccacagcaggaggccaatacggcagcttctgatcctgcagtagatgctactagtacaaatcaacaggtcagtagtaagaagacgaagaaccagaatgcatggcatgtcagcatcagtaagggagatgagtgcattgcagtgaggagggacagaaatgttcttccattgaggaggtccttctccatggactcactgggtggtgctggagaggtgcatttgcagattcagaatattctgcagaggagcacccacttccacagggatatcagtgacagcagcagcagcagcactggaacattgtagggattactatgcctgcacattctatggccatgttctatgcgaattcttttggtggtcttgttcaccaatttttcttttctttttctgcaaaatgcaatattacatgtcaatttttctctaatggacacctataacatggtttgtgtgtgtccgaaattccagacttcagacagtagaatggcaagttctttctgtgaaacattcgtgcaaaacaatgtaagttgctcctactgctactgtattttccagctcctctgaatctgcccaagcttcctcttcaggcactgatacatgcatgtgatccccaaatgatcatatacgatatggtgagtcaaattcaacaatgagaaagggaaggagcgagaatatgccaaataaatatataaataaataaatcaagttttgaattgttaaataactagtgaaagtactcagaagaaagcgaatcagctgatgacaggataaatgtgttaccaatcctagaaggtgtaacttcaggcagtcaggcaaaacaaaagaaaataaaaacatgaactgaatggggaaaggtagacacctttcaaaactctgtaatccaatgtctcaccaaaaccttcttataataatctaacattgaaatctgtgtcttagatgacatcatagcttgacaaatcagattttccttgtcgcaggaaaatgtcagttcaccaaccattgaaaaggtcatattatatatctctaaaaggttcctgtcatgctgaaaaggtgtgtttctgattacttttgatatactgttaggtcttctaagtggcacaaaaggatgtcagtgcgtaacaagtcaataaggatcatacaataggtagtttcacagccaaaatttcttgtactactaaacaacatatcataatcatatattgatagaaaaactgatgcgtacaatactttgaaattattgttgagcaactctggtagaatcagaatcaacctccttttccagaggttcaggcaatgcaattgctgaattttcaggcgataggcatgaaagagcctttatctttatctgctcatagagacgaatagcttccttgagctcgtccctagcactgggaccatggtttcgccaagaatccaccactcgcttttggaactccatagccagagcatagctgcatttgaggcaaaatgatttttttttcattagagagaagcgcatagtacttcatacattaatacagcatgtggaaagagctttcttagtttccttaatttttcccattcaaaaaatatcaatctagtctattttggagaagcagatctgaatagtgtgcttacaatatcagccagccattatgttgcgtgcgtacttaatgcatatgaaacaaagcaatcagtaatttccctttccctctaatgatgtaatgcgagtatgcaacagtatgcagggagcacaattacatactctgtaatttcaaacgcagtagcataccatgtataaaaagcatttcttgcaataattgcaaaaatgcaacatatggtcatcctgaaaactagctaaagaacaagcattgcaaaaacaaactagcttgataggtaacatgcagattattgtagctcatttaatcttctgcctggttatattagacatgatactagcaaatatcagaattgtttcatccaaaatttgtctgttcagtattttttttgtaacattttttatgtgtctttgaatgaatggaatgaagttgtgaaatcataccttcccattgcgttgtatgcattggcaaggctctggcaggcctctatggtatctgaatggtgcggccccaaggaaacatccatgacttcctttgcaagcgcaaacatctgcgcagcagactgtggtcggccgatctccatatatgcagcccccaaattgttatacacataccctaccccgtaatgctttggtccaaagctgtccttcatcctctccactgcatcctccaagtatgggacagcctccgacaccttccctgtcagaagcaatagccacccaatccgagccgcaacattcccttccatgtgttgtgcctgaggtatcctctcaagcatccccaagctcctcttcagcaatgatatcgctttgtcaaactcattcaccatctcatacagtgaggatacctccacatatgcttcggccaccttgtctggtgcagccaattccttcttctccagtatgtcacaagcaatctccaagcacctctttgtatcaccggccttctcctggttagcaagagcctttgccatagatataaacactagagctcgtatctcgctatccttctccacctgcttagagacattcctcaacacagtaacggcctcgtcgcacttgcccaaagcgatcttgatgttcgccgcatcaatctccgcgtgcaggagctcgtcgccagccacgccccagctcttcatcaccttctgtgacatctcattctgctgcagggcctgctcatgctgctccaggccggtgtatatcaccccaagcagccgcctatcatgcgcaacctccaccgaatttttgcctagcgtcgactgatgcagttcgagcgccttctcgcacaatgggagcgcctctttgaaatctagcacggtggagtacgcctccgcaaggtcccggtacgcggcgccgagctcccggctacccggcggcaggatggactccttgaggtcaaggcacgcacgcatgtcagctagggcctcctcccgccgccccagcgccgtcttcacgttggccagctgcaggcgcaccgcgtgcgccacgggcctcacgtcgaacccttgagcgtcgtcgtcaccagaggcggcggcggcggaggaggaggaggggaggagtggggagacgaggcggagggagcgggtgaggaaggagagtgcgtcgtggaagcgggagaggtcgaaggaggcggagccggcgaggtggagggccatggcgagcgagacggcatcggagtgggaggccgtcgtcgaggtggcggagttaggggtggcctcgaggatgccgagggatcggagggcgagggcgaggacgcgggaggggtcggcagcgccggaggcctcgaggtgctggccgagcttgatgcaggcgagggcgaggcgcttgtcggagggcggcatgacggcctcgaggcgggagaaggcggcgagcaggtccttggtccccttcgccgcctcgaaggcctcctccgcctcctccgcaacggccgcggcggcggcggccgcggaggcggggactggaggcggcgggagctgggagaagtggcggcggggcgggaggaggagagggtttggggttttgggtgtggggatcggaacgggagctcggagccgtggccggaggaggagggaggcggctcggcgtagagccatggcgagccggcgatctattggaagttcgcggcggcggcggtggtggcggctaccggcggcgagggagggagagggtggtttacgtggatgagaggagagtgtgaagggttggagatttgatgggccttaggtttagttatatgggcctaaattccggcccaactatatgaggccttgatgatctagtgggggtttttgggctacttgttcggaggcgtggattggcctaaatctaggcccaaccgaaagaggccgtgatgatctagtgggatgcttgttgggctgggcttacccactctgctagccaggagaccagtgagactgtgagagtacttctctcctttcatttttcaaaaaaatattttttttctctactcttgttttattattttctatttttctatgctgtttttctatagatggtaacttgtacttctatgttattaaaaatatctgcgatggaaggagaaaatgagatgtgatgatattggcatctcttagctgggcagcaccactgaaagctcgaagtcatgcatgatgatgcgtacgtgaaggctgaagcgaacgaactttgacaaaaacacaacctttccagccaattgtggttgcctaacctgaacatgacgtgctctattgacaacaacgaccatctgtccatggctcactggccactgcaactagttgctaaattggagtagcaatattaagcaaaaaagataatgtcattttacatccaatgataatgggctggatgccattttacacgctgctgaaatttaacctgaacaaactgatatatggttgtgagttgtgaacattagtatcaggaaatggatggttgaactaaccgatgaagtggacaaagcaaactctgccgaatcgatcaaaggtcaatactcaataccgaagaacattctgagaattttcatttcagcaccagatttactcggttaaacaatacacattcctcaccaaaccatcgtttctctcgtgtctccatcgccgtcggtaaattcagcacaagctcactattaatgcttaaaagcaaaaaggagattcagatgcagtatacagccgaatattcagtgtcttttttataacagaagttgatcgaagcaggccttatcctgctccatctctgaaaaaaatgtagaatagattacagcttatctgattatttcatagattgacaattgcaaattcacaatcgcttatgtgatcgatcaacgattgcaatccaacagctagcattacagaatcacatccaaactgaacaaattctgaactctgcaacaattcgtagcagcaagaaagcaagaaatgcaacaagctgttcgtcactcacagctgcttcagtccgtcggcgaagcatgagctgaaccgcgccatgtcggcctccggcagcgccacgccaatctcgatgccgccgtggccgtcgcgcgcctccgccatggacaccgtgccgggcgtcttgtcgatggacaggagctccaccttcgccggccggcccagcccgaagtcggtgtcgtacacgccgtaccgcggcgagccgccgatggacatcggccggtgcggcatcagcgacacgatcttctggaaccacccgtcggcgccgtccagcacgccgtcgtcgagccccctgatggccgcgccgatggccaccgccgccgtcaccacgccgtcggcgccgctgccgagcaggccggccgtgtcgacctccacgaagcaagggcggaggcagttgccgaggtactcctgcggcaccggcggggtcaggcggcggcggcattccaccgagaacagcaggtgcgcgcgctccctggc

SEQ ID NO: 30510 - DNA, 6980 bp, Oryza sativa
gcggcggcggcggcacagcatcgacgtccccaccggaagccacccggcaattggccgcccaggtcttgacgaagtgcatgaagctggaatcgtcgcaggccacatggtggatggacacgccgacggcgagccccttcccggggaaaaccgtcacctgcaccgccgcgagctcggagctcccctcctccgggcgcgggagccgcggcaccagagagtacagcctcccaacatccatcgggccgccgccggcgagctcctcgaagtcgtcgccgctctcggcgacggtgagctcgacgcggtcggcatccccacccgtggagcagaactcgtaccctccgcctccgccgccgctagaacacggccggacgcggccaagaagcgggtagaagcggtgcagcgcggcggagagcgaggaggcgagggaggggaggaggtgggcggcgaggtgttcgacggcgtgcgggtaggtgtagaggaagacgcgctccaccgggccggtgaagatccacggcacgtcgaagaaggtcagcgggagcacgccgccgtccgccggaggggaggccgccaccgtcagcttgtcgacaaccttggtcgccatgacaatttgccgctgcttcttcttcccctgcagagaattcttggtagaagagatcaagaggagaggtgggcgaagatgagaattcgtgagatttggggaggaatcaggattttttttttcagatccaccaaacgcatggcactggtggttgcaagtgtggcagaaaaatgctctctttgtcactctctattctttattgccatcatgttagatccttttcctttcctactgctttctgatcgaagttggaggaggttcctactactatccaatagcacaagaaaacattgtcagtgaatactgcagaaacagttaaagaagcattatttatcagtaaaaagcattatttgatccagtgaagaaaaagtgatggcaatctggagcctgtgtacactggaaatgagctcatcagatgaaatcaatgacaaaatgttaatctttatactctgactttgcagttgtaacttgcaagtcttttttttttcaaggttccacttaatcacatcggtagtataactgattatccggactgggatccacacaaaagcaggaaaattaggaagagttaggtatgcgattaaaaaaaagttggcaaattagtgtcggcgcatctgcctaccaagtattatcaagggatgatatctttggcattggaagtcacctctttgattctctaatctggaccgcgcacaaaagtttcaagaaaaacaagtatctcaaacttgtctgctgatcacataatattgaagaagtaagacggatggaaatactagctcttaaccttgactgcacactgaaaacctgtaagaaaatactaccagatgggcgtatatgatagcaaccaactgattcagtcaatggccatcagttcctcggagtgaaaaaatgcaatgtttagtcaactgcctaatggaaattcaggcaataaccatgttcataaacagtatgatcagacaactagccaaacagcaacaacaggtataataataagcttataacatcaaaacgcaatttttaccttctgctttccttgataacagatgcagcaataaagatgatttaagctgacataagaacttatttttccgccttaaagtgggcttgcacgttttaggcctaatccgattacatttgggccttaatggtctttcacttcttggaccaaagcctattacatttttgcttacaccacggcaaggcattctcttttttagggcttaaacgttttatacaacacttcagtaaagtactccgtactccaatattatttgcagtcaataaaactattattccaattaacaacatagcaagctcttcaagtggagttaaattaatttttaaaaaagattgaactgaaatgatggagaggcgccacaagcacaatttccaaggcatctgcttgatcagattccatttcattcctctcttttacaactttttttttgtgtgtccaagcacaacagacattggcttgggagatgatggatagggccaaagtttagcatattttgactcctccaattgctacatcttcatgccaaagaccatcctaatcctcttttcatccaagactgcaagtctgcaacaaagcaactcaacacacaatgcaagcactagttttcccttttcattttggtttctttatggttagggattagtgctaaagcagctgcttgattagtggggtctaatctaattactctcaagtgccataattggcatgctttagttttatgcacaactttgtttgaccaatgaccagcttcttgaccagttcaatcaaacaaacacaacaatgcttatggagtacatatatatatgtgatggaaagactacaaaaaacacaaaggaccaaggcaaagaaaaataatgaaatttccttcaactttaacagacaacccttgcatatttaaatgtctgtttctcgggccattgaccaataaaccaggcaattaaatatggcaaacattttgttttctctggtttgcaaagaacacaaagaaacaagaactgaacttgtgaggtgaagctagtgattccaaggcactgataagaacaaaacttgagctagtgctagggccatctaatcgctgattactgaccagtacttagtatcctaggctacctaaccatgtgtgtgtagatcatcttatacattacccacattaatcacgcgttaaatctacggctttgctccaatcgataaagacgagtgatcacaaaagtcactggcctataccaattattaattcaactgcgtttgcttgcatttgtgttcagtcagatgcattcttcttcaggttgtagcagcgccctaaattaactaaacaatgagcttctatatgtgcagggttttgtttgcttgcagcagtatttgatgaccttttcttagataattttaagtgtttgatgacctgacaggttagctgctcattggctagatattgctattagcttctagtatcttctgaccttaactttttagccttttgtaatggattcagtgaacatgtctgaattaaattgcagagtcccaagatgctagtacttctacaaacctactagtagtactgttcttatctgatcactaaattaaacaaacatgtactattaatatactagtgtatttctgtctcaattattgcaatgggattgccatcccacaggattactggtactatactggaattaacatttcttcagttctttcaaaatggcagtgtgattagtgctaagttctatttgatttaacctatctagcatagcaacatggatgtattatagcaggattaactagttgcatgcagtagttaactttggtcaaccatcaaagcacactcaattttgcaaagtaattaatcaaccattgggatcaggacctttcaccgtgtatctgttcatgtgcatgcgtgctaaggtcaacatttaagtagaacatactccagtaattaaaattggaacggaaagtaaacggtggtagctgcggctgatgagttcatacttgcccttaatcaaggggacaatccttatgcatggcatgaaaaaaaactaggattatcagcagcagtctaggacatatatatatatatatacaaaatgattttagggtctctagagaagaaaaacttggtggcaactcaaagttatgtgataaatgtttcttcaactttcggcactctcaagttatattactaacttctagtagcatagtttctcataaaaaaaaaacaaaatttataattattttcagtttacttcgaccgttacaatagtaatatttctccttaaaagaaggcgattgttgatgggagtgtttctgcaacaagggacatgaacacctttttgcacatcaaccatggctgagaaacattttaaatcttatcaagaacatgttggacaggacatgaagtagtgagaatctgcttccataacaagaacaatataggacttgagaagtttctggctcatgcagtagtaacaataatgtctcttaaaaaaagacacttgctgatgctggctgcacatatatgtttctgcagcaagacacatgatcgccttttatactgaaatcaggagaatgtctctaaatcttatatgaaacaagttgaactggaaattattataaaaactagggatagatcagaaaatttttaatgcagttttacactagttcatcgcctgagacacatatgaaatgacacacatagatactgaattcagaaccttgtttcatctgtctcgatttaacctagctaaacactcaaacaaattttggaaataagaagattgcaccaactaggtcagcaagattatacttggacatgcatgcatggccagggtccagtgatgtgtgatgtcattaccaagaccttgttgcaagaagctattagtgttatttagtagtactacgtactaatcatcatcatgaagcagactaattgcttcactatgacgttgcactgataaaaaagttcagtagtacacaggctaaatttttgcttgtccactctctaactcctgcatgcaaagcgttgcattgtttgatttttctttctactgagagtagttggaggttgatctcatcatcgcctgggccagatactggagctcgccggcgtccaccgccttggagcaatgctgctgcatctgcacggcggcgacgtcgtccttgaagccggccgccatgagctccggcagcagcgcgccgccgccgccgaagcagtcgtcgagggcgccgccgggcggccttctcgccatgtcctgccggagtagcgcgctgatgctgccgctgtccggccagctcaccggagagtgcgagctgctctggatgccgcacgccagctgcgccctcgcctgcatcagctgcgcttgcaggatcgcgacctgtatgtagcatcgatcgaatcagtcacaaatccgagaggcgatcgatcgatcgatcgagcagcgacgagatcatctcattctcatccatgaaatgaaatagtacctgctgctggagggcgaagatttgggcgacgcagccatagacggggtcgcggagcctggcctgggcctcgtaggtgatggtgacgacggcctcgcagcggtcggcgacggggaggtgggagaggagcttggaggcgttgctggcgccgaacaccttgtggatcgccgcgaacctcgccgccccttgctccgagctgaagtagggcgcgaacacgcactccggcacgcaccgccgccgcaagaacttgcacgcgccgcacggcgacccggctcccgtccccgccgcggcagcggcagcgccggcagccgtagcaccagccataccgatcaagatcgagcaagaaaatgaatcgatcactctagctacgtgtgcttctctccaagtgtagtgtgtggtgtagtgtagtgtaggtaggttagctgctagtagcggtgcaacttgagatggaggaggtggatttataagaggaggaaggagaggagaggaggaagaagagaggaggacaggtagggtagggtgtctggttcgaggggagcaaacgtgttaatgctgcgttgaataagaaggccaacgtcctctgccttactacgactcacttgctaattaacctgcagcttaaactaatcaattctactactgtatatatatcaccttcagaaaaaagaaagaaatattagtgtacaacatggccatgtgatttgtatagtcttccttaattgatcagttgtcatggagcagataatgactatatatataaataatattggtacgtatgtactagtaatataatctgatcttcattgaaaatatgcagaaacggtccagtttaatttctacactttgcttaccaccaacatcttcatgaacattgaagtttaatttgcaggtgaaagataatcactagaatgaacatatcctatatatgccctcagaaaggatactagctagctagattaattgccgtggaatacttatactgaaccttgataatttttcagtagtactgttggatttgtccagtacaagaatgagaaggaaataaaaaacttactccctttgttctgttataattgtagagcctgttcactttgatgtcaaaaaaaaaccttatcaaatttttgcattaccaaaattttggcatagcaggatttcttatatagttaccaaaatttgacagcaaactaaatgtagccactttttttgcgactttacctaaatttgataagattgaaaatggcatcaaagtgaacaggcccgtagtttagttgtgggtttctatgttatacgtttgactattcgttttatttaatttattttatgaatagtattttattgttattagataaaaaatgaatagtactttatgcgtaatttatatttttaatttttttaaataagatggacggttaaatgttatataccgaaacccacagggagcctgagagggagcaatacattttggatttggttcaggtgcagtccctagtgtgactgcaacttaattagtcacactaggaccatccaagttgcatctaagggctgagatccttagagcactgttcacgcgtaaaaaatatttcacagctactgtagcgatggtactatagcagttgatctacacccttgatctaaaaaatgaatggatgagataatgtgccgtcactgacttgcagttctagcagtgactgcatttgatctcaatccgtacattttgtttgcagagaaactacattttcagtagaggagatccagtcaagagtgaggcatgaaccaatcaatcaatgcagctaaattaaaattatactatcaattgaagtgagttgagtgtgcacgtacgtaggcgggctgcataaagaaaccatttcgcgccgaacagccgcaccttgcacggtc

SEQ ID NO: 30511 - DNA, 894 bp, Oryza sativa
acgcactcgggcacgcaccgccgccgcaagaacttgcacgcgccgcacggcgaccgggctcccgtccccgccgcggcagcggcagcgccggcagccgtagcaccagccataccgatcaagatcgagcaagaaaatgaatcgatcactctagctacgtgtgcttctctccaagtgtagtgtgtggtgtagtgtagtgtaggtaggttagctgctagtagcggtgcaacttaagatggaggaggtggatttataagaggaggaaggagaggagaggaggaagaagagaggaggacaggtagggtagggtgtctggttcgaggggagcaaacgtgttaatgctgcgttgaataagaaggccaacgtcctctgccttactacgactcacttgctaattaacctgcagcttaaactaatcaattctactactgtatatatatcaccttcagaaaaaagaaagaaatattagtgtacaacatggccatgtgatttgtatagtcttccttaattgatcagttgtcatggagcagataatgactatatatataaataatattggtacgtatgtactagtaatataatctgatcttcattgaaaatatgcagaaacggtccagtttaatttctacactttgcttaccaccaacatcttcatgaacattgaagtttaatttgcaggtgaaagataatcactagaatgaacatatcctatatatgccctcagaaaggatactagctagctagattaattgccgtggaatacttatactgaaccttgataatttttcagtagtactgttggatttgtccagtacaagaatgagaaggaaataaaaaacttactccctttgttctgttataattgtagagcctgttcactttgatgtcaaaaaaaaa

SEQ ID NO: 30512 - DNA, 726 bp, Oryza sativa
  unsure (1)..(726): unsure at all n locations
nnnnnnnnnnnnnnnnnnnnnnnnnnnnnnnnnnnnnnnttactgtgttgaggaatgtctctaagcaggtggagaaggatagcgagatacgagctctagtgtttatatctatggcaaaggctcttgctaaccaggagaaggccggtgatacaaagaggtgcttggagattgcttgtgacatactggagaagaaggaattggctgcaccagacaaggtggccgaagcatatgtggaggtatcctcactgtatgagatggtgaatgagtttgacaaagcgatatcattgctgaagaggagcttggggatgcttgagaggatacctcaggcacaacacatggaagggaatgttgcggctcggattgggtggctattgcttctgacagggaaggtgtcggaggctgtcccatacttggaggatgcagtggagaggatgaaggacagctttggaccaaagcattacggggtagggtatgtgtataacaatttgggggctgcatatatggagatcggccgaccacagtctgctgcgcagatgtttgcgcttgcaaaggaagtcatggatgtttccttggggccgcaccattcagataccatagaggcctgccagagccttgccaatgcatacaacgcaatgggaggtatgatttcacaacttcattccattcatttcaaagacacataaaaaatgtgacaaaaaaatactggacagacaaatttggatgaaa

SEQ ID NO: 30513 - DNA, 606 bp, Oryza sativa
  unsure (1)..(606): unsure at all n locations
nnnnnnnnnnnnnnnnnnnnnnnnnnnnnnnnnnnnnnnnnnagtttggactttggagtaatagcttgatctttttttctcctctcttgtctatctcagatgggtacagagaccttattagttgtgatcacactgtgctggtagagcatatatcacctgctgctacagttaagggagcaacaaatgttcagaatttcagaacaggaaatcaacttgagttcaaacacagggaatgacaacttgggggtgtttagatccaccaccggcaaaaaatttttgccccgttatatcgaacgtaacacatgtatggagcattaaatattaacgaaaaaataactaattatacagtttgtgtgtaaattacgagacgaatcttttaaacctaattacactatgatttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30514 - DNA, 538 bp, Oryza sativa
  unsure (1)..(538): unsure at all n locations
nnnnnnnnnnnnnnnnnnnnnnnnnnnnnnnnnnnnnnnnnnnnnnnnnnnagcacaccatcaaccccaatttgtccttttaagagcaaagatatactactacaagtagactgtggtttcagcgaatgtcatcttgccagatattatccgttttgatggggctcaccaatgatgaattctttccatttcagaagcatagaattcagcattttcttttagttgtgagctgtattaggatgtctttcggtattggatcaatgttcgctaaatcttgcttattcgacgcagaaaaatatggcgcatgttttatttacttccccttgctgtcactgaacacatttcctaaagtcaaggacaagacatggtgttgcagaagaggttggactatggatcccatggccatcgtgctcccattaagccacgtgtcgcaacattggcgcccgaacatttttgttatgttcttatgttaagtgtgctacccacataatttggtaagttttaatnnnnnnnnnnnnnnnnnnnnnnnnnnnnnnnnnnn

SEQ ID NO: 30515 - DNA, 1232 bp, Oryza sativa
taaattaaaaacatatgctttatctgttgttacacttattggaggataacaggacctcaacttgaaaaaaaaaaagagaagcctttttttccttcctcttttcgagatcaggttcatatgcctcagtgtttgactgacaaatgcagttgctgaattctgaatatctgacctgaattcccaaccctaacaacctgacatctctcaagtttgttatttttctccggtctcatgcgttgcatggtttcaggaaggacggttataccaccatggctgatctgattctgatcttctttcacgaaactgtggtgatcatcctcactctctcttgcggtgactgacatgtgggccctctattctatatgccctggccactatccaatcacaaagagtttgttttcattgactactattgattgtctagtcaaaccagcagattaagtggagaaaaaaaaagagagattaacaagtccttcagtctgggatttgtgtgttttctttctctaaactgcagaagcagaaggtgtaaagatagtgcttttgccgtgttttttaaagtgccagacacaagaaagtgctgaggttgcgatcaaattaagaaatcgttttaatatacgaaaacaaaagcatttcatgttgtttgtggttgaaaaaaagtagtattagtcccccagtacccaatgctgaagcatgtgggcaactagttgagcttataagagggaacttgcttccactaatcccaattaactttaaggataactatactttgttcagcaggaacatatacatacatgcttgtttttctattttgaacaaaactaggaacacctgctttgcaaaaggctgacactgtagctatcttttgtagtactagtagttcaagtcaatcacagttgtgcagcatatggatttggaaccataacactttcaacatgccctctgaaggctcattgactaaatattattgtcatctaatgactaatttaaatgcttgcccgtactgtgacagtacatgagcaagaagtctttgcctttaattgcatagatttccaaacaagacacatggatacatcaaggacaccacaggaatgcagccacaggttgtgaaattctgtcgaccccaaatttggagagaacacgattgaaatgctgccttgtgtagtagtgcctatttgactgtagaggtagtaatttcgtcgattcgatacttaaatatatggctcgatctcttgaaa

SEQ ID NO: 30516 - DNA, 945 bp, Oryza sativa
  unsure (1)..(945): unsure at all n locations
nnnnnnnnnnnnnnnnnnnnnnnnnnnnnnnnnnnnnnaaacaagacaaaacgtttacgacaatacatgttttgatgatgaagaatacattagtcgtgaaaaatacacgtttacgacaaaaacgtatgtcttgatttaataagctgctaaaaatacacgtttacgacacatatactgctaacaaaacgttttctatgacacaatatacgtatgaaaaaaaattgttcataattatcttttagtttgttttaattttctacagattatcatagcgtagtatattactctctgcgtctcataaaaaatcaaactagcattggatgtggcatatcccagtaatacgaatttaaacataggtatatccatattcctagtacaagtatatgccacgtccgttactatgttggttttttatgagatggagagtgtatgtgtcatcatgtatggtggtgtgcaggtttggcgacgttgccgaggagccaaggatgttgatctcgtcggagaagctggtcggggaagggttcgagtacgagggcaagaacctggacgacatgttcgacgatgctgtcgagtacggcaaggcgttggggatgctgccataagccgtagtgatgatacagtagcagactgatgtgtgggcccggacccacatgtgagttactgctactgcatcagcagtgaatctgcatccgttcgtaacatgtgggtagaatgtagtatatgcccttgctatacatatccatccgaataatcatgaacattatcgaaataatttgatagcatggattgtgacgtcatactacaatatttcatatatgcatgtataaattcgatgccaaatgaagagaaaaatgaatccacatgtgcatggtcttgactattttactgnnnnnnnnnnnnnnnnnnnnnnnnnnnnnnnnnnnnnnnnnnnnnnnnnnnnnnnnn

SEQ ID NO: 30517 - DNA, 699 bp, Oryza sativa
  unsure (1)..(699): unsure at all n locations
nnnnnnnnnnnnnnnnnnnnnnnnnnnnnnnnnnnnnnnnnnttgagctatttcctgtaactgaaatggtttgtgtggccttgttagtccttgtagtttaacatttgtagttgtgatgtactgtagtgtccatgagatattcgtctatttccttgctggttgaatcttaacataaaattgccttgttacaactaactctgtacctaaattgtctccttgtctatgacagactgtaggagaaagttctctggttcgttggatggccttttccagatttaccaaattgcattaagtggagttggtggttacaaagtttcttcagaggactcattgcatttggttgaagccttaaggttcgtttgttcccaccagtgctttagtcatttgttgctacctttgttttggatttgatcaaaatctcaccttacatgttcttgcactcatcagtgtggttatcacgactctcccaccagaccatgctcaaagagcattggagttaatctgccaaccagtaattaatcccttgcaggttagtattgatcttttacagtcatttgatgatttcgattttatcaatgctaatatagtatataccgatataatacgaaataatccaagctggagatgcactgcttgatcaagtttctgttcgggaaattaaccttgcatatagaccgaatatcatgcatttttaggtgg

SEQ ID NO: 30518 - DNA, 562 bp, Oryza sativa
  unsure (1)..(562): unsure at all n locations
actnnnnnnnnnnnnnnnnnnnnnnnnnnnnnnnnnnnnnnnataattggttccgtgcctcgtgaaatcgtagcccaacgttggtagagttcgtcggtttcgcacactttattagttgtcggtgggggtttgcttttttttttttttacaagcagttgttaattcacggtaaatcacgatgaggaaaaaaaaacaggttatctgcggtgccggcgaaacgcggtggaggtggtgttgttgctgctgcatcggcggcggcggggagcgcgcaatttggcgccggggacagtgagaatccatacgaggtagaatgattgggttattgggagtggctatgttcatgtttaggatcagccttcgttggtgatcaggtgattcaatgattggatgtggctcctggtcttgatgggatggatggtccctgtttgttagaatttggggatcaatccacttgatgggttcaaccatgtgaagatggcctataagcggaggcgaaaggattcccatagcaacaaaaatgccgaacacctgttaaggtgggtttgggtcatgggggttcaga

SEQ ID NO: 30519 - DNA, 646 bp, Oryza sativa
  unsure (1)..(646): unsure at all n locations
gggtgaacaaaataagaccaaaaaactcggttagtagttcggctcagccatcaacagaccaaaaaattttcgacaaattcggtcattagtttcagttatccgaattacccgaaaagcccgaattgtgatccaatagtcctagaaggcttaccaagttcagtagaaataccaaaccttagaggccagcagggagggagtaagtcaacctcacgccggccataaccagcgctgcttccaatccaacccatccatcacgcggcagccgccgcagcttcaatggcaccgcagccgcttctgtctccactctccaaacgttcgtctccactttcccattgttgcttgcatagagtctttgcaacttgtcaaattcagtcaaaccgagcccgagaccgaatttactggtcgtgagtttttttttacgaaattcggtcatgagtttccaaaaccgaaatgaccgaaaaccaagaccaaatttttcggtctgaccgaacgcccacccctagccttctaggcctccttccgattgtaggaaaaagaaggaattttgttcttatggattggatcactgtagttttatatttgcgtttggctatatttaagttaagaannnnnnnnnnnnnnnnnnnnnnnnnnnnnnnnnnnnnnn

SEQ ID NO: 30520 - DNA, 9182 bp, Oryza sativa
cccatatgggatcatatcatatttgaaggcagttagtgctgctgttctttggattttttgtttgatcttacaaccaagcttagctgctttaatttcttactgatgtgggagtttttcaaatgcagctacgtgtttctcagtgtttctgtccagtgttatgcttagataccctctcttgctcctctttcatatgcatggtcttgcatgcctttaatggtactcctttcgtccaaaaaaaaagcaatctaagaggggatgtgatccctcgtagataatgaatttagatggaggtttgtctagattcatcattgtactaggagggataggatggagggagtagtggttagctcttaactattaatatatggtctacgtctttttcacagattttcttgattcctgtgtcttagccggttgtaagctagcttaccacccgcttcccctctctctcctctcttatccaactcagcattcagccatcttaggccattcccaacccaagaaactagatatagttctcataaacttcatgtcatcaagaaactagttctagatgaaactagttctagatgttctttttcaatacaaacactactattctatacttaaatttaatgctacttatctcacatgatatcttagatgtgtagaaattatgtctcatgcaaacacatggtttccttctctttcctcatttattcatttgccacatcatttttcattctaggtgacagtttatttaataatatggatattattctagttattgggttgggaatggcctggtagccttctattagtacctgcttactcctagccttctattactactccctcaaaaaaagataaaccctaggtttccgtgtccaacgtttgaacatccgtcttatttgaaaaaaaatgaaaaaaattaaaaagacaagtcacgcataaagtattaatcatgttttatcatctaacaacaatgaaaaatactaattataaaaaaaattcatgtaagacggagagtctaacgttggatacggaaaccagatttgtctttttttagacggagggagtacttgcttactcctagctttgctttgcagcagctagcaggagtaatgcattgcagtggcaacaatgtgcctctcctctctgattgaggaaaactagacttgctggtgtggcaatggcaggtctctgtgtgtgactggtaggagttctgcatgcttctacatgaccagagctctaggctagcaggtttgccctgaggaagaaagagaaaaagggttgcatttgaccactatacatgtccatttccatgctgctctttacacatcaaatcaaaggcatggctgtaaaagcttgcaaagatcacacacacactacactgccagtgccttgcattggatgttctcttgcatggacagccatttgttcatggggtaataggctgctctctcttctctttgtgatctctcatcagtcatcaccaggtattactcagctagccaacaggaaactggactactggagtactacgcactgtcacactcctttgtcaattgtcagatttgctgcagcttctcatgtacccctactgtagtacttgtacagtactccccttattttaagtgtatggctgtgtccaacgcttgaccacttatcttatttaaaaaatttatatattttttaaaattaattcacatataaagtattatttatattttattatctaataataataaaaatagtaataataaaaaaaattaaataagatggatggtccacaactcacgcttattatgggcgagggagtacagtagtatagctgagttctgacctttgaacaatggccgtgcggctcttccttcaagtcggaaaaaaaatccggtattttctttgatatgcagctgcattaatacctttgtgatgcctacctcttgtataaaaatttcctcttttacgatattgacatggttttaaaaacaatgttgatactaattcctactttatccgtcccattttgagcgtaaccacgagttttaattccttgttcaatttttgattgtctatttcttttcaaattcttttatcattagtatttttgttgtttttagttgataaaacatgaataatactttatgcgtgactttttttttaacttttttcaaaaaaaaataaatttaaataagacggacgataaaagttggacatggaactcatggttgcgtttaaaaatgagacggaaggggtattgataaaagatataaaacactcatttttttgttaaaacaccttttttacgatattgacatgggtcctaaaatgattccttctacaaatactattcagtgctattaatgaatagtattttttttgacaaagaaagttttttcttcaaatatatatatggctttgtgtatttttagttggtgcacaggtaggaagttatacttgttttgttaatttttttagagtgctaagtttttgcttaaaacatgtcgaaaagaatcaacaatatgttttggttatttttttgtgactggagggagagagtatggaatgaatggctgcattcagggcattgatcttgtttcattttcacgccgattgtttttgccaattgtgtggggactggggatctagaaagtattattatggttgagttgtcccctcgaacttactgtattttgacgttgataatcttgtgttaaatattgtatcatactcactccatttcattttaagtgcagctgtaggtttctatatataacatttaaccattcatcgtatttaaaaaaattataaaattttctaaaagtaagtcatatataaagtactatttatattttatcatctaacaacaacaaaaatactaatcataaaataattaaataagaccgatgatcaaacatttaacatagaaatccatatctacacaaaaaggaaaaaaaatactagttactgtgaataacaccgaggtcttctataaaaggccttaattaagaaacactgaagtaaaggtacaaaacaccacaagttagatctttgatttgaaaatatcagcatacgaaaatataccaggagttctgagttaaaagaaatattccttttgatcgtcgttctgtcacttgcccgaaaagaaaaggagaaatattcttctcgatcccaaatgaaaataatttttagtattttttagcttatttgaaaattttaagttgttttggtatatattacttttcttcattatttatttcttatttactcttaaagaaaatgcggaatctcttacaaatatttgactcatctattctagtatgaatggagggcaacaaagtcatttcagccatctttaaaattcagcttcggccgagtttagttccaaacttttttaacaaactttcaatttttccatcacattaaaactttcctacatatataaacttccaacttttccgtcacattgtttcaattacaaccaaactttcaattttggcgtgaactaaacacaccctgcatctagaacaacttatatttggattaaaaaaagagtatatatattgtacttgtatcataaacgtgtaattgtactttacccaaaatattacaacatatataaaatttcttcaggaattgatacatttgattattagggcactagttgaattacagaagttaattagtttaattctttagggtgataataaagctctcaattaacaactttggataccatcctggttgctttagttagtagatcaacgaactctttatttagattttgttgatgctacatttctgtcgtttttccgttttaattatatggcagtttcgtggtatatagtatggtgggtgtgactttggaaattgtacgcttgtttcttttcgctgtcattttccttcgtggagcttttgccagctaaatgctgatactgtcagtgtcgatcatacagtgcctctctcactgtatccatacacatctaattaataactcatctaaaaatagtactacatcttatcttattttatatcaagcatatttacccggttttttattttttaaaaaagtacctctcccacattctctttttttttcctgcgaaactgagatgtactatactacgatgcttgatttgagtacatattatatatttgaattcatacatatgcttgatttgacactttattcgataaattcgggtaataattaagcaagttctagtcatgcctagtgcaggaaaaccccctttgttctgcaaatacaatatttgagaaaatatatatgcatgttctgttgtcaatcgctcattgctcgtcgggtagctatatatagatatttacttcctagaaaaaaatgttgctcacaaaaaaaaaaaaccctactccatagcggaccgagcagtattctgcatatatgcacattctgcctcagatataatatgagtgaattgagcacttaatttgtaatcgctcatgatcattatgcttattcaattcagactgtcgttatcggtgactaacaaagtaattaacaatacaaaatattgagctacctaaagaaaacaaactaaccatgaattggcaagaacaaacaagtaataattacttaaccatgaattggcaagaatcaaactaacaatgaattggcagatatatatctagggaagtcaactataaccgaccccagcttataatatgtacgtgtgtgcactgcgtatttactcaaaatctacgtgcacacgttcagtgtgtacatatatatatatacagtatatatagttaattagcgtcggtatatatagacaaagaacagtggtgaacgttatttcatgacgaaggttttccgtacatttctcattgaattatatacgggcaagaaggaacatgcatgcatagttaattgattaattaggtttgttgatgatatggtccagctacgaacaatctaatgaatactttggtttcggtcgtcactactagtagttagtaaatgggataaaatcgatttgatctccaggccaattgggtatttttgacaccattcaattttcaatattgttagactaatttagggtggttaaatgctccctccgtccctaaatataagagattttggttggatgtgacgtattctagtactgtgaatctagataggagcatgtccaaattcgtagtattaggatacatcccatttacccaaaatcccttatattttgggacggagggagtagatgtctatacagcagtccattaaaaaaattatattttaaaactaggtcattggaacccatatatataccagtgacaacttgttaattatctttttcctccacctctcttctaaatctctcatcccttgccttttctcttctacctcctttgtgagctaagggaggtcctaatgacaacaaacttagactgttctcagctgcctatgccacgatatatccatcgaagcatccacaaatggaggaggacgtggcaataacatatagcgagctagcaacaacgacggtggtgaaggagcccaatccctagtttctagagagttgtattcattatcgcgtcacctggcctccccacccctagcacacctctgtctcaacttcttcaagatctacctactcgaatgtagcaatgccttactcttagctaggtggccatgcaagagggggaatctcgtcgtcgaaggcatgagcttgggctcgctgtcggctgcgcgttagatttacagtggaggtgttgatcgaaaagaagggattcggtgagagaaaggaggatggaagaggggagaacatagtagaaaaagccggaccagccagcgaaccatccgaacgtctaggtcacgggtcgagcggttggaccgctaggtcaaccggttcaagtgcaggtgaaaaaccgttatttactccatatattcctttcaaacactatatatgtgttgctctattggctagcaaagtttgcgatctcccagagacccacgtttgagtcccatgcgcactagattgagtgctatttttgcctgttgggctgcaaattgctggtttgggccttgatttggcccatccttttgtgttagccgtttgggcatgccggtttttttcccctccggtctttttgcgtgaacatactggccacatcgttggttccagtttttccccgttgaaccgccggtccggtctggttttttgcacaggggggagaaggaagctaagcagtattgcaagagttgcggccctagatttggttgtggactcattgtcatctttgcctctgtcaacagttagtgccaccacctcctcgagctctgtcgtctctagctacctccaccgagtatcgtcttctcctcgagcttgtgtcctcccttagcactgtcttctcctcatgctttgctttaccaagtttaatctccaccgtctcacccgctatgttcggcgatcgagctttgcttccatattgcccccaccgagcgtgcaagagagtattagggggaggaggggcagagagcagggtgtgcggtggataggtgggtcctatatatagagagagagagatgcggaggaatgagagagatgataggtgggtcctatatgtttttaaacttttaatgttgattgggttgtcacgtttggtgccacatagcaatggtgatcaaataagcgcgataaaaaggttgaagctatcaaatatagaggtgttttttaaacaaagagaagagtagtgaatactttctccatcccaaagaaatatagttctatgttatttagcataaattaagatatggaagaaaaaacaactctagtgctcccaatattcatgtgtgtatgcttactggtgtactccctccgtcccaaaaaaaaaggcaaaccctgggtatccgtgtccaactttgactgtccgtcttatatgaaatttttttataattcgtatttttattgttgttagatgataaaacatgattaatattttatgcgtgatttgtctttttattttttttcataattttttaaaataagacggacggttaaacgttgggcacagaaaccagggtttgtttttttttttgacggagggagtacgtaattaagtgtcaagtgagtcattgtcgaatcgtaacaccctgccaaaaaaaacaatataaaaatttgaaatttgtgtcagtgctaaactcaagctagaaatatcaatattttttggtattaggcgtctgagcgaatgagacgcgtttaaaagctgcacccaccttcgagtctacctcccatataatttcccaccgcgacaattttgaggagacattaaagtattttgtattgcagttaatgaatctttccaaatgttacatatgacgttgttcggatgtttcaataagtattttattttgcttaatttgtcattttgatggtccaatcgttttctctcatatcagggtcctagaaatgtagtagtacacacaaagaaaatatctgcatacactagttcagtgaagcatcgatcgaattaatcctcgtctcgttctctgatttctccgtccgtctttcaaatcgccggtgccaattaatcacaccgccgcgcgtccactccataaccactctcagtttcaggtggtgaagcagaaagcgtagttctccctccgtcaaaaaaaatctcatatccagattcatccataatatatcgttctcattctcatgttcagatttatctttaggatttaattctttttcgacagagtaagtaagaaattgtgacgcgcccccacaataattaggaagaaaagaaaagaaagaaagctactgggtatagagcgagtgggctgtggttgccttgttccttgggcttgccggccgaccatgcaagcaagcagtagtgtactagtgcagcggcaggctcttggccttggcccaaacggcgatcagcatcagcaagctaggccttaatttagtcctacctctctaaccaacagagaattaacggcagcagcttataaggtggattgcctggagactacctaaaattgcaggttaatcactcatgttacagtgtagtgcattttcactagccattggtcactggctgcagcgtcgaccgctatccgccagcgaaaatattgcattttcattggctttggccgctggctgcagcgtcaaccattgaagaaaacttaaaatgtccgacaggaaaaaaatttttaatagtgacagcatcactaccaacattttaaacattttaagtagcatagatacgtatctagaaagtcctaacgttcatgaaacagttttcttgggttaagatcctagccagtttcttcatttcagattttagctttcttctttttcttgtagtctactacatcggtcccaaaaagaattaatctacgatagaatatgacctaggcaaagtaaaaaaaacggaccagagatcgacccgctggccgtcggttcaccgatcaaaccgccggtttttatttattaatagtatatttgatttgcattattttaaatatagaatcatcacaaattggtgaaaatatgcataaataaactagtatatatattattatatggtcacaacgtcaaaagaaataaatgtagtgtggtaacataataaattcataatgccatactactaggacaaattaaaaactggttcgattattaaaaaatcacaaccagttcaccggttctcataaaaactgcccgattcaccgttcttttacctattcgattgcaggggccgtctttttgttgaaccgagccgccaaggttgccggttccggttttttccgattcaaccgtcgatctggtccgttttttttactatgatcctaggacaaccaatccgggtgtcacatcctagttgattcattttggacggagtgagtacatttaatacatataagaatttaatttgaaacatggtattggcaaccattttctgtatcttcgttaatttgctaatcaataaagatccatctttttttcctcgagagaaaaaaaaagatgaaatcgctatctgtccagttggtaatcacctgtaacaaaatttatatcacgcttccagatggccaccctataatatagcgtctggtacttctacaatatatatcaacggcctcccaaaatatatagctcgtttaataatccatgtctaaaattacaatcttggccactataaagacccgactattatacgctgaa

SEQ ID NO: 30521 - DNA, 4140 bp, Oryza sativa
caatgactcgatgtcatcatgttaattatcatcgcagttgagttacaaacctttcaccatgttaattatcatcattgtaagtcgcaggcacgtctgctgtgctgccgtgcgtggtggcaaaacaccttcaaattaaaactgaacacgagagagattatcttctaaattggctttcatatttttaagaataggatcgttctattaaatggcacattctccagactcttaaaacagtactctctctgtttaaaaaaaaattaaactagaaatagatggaactatctagaacaacgaatcaggtcagtcgatccgtttctaagttattttttctgagacggagggagtacgtgtgattaagtaaaaaacttaattttatatatgaatttcttatcaaactgttttaaatccattataaattttataatactctctccgtttcataatgtaagactttctagcattatccacattcatataaatattaatgaatctaaatatatatgtctgtatataaaaatccaaatcctacgcatgcttatgtctggaaacagagagagtatatatatttttgtttactagttttgtgccttacgtattaatcttgtttcattgttttctgcttttcgtgatagatagtaatttttaatctattgttatatggtaattagaccataagttttacatgacatgtagctaaagatgaatgtataaacacccacgaatgtgtcgtcccaacaaacactgaatggacaaaggctgaggatattagttgcatgtttgtgtacaatttgtatgaacaaatcaatattcatttactagtggaacatcatgtgcgtaaaatatggataccaaaatttaatcccttgaggtaaaaccatacacctcaaacaaaactctagtttaagctcgaaggtctcttggccggatagaaatgtgaaaaacaaaattgcaatcctgattaagagtactcttcaccgctctagtacttcttaagccgaagcgctgttctggttttacatttcagatgacgagaagaagacctcccatttaaaggacctgcagtcacttggccccttgaagatctttcgtgtcgacttgaacgaagaaggaagcttcgatgaggccatcaccggctgcgtcttcgtcttcctcgtcgctgcaccggtggtcgtcgactcagaaaatcttgaggtaattgaatattgatcgattcattacacaaaattaacatagatattagttttaacttaacttccagtaacaccactattttgttgctaacggttgatagtcaaatttagtagaaagctaaatttgggctaagttcagaaagctatgaaagccttcccgcaggggctggtctgactgagcacctagctgtctgactgacccttaggaacaggtctgaccgatggcgcgccctactgttatttgaccgaagaaatttggctgatctaaccagcaatcctaagtctaagttaattttgattccatattatgcttctttgcttgggaccggggtttgtttttattatagtcgtaatatacctctaaacctaatagaaatgaagagactttgtttcatgctaataaactatcaatcgatcatgaactgttcttttcctttaccctttacctaggagtagtttaataacataaatattcattagttcgcatggtaagacgtccatgctcgttccgagtgtgaaacccacggtaggtttttatatatatcgtcgccaagatcagaagctacatcgttgtttgatcataaagaggtgtcagcaccaactctgcatatatatatttcctgcatgctgcattttcttaattaagttttttttattattttttccatcaggaggacattactgaaaccaacgtccgaggcactttgaacgtgatggggtcctgcgtgagagcgagggcgacggtgaagcgcgtggtcctgacatcgtcggtcgccgccgtgctccacgacggcaggacgacgatgcaaggcggcgacgatgggcatgtggtggtggacgagtcgtcatggtccgacctcgactacctcgctaccctgcccaaccacccatctgcaaattgggtatgtatgcatatactttctcgtctctgaatattttacgctgttgactttttaaaacatatttaaccgttcatcttatttaaaaaatttaagtaattattaattcttttcatattgtttgattcattgttaaatataattttatgtatatatatagttttacatatttcacaaaagtttttaaataagatgaacggttaaacatgtttaaaaaaagtcaacggcatcaaatatgtagggacggagggagtatatcggaaaatttatgccgctcctctatttgttttgatcgatggaagtatgatttatgatttgatatgtaccaactaagggctcatttgaaacaaaggattctcggagaaattcaatcctatggataccccctaaggataaccatacttactttttgaatttgtagtttcaaccgaaaataattatattgatttgcagaaaaatcttgtaccgtattggaatgtggaattgaactgatgatctatgtgaaaaatcagtctctctttctctcttggctgaagtgctgcatggggaggtaattgcgtgcatatatgctttgtttgagatacaggctaaggcgtacgggccaggaaaggtgcggtcggagaaggaggcaagcagggtggcgcgggagaacggcatcagcctcgtcaccgtgctccccgtcatcgtcgtcggcaccgcgccggcgaccagggggttcaactccagctccctcgtcctcagcttgctcgccggtgagcgctcgcgcgctcgatcgatcgccggccgccgtgtcgtctcgtccatggcttttgcaattctcacctgtgactgtgaaaggtaattcggttcattgatcaggccatgaggcgacgacggagatgctgaaggccacccaggatctcgccggcggcacgacgccgctggtccacctccgcgacgtctgccgcgcgcaggtgttcctcgccgagaagggcgaggcggcggcggcggcgggaggaagatacctctgctgcggcgccaacaccaccgtggcgcggctcgccggcttcctcgccgggaagttcccgcagtacaatgtgaaaaccgatgggtacgtgccttagctttctccatcccaaaatataaaaaaaatagttaaacggaacacattacttgacagtttttaaattgatttggggcatgggttgtaattaaatgtttgtttctgtgtataaatttatctaccacttatagaatcatcaagacaaaaggacacgtttatgactaattttttgttaataatactgctaacataaatatttttgttactataatactttctccgtattttaatgtatgacgtcgttgactttttaaccaacgtttgaccactcgtcttattcaaaattttatgtaaatataaaaatagttatgtcatgcttaaagaacatttgatgataaatcaagtcataataaaataaattataattatataattttttaaataagacaaaaggtcaaacgtttgtcaaaaaaaatcaatggcgtcatacattaaaatacggaatataatttttttttggataatgagctttctttaattcggtctttatatctacgaatgatattcacggctacgtgagcgtacgtagtatatgaacaaaactttttgtacgaacatttagtcgtaaacaagacaaaacgtttacgacaatacatgttttgatgatgaagaatacattagtcgtaaaaaatacacgtttacgacaaaaacgtatgtcttgatttaataagctgctaaaaatacacgtttacgacacatatactgctaacaaaacgttttctatgacacaatatacgtatgaaaaaaaattgttcataattatcttttagtttgttttaattttctacagattatcatagcgtagtatattactctctgcgtctcataaaaaatcaaactagcattggatgtggcatatcccagtaatacgaatttaaacataggtatatcatttcctagtacaagtatatgccacgttcggtactatgttggttttttatgagatgga

SEQ ID NO: 30522 - DNA, 14599 bp, Oryza sativa
agtcagttgatgctcatcaaccaaccagaacgtttctgcatgataagtcattttacccttctaaaactttagtttgagataactctggcatgaagtccaatcactctacttaaacataaaagggatccttttaaatgaagaggtcttcataacaataaaaaaattgaaggccatctaaattgatagaagctggccggccgttgaaaaatcaggcccaaaggcagatcaccatccgtgtgatctcccccagtgatgtatacccacctcgtttttgacataatacaacacaactttcctcccagatacacaatgcatggaacatgtacagtgacgacgaaatacaaaagaattacagtgaccaccactaacctatctatcctctgaacaaatctgaacagtatggtgccgcaactcaaacctgtatgaagtagaaaaaaagatccaaagaagctgtggaggcataaaccaacactgactaaagatgaaccgccatggactttcagttggtcttgtataaacgtcctgttctcacaatggcgggggggcaaccgtgaaggataaatcatgtggccgcaaagcaccttgaactatgtcttgcacagttttgttccttctacaaacttctgagatttctgcaaatctatctgttatggaaccaagactagatcctgatgatgcatcagatataatattcaagaatcttgaacgttctgaatctgtcaaggcttgtggtggtataagggtaatacattcccttgcccaactcaacatgttcccaccaaatgatctgctaagggacaccagaacatacgagacctgcaaaattccaagtagaagatgaaaattcatcctcgcatcaaacataaggtggagtcaggatctagatttctagcatttcctgtaacattttaaagggaagacggtttcttaaggcctttcttgggaagatctctattttacaagcacaatcaaaattcttacaaatcagtgaattaacaaaactgtcaaatactgttcgtacaatcaaaagcaagaacctggagaagacaattggaactaaaaaaaaggcaggctatgagtacgaacagtttgtgccaatttagccaacacctgttgcttcaggccatagtaggtgcgtgggacacaaacaaggtcttgaaaagctttggaaaatgcagttggaagcatttgaacaaatagcacttccagtcactctattcataaaaaggactgaactgatcgcacagagctgtaggggatggaataataggctaggcagagctcattgaacagtgattgaattcaagaacacatccatacaaatacaataaagtgtaaaccatcggaatatatttcaacatctagttcaagtgttgaccacaatttgagcatatatagtgaggtgacatcagctgtttgataagagatgccacctagtattttttttcattattcctgttttatggatgcaatatgcatcttgtgcacctaaatttcaaattacacacaaaattgcttcctacaatcttgtcaacacagcttgaaacgaggatacaacagcagatttgccctcaaacatcccacattgtagttcaatgttattaaaaaatagcatcagtttattaaaaataatcggtgaaaacagtggtaagtgggaattctccaatgatttaacttttatttgggatgccagtagattatcatgacatggatgttttgtagtattccagagcatttgagatgaaatattatgggataatagttggaaaaacaatttacctaaatttagtctgattgtcaagcagaacagtagacattaaataacgttttcatgtcaatgaagatgagcagagagtaatccaacagaaaattgaaccttaacgcaacagactatgaaatcctcaaaaaggaacttgatgattctgaagaccaaattaggtagcgctcttttccgcttatccaccaaattattgccgcaaattatttgctccatgcttattaaaatatggtttctaaaaaaaaactttattttactgtattgcttagagcactcgttctaagctatttgttaggtttttaatatataatatttaatttatctgtcagttttcatccgcatttcatcactttagaacagtgagaatttggattatttttccccaaaaaaagggataaaagaacatgttttccaaggctttttaaaagtgaatgcttcattcttcttatcaattattattttaattggtgacacagaactctaatattgggtttgttagttcatatttttttcaagcatgaaatttcagtaagcagcacaataagaaataggaaacaccatataacacacaatcatattgtgtacctcttccaagcgactagatggcagagctcctgttaaggaagcaaccattattctagtaagtactgcaccccgctgaagtataactgtatttattaattctcggtacttttccccctcaggtgattttgcaagatcaaatacatcagatagaaaagataatatagacttgcatgcctccctgttacataacacaagaaaaagaaagacaataaattagccatcacaaaaccgcattaaagaattgagcacagaatataaagctcatgtatagtgcatttctctctgacgagtcaggtagactattcgaggcactacctgtgctgtatagttataccaaccattgcacagtcaaccaatcttggaaacatctctgtaggtacaaataaatctggacagtaacgaatacatcttgatgctagcaggaagcaatcatcagctatatccggtctagctgtaaaatcctgcaaacatagataacgcaattcagtaattacttgtcatgttgttgatcataatttgaatatttgaatttcccagattaaaaaaagaagaagaagagaacagaacctgaatagtccgaaggagctgtattgtatggccaaaaagtgcctgaatcagacttgcaagatagtttgcacatgctggatcggacccaaatatctaataaaaaatattgtcagaaaatcaaagatacaacaaaaaatgcattgataagatctttcaacatatataaccttaataacttcactcgacaagtaaaggaagcaagcctgattgtgttgctgatacagagtttggatttcttcaagcattgcaccaatggtgaatcccatgaacctcccgcatgtccttaccttcatcaccagagcaaaaactcattattgatttattatggaagtttaatcattcataattgcacgatgctcaactgataccaacagacagacactccctctgtattttaatgtatgacactattgactttttgaccaacgtttgaccattcgttttattcaatttttttgtgaaaatatgaaaatatttatgttatgcttaaagaacatttgatgataaatcaagtcataataaaataaataataattacataaattttttgaataagacgaatggtcaaacgttggacgaaaagtcaacggcgtcaaacattaaaatatggaggtagtaataatttataaggcatttaggcaactaacatgggcactctctattatagtgaagtacagagtggaggaaaaatacttaacatgaaatttagcatttgctacttttggaaagtgtgcgcgcactgctgtcgaactaatcctagaatttagccaaaccacccttatgcacttgtgacagtatttgtattccatcagagtgtacattgtattaaaaaaaacttccagacctaaataaaataaaatggtaaactcacagcaaatttgcaagaacgacatagtgactccatggtccgtgtatcccatgcccgtctgcagaagtagcaatacaacagaaacggatgaaacatttcctgaatataataccaaaagtaacttccccatatctgttttgttgaaatactcactgatcaaaaatacttttcaatgttggccaatatctattgacagcgtcagcaactacttgtggaagtttcacattgctgcaaaaaatcagagaatttagtaaataaagaacaaatttctgtggaaaaatatataagtgggagataaccacctaaaaatgcatgataatcggtctatatgcaaggttaattgccgaacaggaacttgctgaagcactgtatctccttgctggattatttcctattatatcggtatatactatattagcattgataaaaatcgaaatcatcaaatgactgtaaaagatcaatactaacctgcaagggattaattactggttggcagattaactccaatgctctttgagcatggtctggtgggagagtcgtgataaccacactgatgagtgcaagaacatgtaaggtgagattttgaacaaaaccaaaacaaaggtagcaacaaatgactaaagcactggtgggaacaaacgaaccttaaggcttcaaccaaatgcaatgagtcctctgaagaaactttgtaaccaccaactccacttaatgcaatttggtaaatctggaaaaggccatccaacgaaccagagaactttctcctacagtctgtcatagacaaggagacaatttaggtacagagttagttgtaacaaggcaattttatgttaagattcaaccagcaaggaaatagacgaatatctcatggacactacagtacatcacaactacaaatgttaaactacaaggactaacaaggccacacaaaccatttcagttacaggaaatagctcaagaatatcaaaattttgaaaaaaaatatatgaacacaaataacagagattctgttaaggtatgggaatactcaagtcataccttcacatatatacttgaatgccacagaagcagctgcagctgtttcctctgatgtactcatacccttgttgagaatatcaaccagaggtggtagtatcaacagttcagatggtgcggcttcaatccattttgaaaatgctccaacgagtgaacaaactgcagtttcaagtacatttgagctccaatcatcgtcataactcataacaaggctagggaagaaccaattggcatttcagaccgcaaacttcaatagaataactaccatccacaacaaagggaaaacatatgaagacacaaacgaatctgaaactattgggaaacataatatttggtttagggcaagtacaacaatgccaaaataaaattatcataaatcctggtatctaggaacaaacagccctaacttgtcagaactctaaatctcaaccagtgtcaatgagctactgtcttacagtgaaacctgaatcccagtcacagtataaaattcaaagcagtgagctgcaaacaaggacttatgagttatgaactttcaattaaactgaaacatacctgtttgcagcaactgttcttgatgaggaaagctgggaagcagtgacatgaccttcaaataacagcaacacatttcatgaccagcatccagtataaagctatggtggtaaatttacgcactaagcacagtagaaagtaaccacacagcgatcttaaccatcagttaaatagcaaatgatgcataagtaaaaacattaaaatacacccaaaatgatatacatacctgtggtagtatttcattctcttcaactgagactgacttagcaatggcttgtatacagaacagcgcagcctcgacaggctgccatttttggttctgtccatttccacatgcctgagatataaaagtccaatcttttattatagattactaaatataaatcttttacaggattaggaagccaggaaagtaatagtcaagtatcagatatagcagaggttaaaagccatagcaaaaaagcaagctgagacaccacactacaacaaaacctgttagctgagtatgcagtgacgcgacaccataatgcatggcaaatttgttgaattatttcagttattgaattattggctacaaactagtgtagcttaattagcacatgaccatatattagaaggccataaaagatcccaacggactcgttaaccaatgaaagactcacagcagacaagctgatctctccctccctccaaccaacgttctcctggcttccccccgtccattgtttgtatggttaggcagcaaccatgacgacagcaaccaagtgccacatcgtataatcaacagtaatgcaatgaatatagagactgtttggtaaccatgttaaaagaatcaccacgccatggacacaacaacagcatcaacctttagtcccaagcaagatggtggttaagatgagaccctagtcagaccacacaaaccaaatgggaaaggaactaaaataaatagaagtaggactagcgctagcacatggattgctagaaaggaactaaggtgtgtaattatgcataagataagaagccagcaaatggatggacaaaacttgtgatggtaacaatttaaagcacctagttcaataagatttgcataagtaactgaagtcccacaagatattcatcatgcataactgaaaatttagactaacaggatgaagtacacatccatgtcatttgcattgttcagagctttaggagtctgaaatgagattttctgcaattagtgtgttcaaacaaaagaacttttttgaaaaaaaaagtaggtaattattaaatagaaggaagatgtagaagtataggaaaaatttgcacgaagaatttgcataatttattcatcaattaacttagatcccaggtttcctccagaatatccgcaaacgaacacatgcaaactctgacaaacaacattgaatcactaagcacatttctcaaaaagagattctcatgccaggatttcagaacagttaaacatgcctaaacaaccagtaactaaaattccacattttgtgaggaaggttattttggaaccgtagataaatttaaagcaagaacaggtcaaaagctaagttcacctgaatcagcttcgtgaaaagtattttcagcgtcggatcacctccaagaacatcagttgcgtcaagtaatacatcactaaccgctgaagaaaaatggatccaattacttgacaagttgtatgaaaaggccaacattgcaagagcaactgggttaaaagaaacactgtaccataccatatctggaatgtctgaaatccctttggtcttcctccgaaaaggtgtggtagagctcaggatattcaactcggaaacttacctgattcagttagcatgacaagtttatttttacacgacacatcatacagaggacagttatactaataaacctcaccctctcaaaaacataccagagaaacaagaatttcaaaaggttgacgaaatagctgcaatcttctattcctctcagtgttgattgagacctcagatccatatgatgcgtacgaacccctaagatgtgtaagcattgaatgggttgtttcttgtgaaaaacaagttatcatttagtaaagtggtacctatcggtcaggttacgcataagatgatgccagaaattaaatgtcatggaggaaatgtcaaattctgaatgagaagtaacttccagtaatgcattcactatctgcatggcatcatcagaacctgtagaaagataaaaaaataaacacaataccctcatacttaaatgatcacaataaactttgttcaaacatgaatctcaggatatacaacagtaagcatcatccatgaagctttacctgctgcaatcaactcaacataagaatcacccatgtctgccaacaaacgggcaatagcttttacatcttcttcatcctagtaatgtagaaatgaattactatagacagtaaagtaatgaaaaatatatttatcacattctcatggcacaaaaagttaaaaggaacaatataatgatacaaagggcaacaaaaaattgtgaaagtgatacataggaaataaaactttctcaaaaaaatcaacataaagtctactacgagcaaatttgataggtccaactagccaactagggaaatgccaaacataatattatacattgttcaatgtcgtttcagaaaacttttgaatttgtgtcccataatactaagtgacatttcaaagagaaaacaaaagaaagatgaagttcaatcacaagtgaaatcaaatatatgtggcaacaatcaactagtgtagcgtgtgtttcaaaatttagattctccttaaactcattgggttatttgaaaggctcagcaccctcattagttcgcaacttttaattgttatctaaatcaaattatatggccagaggataatgagcacaaacaggtgacaaatgtcaccataattatcgcaaagtttctgctttgcacaaattcgaaggttcattttaaaagatggtttgttgtgggttgcttggaataaaaaatcaacaaaaccattataggataaaagaataatttaggtaacatgaaggcaacaaaaataatcactattgaatcctgtaaatcaaaatagagttattcacattttactgctttgctaatgtattgtatcacccaaaccattgaaatatatgaacaagagaagtttcgcaaatagagaaatcagatgttcatgtaaaattggtaggaaatttcaaaccttcgatgaatctttgagttgctccttaagacccataacataaggaatgagaacttgaatcagtggaagctgttcggtgatgccattagattctcgagataccgtaaaatgtatcaattcggaagtaactgtcagtttaaataaaatgaattagtgagcttccaacaaaaacatgggtgtaaaaacagttatcttgaacgtaactacctgcgaccaattacagtgagtatagaataccagaggtcctttaaactagcttaattgattcaataagccatcctttttcagcttcttagcttataagcccaaaatttcatttcaatataagtgatgagcttaaaaaattgcttggaagaagtttgacaccataaggataacagttcaaagatttctaccactagaaagcatatttctaccactagaaagcaacgacaaggttacattacctaaccatgctcagctttcatctgatctctaatagaactctatgaatcaaatcatttagaaaacaccaaattaactatgcctaccgttgccgataggatgctttattgaagataaacagcagcacagtagcatgccaacccagatcttggcagcaacgacgtatgtcagtagcaacagagtatgagctctggattgatgacagccaatgcagaagccacaaacttgacgacaggaagcaaaagcagtgaagacacacttgccactttaaatcctgaattcttcaatgcgccgtgagatatcacagcgagagagagagaggaggacgcacagggcatggaaggcctaatggagaaactgaaagagctggattttcggcagatcgcttttccaaaagaagatagcttcagcttcagaatctgacttaaagctggaaaagatccatcttttgaccaagcttgttgatcattgaaattagcacagaagccacagctcaagctctatctattacatacacactcagttgttcttcgcaacctccatgatgagcagtgctagacgagggtggggtagatccacaaatctatccttaatgagtgcgcagaggtggcattgcagatcataaaggacaagaagagggcggtgctaaagcagtccgcaaggttgtgctctgcaacagcatgcgatgacaaggagaacatggaccctcaggccagtatggcagccccccgtatggattggtgctgcatcaaagacagtgcacatcaaaccccaactgtcaccacctccctccaaacaacattactgccacctatagctgggttgacacttatgtcaccgccattggcctcatcgccatagcgcctaagcatgcactaacaccaacccatttacactaccctctagaagtctgcaccaggatttgatctttttattagaccttgttcagaactacattgaaattttggaaactcttgttgaagcctaataaagcctctcgcattgtctatggtcaacacctggaaactgcactttgtttttatagaacctattgaagcatgaaacatgaacactaacatgtcaaaacctgaaatctggtacgctttttgtactgtgctgtgaaagctccctttttatgagttataccagagttaattgctggttaacatccaaatgtgagtatacaatattccttattcctgaacttaaactatctacgaatttgacatcagaattgtcaagaattacacaacatcactgcaaattggcctgcatagactcaattctgcagcaagtgaacagaaacaaaatctaaaaatgttactgagatcaacataactatcgtaacaataatgtactaaaaactgatcaattgaaaagaacatgaagagaaagtgatgataaactaacggatgatgggtaagtaaaatacaatgaaattttgatcatatacactcagtaccatttacagctgcctccaaaaattggtcagagttcaacgaagaaagtgccgtatagaccaaaggaagcgaagcaagattagatgcggagattctggcagaaagaataactcagtaaattcctgaggccaatactgccatgaagcagatgtttaatatttactaagaatagaaaatgttcaatgtactacaaaagctacattataaaggaatagagtgctattagattaaagtccaataagcatacccatgacaaaaacgaagccaagaagcaaaaccctccagaacctgaaaaggaacaatcaggttagctacagataaacctcacataaattgatttatgtttacagattgcagattttatgcatttttgggttgagatcaagcatattaaagcatgcctgaatgtgatattgctgtctggaaaggctgaatgtttctcaccatctaagtatattaaagtggaatatgaaattgacatgaaacataaaatagcaccattctcatataccaagataatgagaatagcacattataaaccagccctccagtcaaacctttctattagcctaggatgtcatctgtcataatataaccaatgaaatgtggtaatagatgcttcacaggagatgagttatgaataactttgcagtgaataaactgcctgttatctctgaagagatcctaacatgcaagcttaaaatatttatcctaacatgcaaacttaaaatattttctttgccacttaagctcctaaggtgccaatgaaaaacaatcttgaagagaaggaaattgacctgttctttcagttgatcaatacccaagcaagcagtcaatagactaagtgcaacttcggctgatgaacgaaggtcattctcaaactgtcggcgcctttcaggacgagctgctattttatgactagaacattcctgaaaggacatcattgaagaaaaatgaagaatatgctatagaaatctgagtagctggcagtgtcctaaaaattggctctaggaaccaggtagccgcagcaatttggcatttgatggtgcattatgcagctgctctgcattgggggatctagttttgcaatataaatggtgaacagtctttcttttatgtcatatatgctcgctaactgcttcaaagtccctagccaagttggtcctgggacctaggtgcgccttggcggcagcaactagacgctcctaccgttaggcaccggcctcactgaccctctaatgtctagcgcctacttgaaccatggtagctggtgtacataactctaaattcaagcatgatcatatatgcacatggcaaaattacaagcataatagtacttatgtgatttaaaatagatatctggctacaggttcataatatttagaaaatatgtcaaaagtcattaatgtgattcatcaaaagtctaacttattattcagaaatagcatcaatcagcatgtacaatctactattactaaaatatctctcttttttttggaaatggcaaaaggacaataaaaaaatgaattgttttacttcaactcattttcttttactcaagacaataaccacaaaaatggtactactttggtgcttcctgtgcacaaaatataatagcacacattttacaaggcattgagatcatatttcagctttctttaacgcaaatccttcagtgtcagaaggattcatggtacttctatatgagttaaccaaactacaggacagacttgaagtaaaactgttcactcctatataggattataaagataggatgaactcagcgacatggaaacaatagggtatatgataggagtccatatgaggctagacatgtatgtacctgtggcaaaacagttagcagctcaaggaagcttgggataaagtcttgttgagagttcatttcatcacttagccaattcacaatcccaccacctccccagtcctctacaggtacatgcaccgcaagagcagccattgcaatgcaaatctgaagatggcacaaaaggtagtttgccattataactgtgaaatacaaaattgattgcttaattacaagctatatactcaaataaatgtggtcttagaatgtgtgcaatcaaactttgatatatttttttttgctactaatatacacgaccgtattaagatttttttgctactaatatttttttttgctactaatatgattatatttttagtatgctgtgagtatataattacaaaaggtataagtcaaaattgtgtactggtgattgtatcaatatcctaaatgacaagtacaaaggaatggaggtagtatagattacctgtgttctaactttttgtggccctttactaaattttttcagcaatgcctgcagatacatcacagttaaatgaaacaaaacaagatcttcacaagattatccaaatcttactagtaaaggtaaacaaatccatcactgaacatgacatgacataactttgaaaaattggttttattttattttgagcaagtgaaataacgcctattatcaaacagaaatggcagccaaatagaagactgattctacttgatacaacatttagttgaactgattataatatgctaataagaaaagaaaaacaagaacttcaaaaactggtgcttacatatagagaatcttgtagcggacggaaagcttctgaaggtaattcttcaaagtccctttgtacctggtattgggataatttaaaagataacaggaagaattagaccaatttcagagttttttaaataattagaagagaagcagtgatacatatcaatttatttaccttgcttctgagggtttgagagcagaagatttgagtctccatattactactttcatcatgaagtaagctgtcagctacctgcaaattaaaaatagaaaaatatatttggatgtcatcaagttaactagcatccataaatttactaaaagaacagcatccgcaaacacaaacaagatgtcactgtaacagggggaaacagggatctgccaaacactgaagagaagagagttttaaaggggggcctctaaatttactaggagtacacagttacgcactacacctacagtaaaacagttaaataaggaatatgataaaatttaataacacaaaattaaaaaggtgagtgggagcataaaaattctaaggaattctcttcgagtcacaaatatacacatccatgcgccgaaaatctatatgctgatttcatcatcctccatgtttcacttcggcagccagtccataagcttgtgtagccacattggtaagccacacatcatagcacaacccaatggtgagaactgagaacgaacctaagtttgcatcaaacactagcaagctttaactcatccaacttgcataaaagtccacgatgctgaactcgatttcccagcaaatatgccacgatctacgctcagtatccaaaataaaatctagtttgaaaggtacttcatgattcaacatactaataaagctgctgattaagctctaaccctaagttcaccagactgttaatgcatcaaccgtagcctcaaacgtaggaaccaaatacaatgtgcaatcagtcacctaaccagcggaacagaagtccgctccaacaaatatcagatcgcaatgccccctcccaccccccaacacacacacaacaagggccagagaacgccccctccacaacaaccccgctgcggaatcagcacgaccgcagccaaaatctcatcaggaccaacacaactaacgaaccccaaacaggtgcgagatcgagacgattcggctcgaggaaggggaagggggaaggggcccagacctgccacgcgtcgagcgtgtgctggaactgctgcagccaccggtcggcggcggtgcgcgtggcgtcgtcggggtggtggtacagcgccgccagcgccttcttcaccggcgacgtggcctgcgcctccatatgtcccccccacacgcgcggcgcggggagccccttcttccacacccacacacactagcaccaccaccagaaccctaccctcgccgccgccgccgatgcgatctccggcgagttcgctggatctgccggcgggtgggggtgggggtgggg

SEQ ID NO: 30523 - DNA, 13832 bp, Oryza sativa
  unsure (1)..(13832): unsure at all n locations
ttgtttaagttttctttttgttttttattagtactccgaattaaaatctggttttatttttggcttttgcgggagattggggcagtggagcttccctgggcgtgagctggggtgtctctgtgcacgtgggcccgaatgatcaaatattaggagattattaagtccccggtttttcttaattaacgtagtacatttcttttaatgatgtgtttcttgtaaaacgtttttaaatataaaagttgctttgaatataaaatagatctatttttaagtatgtaataactaaatactataaaattaattatgggctaatggttgaatacgctaactttatttttattttgatctatctaaaacaccacctaaaagagctaccgtgggttgggctgttgaagttaaaatgccgtaaggtttgtaattgctctttttctctaaagagaaaaaattaacagatcaagtggataaaaaggatactctttacaatcatgacttggtctagcaatgattcggtggcaatcaatcatctagcaccttgattgatttatcatctgctcgatggcacacaacataacaaacatatctctttttaaaagacagattaagtcgttaacatcttttctcataggttcatagcatgtgatccatccgttttatattataagttgttttaatttttaagtcaaatttattaatagtttgactatgtttaataaaaatataacaataattatagcatcaaattaacggtagcgctaaaatattagttcgagcaccgcacaacgctttcttcttctgcttttctcttgtttaccacaccaccattcatctgcatctcacctttcctccgtccgtttttcttttcttttttaccacctcaccttccgtgtttattttttctcttttccatatgcttttctccctttttaccacaccaccattcctccgcatcacaccttccctccgtccgtttttcttttctttttttaccacatcacctcgtgtttattttttctattttccatcttatccatgcttcatcaaaaggcccggtaaaatattaaccatctagatttttccccttctcattccttctctccagtttctgttttttgcattttagtaccgtctagtttttctttccgagtttttgtattttagtatcttcccgcgtttcaaaagtaacgaatttactatgtggagttttccatttactcccagctttccacatctactcattcaaaagtaacaaatttactcgcataaatgctcccttcaaaagtaacaaatttacttgcatgaatgcccccatatcgtactgcataattcctaaatggtcgtaaaggaattactaccagcttataacgctactaattcttttactagtgttatgaatattgttcagactttgtgatctgcgagtaaaacaattaccaccttcctctcgatatagcccacgatattgtagccaccgtgtagtaatatgtttactgtttactgatatgttcaatacacaatataagagtaaaaattgatactaagagtattgttaatctgtattataaaatggtcatacgaatgaaaaaaaatgcaggctcaatcacacacgagtgataaaattactcacaagtgaatcaaactagaaaagaaaaaaaatgattcagccaaaaatccatcgtgaagttgggatcctggtggctttgttggatcttgctataaggatggagaggttggtctgtgtcttgtgactggtgctgaagagggcaaccgggtgattagcagtaatcgacgatggaatcatggaaggatgtagcggcgtggtatagaggtgagctcgacgttgcatggtagcagccatccatcatatagtaagcacgaagaaaatgcaaaaacattatcgttcgtgtcatagagacgacgagcgaaagaaaaatagcaaacaacttccatcatcgacggactccacactatcctctgcggacagccacatgaagcatgatgtgcaaatgtaggacctgtgcagcccatcaattcagatcaggtaatattggagattgcacgttaatttggtttgcaaaaataaattggggcttcatgcgtgaaggtgaatgagagtatgcatgtaacattgaacatatgagatgaatgtggaataaggcatgattgtgcaccataagtttatctttgactctttgcggatcagggtcacatatgagatgatgattatgggctgatttggtttgaagctaaaacttgccatacaaatattggcatttttaatagtaattctagtaatatttggcttgctaccaatacttgcaaacaccacgtagatattgtcaaaaaatattggcattggcaaaaacttacctatgttttggtattatcaatattttggtatgcttgcaaaccaaacaaaagccttaatgtcatccttggctatcatccacccccttacaagaacggatcgaaatcacaaatcaatgcacaattatcaagatatgctacaaaggccttgtttagaaccaccggcaaattttttttccctgtcacatcgaacgtttgaacatatgtacggagtattaaatattgataaaaaaaactaattacatagtttgcgtgtaaattgcgagacgaatcatttaagcctaattgcgacatgatctgacaatgtggtgctacagtaaacatttgctaatgatggattaattaagcttaataaattcgtctagcagtttacatgcggattatgcaatttattttattattagtctatgtttaatacttcaaatgtgtgtccgtatatataatgtgacacaccaaaactttacacacatatctaaccacccccataaatacaatgactgccaggtaaattctttctttctttagaacttttcacctcgaggacctcaactccttcctcatcaccaattgtgttttgtctcctcagtgtgccctaagccatcatctaaagagtgaaaaatgttgttccaatcaaaataaaaggaccattcccgcccatttgaaaaggctagttattttcaaaagccaaaatggacagattaaatctccatttagggctcctgtggaatgcgtaataagaaaaattaatttagaaattcagaggaatatgaaggaatgcacatgtaaaacaaataatttcaaaatataggaagtttggaacacaaaatttggctaactaattatattagtagtcaatatgtgctcaacttaaagtcatttggtgttatatgacacaatttgcttggacttagcgaaggaaagaaaaaagatgtcaagatggatgttcaaattgtgttcaaattcttgtatagttgaagacgaagaaaatatcctctgtttttcctacatacaaaacgaaggaagaatgccgatcttttccccaaatgatttgaaatatatcctacaatccaaatgaggccttagggcatccacaatgtggtgtaaaaatagtctgcaagcaatagaatattccattcagccacctattaccactgtgcaactagtccatatagaaaatatagcaaaagatacccatatgcatatggactacccatatgcatatagagtacccatatggaataaattatattatctatctctacttttctctcttctcctaatgataccttgtatccatatacattatggagattgccatagggataaactatttatgtgggtcccatcttcttagaggatccaatgtcctgcaaatttctttcaaatggaaagaaaggaaaattcagcgtcttggaaattttgctttcctctattttttccatacctaagagctactttgaaatacaggattacaaaatgtagggatagacagaattacaatactccaatatggtaggcatgtaaaatagaggattaaaaacatagaaattctatgtaaacagctatttgtatgaggtcaaggaaaattataggtccactgctacaaagctttgcttatattttttaatcaaacaactttattagtcaatgactgtgcgacttatttccatagtgttgtcattatatgcttgattggctccttcttcatccaggaaagtaacataagttcagactgaatgggtttgtttcccgtacgtttcctatggaatcgccggaggaggaaaaaaaatcatttgtactgcatgtgaccaaattttcaatccaattaaagttacagcaatctaatccatttttctaaacagataatctggtctttactttatcaaaaagctacaatcattcattacaatgttcttaacttaaatatagccaaacgcaaatataaaactacagtgatccaatccataagaacaaaattccttctttttcctacaatcggaaggaggcctagaaggctaggggtgggcgttcggtcagaccgaaaaatttggtcttggttttcggtcatttcggttttggaaactcatgaccgaatttcgtaaaaaaaaactcaggaccagtaaattcggtctcggtctcggtttgactgaatttgacaagtagcaaagactctatgcaagcaacaatgggaaagtggagacgaaggtttggagagtggagacagaggcggcagcggtgcgatggaggcggcggcggcggcggcgtgatggatgggttggattggaggcagcgctggttagggcggcgtgaggttgacttactccctccctgctgccctctagggtttggtatttttactgagcttgttaggcctcctaggtctattggatcacaattcggtcttctcggttaattcggttaactgaaactaatgaccgaattgctcgaaaattttttggtctgttgatggctgaggccgaactactaaccgagtttctcggtcttattttgtccacccctgtagaaggctagaaagctgcactcattttttactagcaaaatgtccatgcttgatgctttgcttatggtataaaataatgcacacacttatttaaatatatatatatatatattatttacttgtttcaaatacatatttaaatattatataatattagaaaatatcaaggactttgtaagacgtgtaaatttggtggggggttggtggagaaacaatatttaaacttgaaatgagaaaattcaccacctagctggaatagctcagccggttagagcgtgtggctgttaaccacaaggtcggaggttcaagccctccttctagcgttatttttattgggccaatagaatttttgtttctggcccagttcagcctatttttattgggccaatagaatttttgtttctggcccagttcatagaatttttgtttctggtccagttcaagccctctttctcgcgtttttattgggccaatagaatttttgtttctggcccagttcaagccctccttctcgcgtaatatttattgggcctcttacctctattgggctaggtttattgggcctcttacctctactggcccaacatagcccactttttattttctggtccaacatatttttcgtttatttttgtttctggcccaacatattgggcctcttacctctatgagcccaacctagcccatatttttattttcaaggccggccttaagtccattctattttgccacatattaggtcttctacctttttcttggctaattcctactacgtatctttctttagtccaaaaatattttcttcttatcaggcctagtccaatctgttttttgaaggccggtcctaatgcatgcgctcccgaagtccgatgaaattacacaaacacaactttttttcccctggagaatatctgttccatgcaactacacaagttcaacaatctgtcatccaatttgctctcttctgtaacatctatatatactgagtttgataattattctattctatatgattggactacttacattttaaaattcctcttattaacttgaaaagaaatggttgacagctaatttgccccactgtagatttataaaatttataaaattctttgcgtggttttattgcaaattaaacagatggaaatctatgtatcagagacaagacatcctttaactttcttgtgcagcatatgaaagagaagtaacttacattaaagagcaaaaatattttgggtagcatatgaaagaagatttataagtataaacaaaaactagataaaaaatatgtacagcatatcatttaaaaatattcccaattttattgaaagaaaatacattttttttgggtgaaatgaaagaggaatcatttacacaaaataaaatggcacaaacaaaataatttacgttaaactgcagaaatatatcatgtatatcatataattggtaataccatattaaaaaaaatgtgaaaatcaacccaaacatctattttgtgcaagggggctttgaatgttactctttttttctttaataaaggcagtttgggtatttcctaaaaagccatctggtccaatggtacagagtgaaaaatgactcacaaactcatggtctagtatataaggaggaaattcgcaagtcattgaacaaagtgaactcagtggcagaaaatatattctctcttcctgaagagcttggctcaatcagatttaaatattattcccatcattacattttttaaagtacaagaatatcaaannnnnnnnnnnnnnnnnnnnnnnnnnnnnnnnnnnnnnctccttaagtagtttatatatggctcacctacttatgggtatttacacaattttttcatatcactaccactcgatctaattgccctattaatttacttcacctttatttatttatacacttctatcacaaactaccataccttttactaaagcctacatattttctgaatttaactgaactctaacacatgcaaatcattaatattaatccattgtactacttctgctagaagtagagctcgtccctgtacacgcagttgctaccaccttggcgccatgctggttccatctctatgatctctcccatgccatgctcctcaaaccccatcccaagtgccatcgtggcatcgttgttgccaccctggcatgttccaaagtgggcccccaccgccatgtcgtcaccagttggccgatgttctaggaagctgtattgcagcatcgtcaggttaagcagtgcgctgctactaccggagttgtcgttgttgctgcagtggacaccgctaccactgatcatttggtccccaccaccttgcatgagtaccattaatggtggcaccgccgctgaccggtggtcgaacctgtccaccactgtcggatcgggcgatgagccaaggagaggtgccatcgtcgtcggcgaggaggggtcagtagagccatcggtggcaccgggaatgaaaaggtcgctgccactgcttccgccaccctcggcttctattgtcgatggcttcttcttgtcaaacaccctacatagcacccaatcctcctgcttgacacaaaagaatacatagaccatgattaattattatgtgaatctgagcacaccaaattaagtagtagtgcttagctattgaaaaatatttctacgagaaaggtaatatagagctaaggcacacaccttaggttgggagttaggtgtttcaaggcggaactcatgcatgacccatgtcgtcttttgcccattaggggcacggccgaggtaaaaaaccagcgtcttcctcatcccgaccaccgctcgtgttgtaccctcatggacaatccggtccttccccgtggccttccagtaacctgtcttggtcgcacggttcgtccgtgaccctgtcgcatatttccggtctctgaagctgaagaagtaccactcctctgcagtgagcttagccacctctgaaaaaagttaacaaaataaaaactaattaagctctcatatgcatccaatcatcagctaattaataaccatttagtgctatgttacacccttcattaaagcatcaaagttaataataatatacattagagatactaattaactgttgtatctgtacctacactgtagagctaggtacgtgagatcatgagagagggattggatacgcttgcacgtgaagtgttacagcggtcactgttactggcaaacagtgacgtttttataattctctgagtggccctagctagctagaagtggacatataaacaggtcgttattggtctctagcttgcgagacttggagtcttgtgacttgtgagctagctagccaaggaaccatcacgaaattattgccgctaattttatgattgcttgcaagctataatagctagctgatgatcatctcgtgcacattctgtatctatctatctacacctatagctatatgcttgtgctccaaggaaccccaaatgattaactaattatcaaacaattatcaaggcaccaacactgtatctctcttgtgtacagtgaaatttcgcacccgatctcaattcattgtaaaaaaaaaaatacaatacttctgactatgtgtctggacaaagtaggtttgtagggtaaggttaccgggaagctcccatggctcgcgggcgtgaaggtcgacgtcgacgagggtgccggaggcgacgcggtggttggcgaccttgttgcggaggtagaagcagatgagctcctcgtcgctggggcagaatctgaaccccggcggcagcgtcgactccatctccctcagcccggccatcgatctcttcgatctcaaccccaacaaaatcaactaatcaaactcactaatgatcactcgatcttttactctcctagctaaagctagctaagtaacaatagcttggagaagacgagacgcagctagctagagatatagctaaatatgatctcttcttcttcttgggaggcgaagcaatggaggggcttatatagaggggagagggggctagctagcacgggggtttgttaattagttagataattaagattttgggatgatttgggggtgaggggatagaattagattgaaatggtctctgtcgaggacgacgacggcgtcgccatctggcccaaaagatgctcgcctgatgagctgagctgagctagctatatcatatcgatgatcagctgagctatcacgcttgtgggatttgtcagaggctgctgctgctgctgctggtggctagcttagcttgagcttagctgcacgcacaggcccactcctcacaagggatcgatcgatcgatctaattatatacattgcgtttatctgctaggaaaaatagagagaaatgtcccgggatcttccggctaactccacaaggtaacgggctagccggtctgggtttgaagtctcacccattatatttatttgatattagatcattttctaatattcgtgttttttctaggaaaaataaatgtctaaattatttctgcaaccagcagagatcataatatatatgccttttccctaataataataataaatatgctttagtttctcttttcatgcaccaaaaacaagacataccacgttaattgtttttaattcttagatggttaattgtttttttattcttagatggttaatttatgacacaaactggctatttcctttccatttttcctctcacgaatctctaggcagataattttaattttctatatggtctatgataaccaaccaaattaaggtccaattaaatttttcataaaccacatcatttaatttcaattatttctaatcttttggccaactgatcgaagtttgcacattgtgcaaaataattaaagtaagttacgtcatctaacaacacaagctccatcttatacacacctactaccattactatatttcagcattaacccacggggtattactaatataattacgtagcgatcaaaacatactattatccaaacctgctaaatgtaagcgggaaactaatagattttgtctatagcaatatatatattcgatttcgaggacggacgctagctataaatgaagggagaagagactagaaagtgacgagacttcaggagacgtggaagcttgtcacaccaaatgatgattaaaaccaaatccgatatatatatgtacatacgtatgtgtgtatactttctcaaattttagggtcgttacgtgtgtgacaatgttacatggcacgtgaggactttgtcacgggccgggcaaattttgggagaagctataacggcctgtttagttggcaatttttttttatcttgcatgttacatcggatatacggacacacgtttaaagtattaaacatagtctaataacaaaataaattatagatttcgccagtaaactgcgggacgaatttattaagcctaattaattggttattagcaaatgtttactgtagcaccacattgtcaaatcatggtgcaactaggcttaaaagattcgtctcacaatttcgaggcgaactgtgtaattggtttttttagctacatttaatactctatgtatgtgtccaaatattcgatgtgatatcgtgaaaaaaattgtttgggaactaaacatgccctaagtgatgagcagtttaccaattagcatatagaaagaagactaaaaccccacatctccgtcgtcttctgccaagtgtgtaaatatgcctgaccatatatgctagatagcttcacccttgataccttcttccttgcatgctggctggtcaccttaatttgtgctcgatcccctggtggcactacatgtagtccctccgttccagaataatatagtaacaacttttcgtgaccattctaaaatataaaaactctcaccgatatctcatttttttttaaaaaaatcgggctgtttgagatctcactggggaagcaatcaaccattagtgatatgaaggttgatctctaagttcacaaactatgaaccaatacattcacatcactgcaactatttatacgaaccgtgagcttgagacaacaatttcttatatatagtacagtatatattatgtgaaagcaatataaaataaatatttttatacactaaacatacttatatagtttgatgaacgtggtcaaaatctacgtgaacttgaaattttaaaaagctagctacataagtaaaaaaaaagagatttaatatcatattttttttcttggagcatgtcctaattcatcaatacatgatcatgagcggagacaggagtaggatagttatggcaggagccctacatactcagcttaaatacccattgaaaaattacaattcaaaacttattttaaaaaatataggctaaattattgaaattacaatagtccatggacaaattcgatctggttccgcctctaagcacatgttagctgttttaaattaatgcgaaaacatacgaagacacaattgagctttgcatatgctccttaataatcctcatgcccctatagtactactgtctgcattgccaattgacagtcatgcttacatacctggctagctttgttcaatataaagaagttttgctagctgcaaaactatacttaacctaacctagctaactcaataacttaatttgttctatgttgtctatatatatatgccctagtttttctattttttggatggttaattatagcttctttcaaacaacaaacaacaaaatcttactcacgtgacaatgatattgccataacagctgactagctagttcccattaagcaacacacaaaacactatagcaaacttccacatgatctcaggttgttggactcttgtcagctttggtacgatttttaagcttctaagcgacacggctatgcaaaacaaaacacgaaaaaaagaaggaagaaactaattaaaaacgtctcacaaactaagatcatcttaattaatcaacaattagctagaatcacacacacatatttatatatattgcacatacgaatacacactacacacacaaacataagaagccaatagtacgtgtgctcgataatcacgagacatgcatatatgcagtgctccagtagttaacaacacgtcgcgattgcgattagcaataaagagggtgattaggacgggattaattagaaaagggaaggggaatctcgtcgatcagattgcgctctacgtctgtccaaatccatgcccatcaggcaaaggtcctgtgtcgatcgatcaagcagctagctgctgcctagctgatcgatcgatcgattttttagcgcgttaattaattgcaatttcttctccttaattactctggatggcgacattgcaagagattagctaatgctacactcagctagctgttaatgcaattgattagtagctcttgcaaatgcatgctgctgttggatttatgtgtggttaatatcgtaatcgtgtgtgtgttcctgtcaagtgcatccatggattaccattaaattaaggggcactttggaacatacatgaaaactacatactctcatgcgttattaatttggcaggaattatatatgcatacggtttcgtgcgtacgtagctttatttgaaccaatattttacttctccaggattttttggagtccattacttaaatataagcatgtatatatatatatatatatatatatatatatatatatactgtatattcgagttgtactgtatttatatgtcgaatttgctatatatttgttgataaattttcctccaaaaatttgtcaaatgtaattacaatacaatcgtagtgtaattacactgtaactataatgtaacttgtatgtaacttttaagaatctctcggtaacatgttatttcagtaaaatagaggtcgtgggaacaaatcctttcatatatgtgtgtgctgtgatttttttcctcaccagaacaaatcttgtaatagatctaacgattcaaaattacgtgaaacttacgtacaagttacactgtagttacatgcaagttacagtgtaattacatacaagttatagtgtaattacactacgattgtactataattatatctgttaaatttttagtagaaaatttatcgataaatatataggtggtctctttatatgtatactcccttttccttacccagaaactagacacgtgaatgcgctagatgctccctcctcttattccatgcattgcgtctatttgtgcatgtttgccatgagactctggagaaggtgcgtgtgaggtgactctgttagggtgagtttgaatttaccatttcatctattgtttttcacgtgcatgttttctaaattagtaaactatatttttttgcaaaaaaatccatagaaaagttactttcatattattattttttaatttttagctaatatttgattaatcatgtgttaattcatcgtgctccagtttgcatgcatggaggattaattagtttccaatccacaataacgaacacaaccctaataaccctactaattagtgcttggagcagatcattgaattcattttggtgcttgtatgtacaattaataccggtgtaacagagtcagtagggggtttcttgtagtgacctcactgtcaatacccaaatttagcttctaaagtaagaaataggtaaccatagataaatttggaatgaacttagatttgtcacgcaaggccagtctgatcgaaaccattgggccggtcaaaccggtgtcatgtggctggtcagaccggtggtgttcgactccaagtccgatttgtcggttctcgggtttccttgttaaagcttaagattttaaagtcttaattggtttctacacctaattagacgtgaaaaaaacctaggaaataagtttacccttcctataaatataatggggctaaggccgactgaaaaaaacaatcaatcatcaaaattaacttatttagccaaaccctctatattctac

SEQ ID NO: 30524 - DNA, 1068 bp, Oryza sativa
tcatagtactagaattatatgtcgtccatctactaaatctcttatattgggacggagtgagtaccagctaatagttatatataggtattgaatatattcttcatgtaaaattctgcaaatttcaatcaaatttccgattacaaaatctgacgatattttggcccacacagcgaccccggctggttagattagccagcactaggcaataatttaaccaaattactcaattaatattcatacaataatgttgggttgccttggtgtttggggctattcgtgcttgctacggcttagcccaagcaccagaaaagccctcgttccattatcgcttgagatatgtgcagtgtacactacgaccagaaattgttctaagtactcttgtcacaatgtcccaaaaattagagataaagttaatatatataattctaaaagtgaactaaccagccgagctacctttaattcccaccctcatagatacacacacaaaaataataaccacacacacacacacactcaaactttcttgattcttgataatcttaggcttacttataagatcaagagtctactaagatcaagagcttacttctgaggcttaactcttatatatatggtcctaattaagttactctttcgagtaccctttatttttttaataagtattctctctgtcttaaaatatactaatatatatagctaattttaggattcaaatttatttcaaaatataactacatccatttcctcatctaaactaatcacacttcttgctcgattcaacttttttacatactttctcatcttaaccaatcacagctagccatttctcacgcactaaacctaatttaagaaatgacatgcataagtagttgtattttgagatgaagagaggaccagtgataaaattttggtttaagtattaaattatataaacaatgattaaattaaacatgcatatttaaggttgtgcccatgtgttaaatgacacacacacatatatataaagaatatgtgtatatatatatatatatatatatatatatatatatatatatatatatatatata

SEQ ID NO: 30525 - DNA, 1270 bp, Oryza sativa
  unsure (1)..(1270): unsure at all n locations
agcgtagctgaaaattacatgcatcgacgatggtcttatcctgtccaatgatcacacgacaagtatagcagaagtactgtgttgtgcatcttcaagcaatttgcatgcactactgtgtgtgtgtgtgtgtgatcgagttgatggaactatagcaaggcttatggtgtagttattttaatctagtgcagtattaggcatgcattgatttatgttttatctcattaccacacctagctaggctacaatggtgcattttggcttatatacagggagatggattggaattttgttcctcaaaggatttcacttctttctttatatatcatataaatagtcatattttttttaaaaaaatcacaagataaattaatatgcgatatttcacttcataaacatgaccttgataaaacactaacgagtatacatacattcacaattatatttattattttttttaaaacttgtagaagtccagtttgaatttgtatatttatgaagtgatgtatcacagtataatctatactgttatttttttagttttattcataactagttaaatatgacatgcaagaatcaagggaaaaaacacttaactatattgagagattggaacgttggtggttgctggcaggcaaacccccattttactcatcatgacaccctactttgaatatagcactatactagagtctccatattgaacatagaaaatatgcacaaacacacattcttccttacacaaattaaggaattgaagtgagactagcaactattcttccacacacgcaagggcggatccagcgtgaggatctagccctagccccctacatgctggatctccatggagagcaaggagagatgggagggggatgtagaaggcaatgaggcctccccaacgtcaagctatatcttccttgcccacacggtaccttcctcgtgctatttttggttgcgcatttctttccaatgccgataggtccctttcgtctatactagtaggggtgtctgtgagttgcaacgtgaaataaagtagggattaattgatttcacatcacatagggtgaaatgatgttaagtaatgattaagtataaatttattgtaacgaaaattttaacatatcacaaacgataattatgtcacattttttacagttttatatattggtaacatgagcaacggaaattgttgaataaaatggcacagtattttcctaaaaaaatagcacggnnnnnnnnnnnnnnnnnnnnnnnnnnnnnnnnnnnnnnnnnn

SEQ ID NO: 30526 - DNA, 257 bp, Oryza sativa
ggaagaaacgatcaggaaataatcaacctaattaattagatgcagtagcagcagcagcagcagtagcaagcatggagattaatccgtagttttgctagtagcaagagcagcctagctagggatcatagtggagtggagtggagtggagtaactagtgcatgcgtaggaggctagcagctcgttttccggcgatcttggagcaagctcggctcggctcaagcggcggcgccgggaggaggcggcggcatgtggtggtg

SEQ ID NO: 30527 - DNA, 20880 bp, Oryza sativa
  unsure (1)..(20880): unsure at all n locations
tnnnnnnnnnnnnnnnnnnnnnnnnnnnnnnnnnnnnnnnnnnnnnnnnnnnnnnnnnatttcatgcgagttttgctccgtttttgatggatttcatgcgagtttgctcccttttttgatgggattcgatcggttcggcgacggagccggaggtggtggggtggggagttttggggtacgagtgtttttcaaactcgctgaatttcgtcgaattcggatctagtgcatacatgttaattaaggtgttgttcagattggtatcatttcaaaacatactattttttaagcaagattgtcaaagatatatacatttagttatttaccaaacttttataaatacataaggaatcttaccaaaacttcgcaatattaatgtcaacttatcaaaatttagatattactaatatttggtaataaggtttattatttcggctataatctaaacactacttagtaacagtgatatggataagattatggcgtactgtagcagaatactgtagaagaaaatcagtcattagatcacaaaaacgcatggctgtggttgtgcagaagttgttgtatattgtgaacataatagcagcgacgaagttcgttctcaatagcatctggccgactggatctcaattcggttttggggtggttgtttggtatcttactgtagcatgatgtttcgtatatggtgtttggaaaatgatacacgtacacaattttgttatccatcgacatcttcaaaaactgatgtgccacactgtgcattgaattttgattttgttttcataactgtccactagttatgtccaacagttgagatctttgttactaagctcacggtttagtaaagatttttctaatactataaaagcggagtagttctttctttccacccctctctcaccagtgcacgcgggttggctaatcaccagatctaatgtttgtcgattactcttctagcccatatatgatacaccctagttatatgggcatgtcatgttacaacatatgtgcatgcttctacttaacctttgatggcattttcaaccatatcattttcagcaaagttgccaaaaaaaatgtctacgtttaatttgttgccaaatttggtaaatgcataagaaattctgctaattttttggtaatattaccaaatttggtaaggtttattttgactacaatctgaataggccataagtaatccagttatcacacggttaccagctatttctttgccaatattgtaagtagcaattttgaggtatccatgatatataataacacaaatgttcgttcaatagttttgaaacaaccggtttacaaagtcggctatcaaatttaaaccttaggcaagaatattttgctttcatcggaatgagttgtgctccctagcttgtttgtaaaacactagagagcctactactactactacctgttggtgataataagcactgtagttgatgtgctccctcttgcttgggtcacgttagatttccatatgtttccggtttcttttttggctaggaattgattttggggaaaaaaatcctgaaagctacttgttatatttgtaggttttatagatacatgaaagaaaatgttttggcttatctagaaattggaaatactactgtcggggctcctttttaaatgtagaaatttcgcaagaaattgtccattttcaacttctgtgctaaaagaactcttggtagtagtcatgagtgtaacctataattatccccttcatatgtttttaactgaaaaatcatcatatagatcaaattttatgtatttcaaacaggtttgttcacaggtcaaacttttcactggcaccatgaactaagcggaggtagaagcacacaattattgtgaaaactactgtcaattattaacatgtcgctgtcctactatatatgtcaagtaacaactgtttgttccctaccttaaatatttctacatatagtatactccttctaaattaatactccaacataaacatacccaaaagtagtgcctaattgtggcgcagatatgtgcatgcatacgatggtcttgttttatccatctgatgattggtcacctagatttctctcccgtgaacatgtacacactgtggctgtgtgcgtgccggtagttttggggtcacatttagttctttgggttccttgggagtaaagttttttaagtatacgaacacacatttaaagtattaaacgtagactaataataaaataaattacagatttcacctgtaaactgcgagatgaatttattaagtctaattaatctgttattagcaaatatttattgtaatatcatattgtcaaattatgatgtaattaggctcaaaagattagtctggcgatttaaatgcaaactgtgcaattggttttttttcattcatatttaatacaccatgcatatctccaaacatttgatgtgacagaaaagttgaaagcttgaagaaaaaaattttgaatcaaaaacacggccagttgattttggacgacaaacacacaagcgctagctttcatctatcgatcgtcagggggcgcagcaaaaccccacagccagagtgtttcttcgcttgtgcactccgggagttgggttcagtgtgagcgacactgttgctgctttgactgcaggacgacgagagctaagctagctagggccggggagcacgggtgagatgaatgaaatgaagaggaggagagcgagcttggattgggcgggccaatggcgctcggggcaagttgcgcttacggcggccaggcgtacaggagatttgctgtgctgctacagggcacttctgcggggattgttctccatcggtagctggcaacgtacactgcccaattaacaatagccaactgcccaattaaaatactttggtaataaagtaagtgaaaataataataattctaaatttttttaataaaacgagtgatcaaacagtgcaaccaaaatgttaaaatcccttatattatgggacggagggagtagtatcttaattcactaagataatacacattccgttacacaatttaaactgcattcatgggttttttatccaatattattgttcgtcttatttaaatatttttttatgattagtattattatttttattagatgataaaacataagataaataatgcttgacttaaataagatgcacagttaaatattagaaaaaaaccaacaaatacacgtaaaataaaatggatggagtactacataaggtatatgaggctagctccattttgaaacacgggaaaaccacataaagtttgaaggatttaaatactactactctcctataagacaattttcactgagaccctttggataaaggattacagtaggtacctataatttctttgaaatttctatggatagatatttcattgcaattttagaggatttgtagcataaactccaaacctccttcaaaattttcctttcttcctagctacctctcaaattcttcaaatgacgtgttttgcccgtgttcaattcaaatggttcttatgctgttttcctatgatctttgttgcttaaagattcaaggtgtgaagacagtctctaaggtctccttggggagcaataattttgtaaaggaatttaacgaattgaaatcctatgagaaaatgtcctttgagccctgtggattttatgaatggatttcgaaatttggattgaacgcacacatgcataccatatctgtatgagcatctcagaaagacttgtccagtaagtcttgacattgatgaagtcatcatggatatctgccactaaaaaaaataattagccataaatacgggtacccgtgttaagtctagaacttgaatctatgtggacttatttcactataaagagcctaaccaattaaattaagttacattcactttgcttaaggacatataattacacatactgccctcttcccatcaaatattttaaaaacttctatttttataaagtagtaggtcatacttttatctttaaggacttacttcttccatttcatattataagactttctaatattgcccacattcatatatatgttaatgaatctagacatatatacgtgtatagattcattagcatccatatgaatatggataatgctagaaagtcttataatatgaaacagagggagtatatggtaaccaacgaaacatctccttaaattattttagaaagcaagttttagtaaaattggtttgtcttgaaacttataagctcaaaccaacaagttatagtatccgtaacaatgccttcggtagtgtacggtgatagcacctttaaaaaatcttagtgctagtattattattcttttccaattttggatttttggtttccgtttgcacgctccataagttcctaaatagtgtgtttcctaaaatacttattttaaagcaactttttaattttgtagtaatttatttatttgtttgtgtccttaaacatatactactcccgtctaaaaaaatccaatgattggattttttttttctttaccaagggggtagctatcaaaaatcagataattcatctgtccattaatttcagctatctcatagggttattatatatacttcttctatccataaattaaatataagcatttaaagtgttttaaaattatctataaatatacaacctgctatacgtacgactcacgtcctactgtctcacgtctaccaatcactgagcttgttatcgtgtgggccagacaagcaacacctacttcctccgtccctaaaaccaacctagtactaaatgtgaccctaggactatgaatctagatacacatatatccagatttatcatattagaatatgtcatatctgattctagattcgttttttctggatagagggagtatgcatttagtacatgcatacggaatactaggttgtaggagttgtacataaagattggacgcataggagtatatcatttctcattcttatttttttcattttaacccgatcactctttcaccccaaccattctcactaaagtttttcacctcatccttaatctctttaaaataaacccgaaactagaaatactcatatatatatatatatatatatatatatatatatatcgggtggagggaggagaaatagtattatcttatttataaatatatactagttttttaatgtcctgtcagttagggcctgtttggcacagctccaccccttctagagctggagctcagccaaacagtttcagtaccaccaaaactgagagtggagttgggtggagctatctcacatctcacaaaatgtcctagagttgtggagctgggtttaggcagctccacaactccactccagactcaattcctggagcaatatttaggagttagagctgtaccaaacagaccattagacaatcggtcttgctctatatgattcagctagtgaagtcttttataatttgttttctctcaggaatacttcgtctttgttaattagcgcagttagtgaattacacatcactcattttgcaaaagtaagaaaaaagaattacacagcatatatcactcgcaattttctccatcttagtcagtcattaatattttgacagaattattggtcgatgatatgacgcaagttggtactatactccggccggctgctagggttttccggttactggccaactccaagccgccatggcggcccccgccatgagagatcgacagtgacagctagctagctggagctagcacgccggcaacggtggcccccgccggcgacagatgcatccgccgttccaggacgccgtacgtctcgatcgatcgatctcactccggcggccggtgacgaagacgaagggccggttcaagttgaaccaaactgattactactattacactgaaaactgacgcacacgtgatatggatccggccacgaagaaattaatcgcgttacaaacggacaaattttcctacattgataattaagtactagtacgtacagggttgtttatttagttgcgctgttagtttaatttgctgcttaattattaattaatcgtcacacgtggctgttcctcttgtctcttgtgacgactgatctactactagcaacgtagctagcgaagccattcccaattcaaaatactagaacatagacggtgtttcctgaaattggagagaagtttagaaaaagttaatagtttagaaaaaaagttaggagtttatgtgagtagaaaagttttggatgtgatgtgatgtgatggaaagttggaagtttgggggaagtttggtgtgaactaacataccatagttttcataaactttacatcataaaaaaaaactatcactagatactactctttcaatgcaaacaccacttttttatatttaaatttaataatactacttatctcacatgatatgtagaaactatgtctcatacaagacctagttttcttctcttttctcatttattcatttgtcacatcatctttcatcggtagcagcttatttaatgctatggtcactattctagtcattgggttgggaatgagggtgtgttcagttcacgtcaaaattggaggtttgattgaaattgaagtaatgtgatggaaaagttagaagtttgtgtgtgtaagctgagtttccaaactttatcttccaacttttaactttttcaacttttccatcacatcgttctaatttcaacaaacttctaattttaacgtaaaactaaatatacctaaagttttgatgtgatagaaaagttaaaaattcaatgaaaaagttggaactaaaccaggcctgacctgatatgacttgatttgcaggcgctcctgacctgatgcaacgtacctgctccaattaaatgcaaacagtgttcgtacttcgtactactacgatcccatcagctggtaggagtaccggcccgttgtttgcaatactcccctccgaacaaaataacttatactatttttttcctcaaaatatagcaacttgaaattaaataggacaaatcctaatcaaataaatatggctaagagagtgtgtagattcgttaaactatcggccgtcatctttccgcttatgcttattaagtcaaaatttaaactttcgactttaaaattagagttgatgtaggggagttttcatcgaaatttatttttcagcatttacttttatgtcgctaaaaatacatatataaaatttttattcacaaattaattttttgtttgcaaatatatcgtttcgcttatttgctgaataagcgaaacgatggagccatatgatatatcccatccaatactagattgttatattttgggacgaaggtaataactttttttacagagagagtatgttattgtgtatttccctcgtttcataaaaacaaacctacataatgtaacacatcctttacatcatagtgctatgaatttagataataatttattcacatttataatattatgatgtgcgacatcttatatcatttattttttatgggacgaagggagtgtgctaaattaaatacaacatgtctcaaaacatatctatatagcgtttgatttatgcacggagtatataaagtgaagtggtggatggttgaaatttgttgagatgagaagttttttttttgtcgaccagacggtgtgataattcattgtatagagtaggaaaaaaattacagagcagacaagaaagaaagaaagaaatgataaagatagctgctacttctatagttctatgtactccccccgtcccataaaaaaaccaacctagtaccgaatgtgcacaatctagtcctacgaatctggacatacatctgtctaaatttataggatgtactaggacgtgtcacattcggtcttaaattcattttttatggaacgggggagtacctcggagcccgaaattaaatactgatttaaaaatgtttttactaatatttgtgtactaatttggaacttacgtttggaaaaataagcgataaatttgtccctcgatcgactctcaaggttattgctaaaaaaaaattttggtactagtaaacctatacaccaatattccagtacttcggaagctaatctttatattgctgacttggaaaatagtagtagtatgattcatcagaatctagctgcatccgactgcatgtagcagtaatatatattttcttcatgtaataatataatttttctcatggattatcttgaaatgggacaaaggaatgtttcctactgttcctttctaagttggcgcgttccatttgacttcacgctgcatatacgctctttctcgaggacaaccagttgaatagtagtaatactcctgtcatgaaattgtactcttgattaaactaatccagtatattaaccatgttaaccactgctagttaaataaatcaagagacgtcagacgaataacagtaacaagcagtacagacgcaagcaatctctctccccatttcaagttccaacgccagctagctgtagaaattctatgcatatgctgtgggcctatttggtttccatggacttatttcaagtccctaagttcctatcacatcggatgtttagacactaatttagattattaaatatatactaattacaaaacctatttcataaccttggactaattcgcgagacgaatcttttgagtctaattacgccatgattttgacaatgtgatgctacagtaaacttttgataattatagattaattaggtttaaaaaattcgtctcgcggattagctctcatttataaaattagtttttttactagtctatgtttaatactttaaattagcgtccaaacacccgatgtgacatgggctaaaaagttttaggcccatataaacaccccctgtattctctccagtggtaaaaagaaggggaacgagatatcgccgtccaaattaaattgcatttgttttggccatatatgcaaattaggccctgtttagatagaactagagtttttaagtccctatcacatcggatgtttgaaaattaattataaatattaaacgtagactattaataaaacccatccataatcttggactaattcgcgagacgaatctattgagcctaattaatctatgattagactatatgatgctacagtaaacattctctaattatggattaattaggcttaaaaaatttgtcttgcaaattagctttcatttatgtaattagttttgtaagtagtctatatttaatactctaaattaatgtctaaatatagagactaaaattaagtccctggatctaaacaccaccttatagttggaagtaacaaaaactacgagtaaaattcttacagtactataaacggacttaggttacgttggagagtgttggagaggaggagaaagaagctgattggaaaatacgaaatatgaggttagccactagtatataattaattgattatttaattatcttaaaggtaaaaatgattaatatgatttttaaaataactatttatagaaatatttttgaaaaaaaatatatggtttagcagtttaggatgtgaagtgcgcgaaaaacgaaggacatatttctcgccattgtgcttcaaatggacacgctcttagtgtagctcggcccgttactagtttccgcttgtggagaaacctgtcaatccgaatttaagttataggcttagtacatgtgcttgtatttatgattattttttttttctagacaacgaacatgttgataacaaggtaataattttgatgactcatcgaaaacaatatgttagcctagtcattaaagttgattgtgaaggtagttgtgaaggttttcaagtaccgagtttgatttgtgaagttgagaacctttccctcctagatgtaaaacgaaatagctctttagcacataattaattaaatattagctaaaaaacttgaaaactaaattagtatgattttttaaaaaaacaaaccatttaatagctcgaaaagcgtgcacgtaaaaagttgaaggtgaggttaggaaaagtcatccccgaactctacctaatttttttcttcagcaataataaaaattgcagattttagcaactaacaaataccactttattcataaggataacatcacagttcacatatcactttgtctcatactttgagacaatttccaggtaatttttcaaaaattttctgaccgattcggcttcctgacaatgggtagtggccttgttgtatctgtttcagttttcgacaaaaaaagtttcaaatttgttttcgcttccgaaaattttcaaacaatgctttccgtttcttacaagaaaacatagatatttttatagttccaaatttgtcttaccaccttcgtcccaaaataaattcatttttcacccattccacacgtagcaatacaaaatcaaaaaagactaaaatacccctactttatcaaatcacaatataattattcctcattttatcttctctcaatacaactaatccctactttcacaaattgcaatgcaatggttgctctaaaaatgaacttattttaagacaaacgaaaggagctaaaaattaatttaatatgagacggagaaagtatatatctatttctctacctacttactcacctcacccaattgtaattttccatcattcaattccatctcctttggctcccatcttttgccctccaactaataagccgttaacaaatttgatttttaaaacttgattttgatggtcttttttttaatcaaagtttatatttcccctttggcttttaaatcactaagaacacatataaagttttatccataaattactcttattgttaataaattgtacggcttataatcaatcttaggcgaatcgataacacaacccttcatcaatcctctaaaattatttatatttagagacaagtgagtactctttctttctgtttcataaaaaaaacaacttttagccgggaacccaaaaattagttttgcaggggacaaggggagtactccctttgtaaaaaaaaatatcaacctcgcactataatgtgatatattttactacaaagaatctgatatagtatgttgagattcattatattaggatatatcgtatcctagtgcgaggttggttttttaggaagcggtagattttaagatggcatgagtgccgcgtcttttctatcttgttcgttcaatagtctgacaactctactaaaacactgttctttctaagttcatggaggtatggaatattcgcattacacttataaaaaatgatttactaaaaaatttctataaattaataatgtaaaattatttagataacgtacttttcacctactatttgctaatattataatctataaattttaatcaatccagcacacaggctcaaaatcagtaaccaataaccattaacacgaatcacctcatcgcacgtttaacatcagatcgcattgaaaaattaccatttggaggaatacataatttcacaccagaattgcacatcaaccagccacgaaaaggactctttgtgagcttgaggaaagggaagtgtgccgactctttgggctccttggctccacacacccacgtgagatcgatggggacctttgcacagatttttcctcgccggagaggtagctatctcctcctcctgtttcttccaaattcatcttccacgacattgccaaccaaagttcaatgaacatgcatggacgatgtcaccgtgcagatacagtgctctccttttcgtggatgtatacaaaagcagatcaccgttatgatatatctgcgtcttcgtgtcgcgacgacacttcccaagacataatatctgagccttataaattttcggaggaaatagtttttgtcctcatggatagggaacatttcataggcatatcacatcggatcaaataattaggaggtgcatatagacatatggacaacatattcatttaattaaggaggaggatattttgtaggtcatggtatgaagtactcccccgtccctaaatataagagattttggttggatgcgacacattctagtacgatgtatttggacagtatatagctgtgttcggaactgttgcttcccagctccaccgtctcgtcttccgcgtacacgttttttaaactgctaaacagtgtgttctttgcaaaaagtttctatacgaaagttactttaaaaaatcatattgatccatttttgaaaaaaactaaacttaattaatcacgtgctaatgagccgcttcgttttctgtgcgcactgtgcttgttgggaacccatggttctaaacacagctatagaccttattatcacggtaatattcagggtttgccacctatggtggatttttagttttttttaaccttttggtttttaatttataaaatacactatcctgaaacttatttctaaatctgaactttttgtacacgccactccaccagatgtggcaaaacaacattgtcatgtcacgcacaatgcacatgctagtgttgttttgccacatcaacttaggctgtgttcggcatcactttttactaacccatctccctcgtttttcgcgtacacgcttttcaaactgctaaacggtaagtttttgcaaaaagtttctatacgaaagttgcttaaaaaaatcaaattaatccatttttgaaaaaaagctaatacttaattaatcacgtgctaatggattactccgtttttcgtgcatacttgtccggttgggaaactaatgccaaacacagccttagctggtgtaacgaagaataacgctatcacgctaaagaggtagctatggaaaaaaattgttccaccatgctagcaagaatgtcatgattaaaaggtttagatttaaaaataagtttttagaatatagttttaaaatgaaaaatgataaaaaaaagattaaaaaatttctcgtatggtggcgtttcatgattcttggttccacgtatctatggtatctatgacatatgggtactaatcccacaaggcataaacacattaattatagggttcggagctttatgtacaacctctaaatccacatctttaacttgtgaggaaggattaaaaagaagtataatcaggcactttatgtacaacctctaaatccacagctttaacttagtgatttcatcatctccgttactatgtctgggaaagacagacaacttataatcaggccaagaaaattaagaataaaaataaagagggttaagttggtacgagttgtaagatgaattatatttaaagaaacaaattcatataaattgtgcatattttgcaaagcgagtgtattcagttagattccttatggtgtaaccagctcacccaattttaagattttagatttgatatgggtgttcgcgtttatgattaattattcttttagtgatagacccatcgatgtaccgaactagtcagttttaagatataccgaactagtcttttggagtattttttttattttttagactttttattttttttaattttattaatagtcctttccaaaaagtatgacactggcgtggctaaaaggttcagtttttggaaatatttttttaaaccatctataaaaaaattttcaaaaaaaatctctttcagatgtgctcataggataggatagagtatgcatgtgtgcttgcattgtgtttttttttaaagaaaatattgtacgtatttttcattttaatgggaaccagaataggagtacgagtgtacaacctccactagacaagggaggaccgaagtacttaagccaagtgcatataggggttgagaaggaccaaaggctaggcgcttaggttgatggagaggcttcagagtgccacccgcgtgccattttgtcggtgaagcgtactatttgcgttgccagaaaatggtgaccacggtgccatgcaaaatcgtcaatctagtatatagatgtctcattctcacgcattcatcagacatgtgcgtggatgcatgttaagcttctcaatttgtcgtgtggaagactgaaaagaaattaaactcagcagattttatggcaattctgcttggagggcttttcttttttcttttttggctgcataagacaagacaaggaagatacaccaccgatatagtgaaaagtaattttaggataagacttttttacacttgtactcgtggcggttaaaaaatcaaggctgagtttcaaattcgacaaaggaaaccataattaattctaaagttcaaaattagcaatggcttttaagctcaaacaaacggggcaactctattacgatccttgattgggagtacttggtagatatatgcaaaaatgaaggaagaaggaaaaaaaacatggtggatgtttgcgggagcagagtagtacagtttctattttacagctcgagctcatcctaaaaacctctgtatagttgtagctgcagtttttctaaaatattttttactactatattcaataaaattgacatattttgtgttagttcgttaaaaaatgcatgtgcttgtacgatactgtgaaataggataaattaattcatgcaaaactgtatttgtgcaggtggtatagtttgcttacatacctagcttctctttgtttaacttggagtatttgttggaagtaggaactgcaaccggatctggggcaacaaatagtatagcagacctttgctctcatagattctgacaaagacatttacaagcatttccttccaatttacgatgccgcagcaggaatccacaacttctattccggtacaaaacaatttactttgatttcattttgtttctttcgagatggttggacacgtgttcatcctgtttatttctgcaaaataagggctcaacaggtactccataaaatatgaaaatagcaccaaccaagacccatatcatcaggacaatgacaacacaacagcatttcttaaattaattaacatcgcaattagttctttgttccatgtgcttgtgctctcgtgtgtcccagcactacgcccatgttctgatcgttcgaagaggacaaggataccactacaacggtagcttcaaaacgcatgagacaagatgaaaaagcgtttgattaagcatgttaacgtacgtgcgtgtgtgtgctgtgtgagcatggaatttgctcggttttagtgtaagctcctcggttattgcagcttaagagaaaaggactaatcagggtgttgttaaatgctgagatgagtacctgtgaatcgtgtgagatgctgaagccaacaaacaaaacgggacggacatgcaccggtcaagaatcttgaatttggggtttcaaaaattggcatcgaacagaacaattggagatggtgtgtggtgcatgtacgaagcagcagcattgaaaaacaccactggggagaagatgtgtttgctgggtgatattctcagttgaagtagtggccgttctacagcctgacatgaaagctgtaaatgttagtaggtcccaagcattattagatgacactaaaagtacgaactaaaatttgggaggcaagcagcacagcttaaaagccaaaagtacacacttttcttatctaaaaagtactaaatgtatggaacatttccagttatttgacagatgctgtaaaacagtggtcaaatttctaaaactttgaatgctctgttggaaaaacatatatatatatatctataaatgcattatgcaaatgataggatattagtgattgacttccatacttccatattgttactttgctcgtacagggaaaaaaactcaaacgtgtgtaccagcactaaatcaattgtcaatgtgtctaaaaagtcaacataagaaaaaaggaggtatagtggaagcatacagagcaaaacaaatatgtgtgctgactagtatctgctacatcactacgtatatgtatgagatcagattggtaggtagactgtttaaccttcctaaatatcctgttcattttcaggactggattagatgccgatttctcatgccaattccagatttatttggccattaaaaaatggcatcctcccttggatgtggagagtgagagaggaggcattgtaccttagttttgattaactaaagcaaaagaggttccatgatcaagtaggcagattccataaggacgttgtaattcataactcaccaacacagagtaattgttcagtaaatatacaaggaacttgcaagcagattgcaaactcaaggaaacttctaggaaaattgcagttaactttttgctggaacaactcactagaactagattttcagcatcgtcaggtttcatgtgacacattgctttgttagctgtctgtctcttgcatgctaaatttcagtttcaaaacattggatagaacatcttatcagtagctgcaaaattttccagatgtaagaacgatgtaaaacatgcaagaacagtgcacttatatagttgatgggctctcatattccatagcagaataggctcaagttatcgaccatggccctcatgaagacaggtttatcaagattgcaatgccaaggggtgatccaacacaattacacaagttgctatcgatagtacgacgccaatatgcaaagcaaaacagatgaagctgtagtcacaatcaattcctggcataagatagccaccaattagttttacttcacctgaaaacaacagcaacaatattcactagcattcttccattacatgttctccaccagaaaaagagattgcacttattgcttactccagtattcttattagagtttttaacttttagcctccagcgaaaaaatattattttcaggaggcttgtctgtctttttaaaaacactaacaactttccagtttctactttatgacagaagtgaaattttttaagtgtgtaacttagcaaatgggagaaaatttaagtgtggaacttatcagcttaatggcctcatcttttcgcttatgcttatgcttatcagtcaaaatttgaattttcaaacttaaatttggatttgattttggggtttttttaacgaagtttatttttcagcctttgcttttagatcgctaagaacacgtatataaaagttctattcacacattatttttcgtttgcaaatatgccgtttcgcttattccccgaataagcgaaacaatggggctgtaaatgtgatcttggtaacaagaatgaatataaaaatgtggcactctgatccaataaaataatcccaaacaacatcagatatgctcaagcataacatacctggaagttataaacaacagatggaatatactgcccaagaaactgagaaaaattggctagcccagtgtagccctgaaaaggataaaacattagggtgaggatacgaatactgagaaacagtagagaaaactggcagataaaccaatagtttagcatctagatagcactgtatccgaacaacccactaaccagggatacagcaagtattgatccaagtaccaaacccaaactacggagtactcgttttgccatgtgtatgccacgaccttcaacctcaccatactcctgccacaaacattttatttcaatattatatttaacaattaagactacaaataataaatgtagcgcaccagcacagatacaaggataaatggtttaatattccaaactttggacaatatctacttgttccgaacgatgcatcatttaatatattatttttgaacctaacagcaggagggctgccgctttgtattaattagcatgcaagaaacaaagagcaaatccttttaaagactttagaaaacaaacgcatactgactacctggtaaacaaaagctctaagcaggacgcagccacccaagagcaggcatgtacacccctgttctttaattttgtgagcaggggctgatagagtcaatcgacattttttttaaaaaaaaagttgatacaggcatcatttggttaaacttgttgtatatgtagttttgtgaatttttctctggaagcttcaccacttctgtattgctatcgttatttacatatagatgagtagatgggcctctagctaatgggccagcacacaaacacacacacactattctatttacagcccaacagtatacacatccatctttagagtaaaatgtgtatcttcatgactaaaagaaattgtagcaaactcaaaagaagggtaccctcatgcaatgctttccccaatcaaggggatgccacattatctatccggaacattagctagacttcttctgtgattctgtcaagctgaactgcaaagctaaaaactagtgaccaagtaatctaagatccttaatacaagacaagcatgcacttatgtaactttgtaactaaaaaaggagccacatatatcaaatatatgcattcccaactcatgaaaagtaagaattccatcccatctaatagctccatttccctagtgtaccttttgctcttatcatatctgaactacaatagagtaaagcaaactgaaccaatttgattatttgatatgtcattcctgtaagtgcagggattccatagaaaatgaaaagggaacagcaaataaaattatttagtaaaccgcctcacattgtatataggagtgctagctgactcggtagccttcagtttgtcaagtattcgatagaaataggcaaaacacaaaaactgcatgggcttccagtctgcatggcccatggtagatatatacatgatctgcaaaaaaaaaaggataaaaaaatgtccattaataaagtaccttttctccatacacaaaatgacttgcccaagataggaagtttggcaagctgatgattaaaaaaatcctatgtgaaataatgctgaaattcaaattattttctattgtgtaatttcaagtttaacaccaatgcatataacaaagttgagtacagaggaacaatccactgggattcataaaacattgtgtttgattaaaaacagtaattattaatatttcaatgtggtacttgggatgatacagaaaataattttcttacaaatgttgctgatattgccatattaatgcgcaggtccttcccagtggatcttgagtatctgcaagatgatcatgatgatgatcatgaaatggcaatagcatagcactaaagctaacaaagaagtggataggtgttaatgtgtgatgatatttccagtggcccagagttttaatatttggaactaacatgtgaataatcaacagttatgctagagaaaagttaaaatttaaaaacaataagggcatgggcattggatcatcaagttttgctagagaactgcattaagtaacaaggatgcccaattcatggatgcaggattgcagtcaagaattaagtctgttaagtctcctaagattcatagtgtatagatgcattggaaaacaaaatgtacacagtatatattgaagaagcacatgaagagattggttacaaaatgtgaactgtaaggtacctaggcccccaaggaaccactggttgattatcagcatatttaatgtcctttgacacctaatgttcagaaagagaactgaataatcagtgaaagaaaacatcagaatagagaattatcatgagactcatttcattattagccatatgttggaaggatcctcttaaacatggcaaccgacagaggtctcatgaagttcactccagtaaggagactagaagagtcgatgcaagataagtcatctaagatctccgtcaaattcaccatgctaaagtaaccatcaagcttaatagcaggcaatgcgttgcttggttagatatctctgcatctcaaactacgtcgctcaacagtaaatatcagtatgtgtttattttagcatgaaggaatttaaccaaggagtaccaaacgaatggtaacagtctgttaccatatacagaacaaatcagttttgcaattacaaatcaattttgtgaatatgaatcctcatatctaactctaattggatacatatgccaaattgccgactgcatgggattgaacagtgctaccgtaaacggtggagcacatacaaaaaaagggcagtaacgcgcaagtgcaaactttgttgctgtagaccatgcatcatcaatgtgacaaggaaataatagtagagagtaacctggattgatccatatgccaccccattcttccggttctgaagctgctccatcatgaccatatcgtatgccctctctaactgaaattcgacaaaactccatcactcatcaatacattaacaacacaacagtaaccaaattctgaacccccatgacccaaaaccaccttgaacaggtgctcggcatctttgttgctctcggcatcctttcgcctccgcttataggccatcttcacctggtcgaacccatcaagtggactgatccccaaaatctaacaaacagggaccaaccatcacaacaagaccaggagccacatccaatcactgaatcacctgatcaccaacgaaggctgatcctaaacatgaacatagccactcccaataacccaatcattctacctcgtatggattctcactgtccccggcgccaaactgcgcgctccccgccgccgccgatgcagccgcaacaacaccacctccaccgcgcttcgccggcaccgcagataacctgtttttttttcctcatcgtgatttaccgtgaattaacaactgcttgtaaaaaaaaaaaaaagcaaacccccaccgacaactaataaagtgtgcgaaaccgacgaactctaccaacgttgggctacgatttcacgaggcacggaaccaattattccaacaacgcgggcgtaatttacctagcggggcgcgcgacgacaatgggggcaacccaatgaggcaggaagacctggcgaggggaggaggaggaaagactccggcggaggaagaggctcgcagccgccgta

SEQ ID NO: 30528 - DNA, 2313 bp, Oryza sativa
  unsure (1)..(2313): unsure at all n locations
gctcccgctccccccccccttccgctccaatggcgaaggaaccgatgcgcgtgctcgtcaccggcgccgcaggtacggacggcgtcgcgctcgcctcacttccccctcgttctcttggtttgccgacgcgatctcgtgcggggggcggtggctcggatctggctgcagatccgcgccgatccagtggagggtttcgagtgtggtggttgtagatagctagatctcgttgtgtggcggttgatctggttggggggggggtgcggattatttagtgggagaaggtcactggcgtgatttgatttcggtactaagttttgtggttcgtggattggatgagctcatctgatggtgggttgtattagatctggttattatggtcgcttgatctggttttcgggggactgattttgcttagtttgtgatagttgactcgagtttgtgttaagtctgtgcatgaggttttagtgggggtttagtggagatccatgtgtatttcttttgatctgtaggggtttgagtggtttgaaatggatcatggtgtcgatttgatgagtgggagtgtgggtttccatagttagaggtgggaggttagtcttataggttaaaagggtttagaagggtttacctattaatctgttaatcaaatgatccgatgggagctagtcacagttgtgagcttggttctcaaagacatacactgataacttgagatgtttgtcttgaaacatgcatttaatttagtttagctctggagggtgtgtcccttcaatttggccccacaaaactgtttgggatcgggtttgtattccgtcaagttctggcatgtcttatcccagctcaggattcaactgcaaaaattatcatgcatccatatagtgatagtgactttgatccaaaattccgtcgtagattctccatctgggatttggcaggatatcttggcatttaaacatttaaatctaaataattaaattgcattgcacatgcttaataagtgggattagcaccaaattgtagggtactaataaggaaaaggctatgcatactaactttttcttactaaattcttattactaacactgatatgtcatgctatgagtgcgtctaaattttttataacttccatctactaaaatcaaatggttgagatgattgttagtaaaagtttagtaagaaaaatttagtatgtgtagcagtgctcgtgctaaaaattgatctacacaagttggggttcttaaaccaagatataaatggtttttgtttatccatctcattctaatctcttgtctagtgtgatccatagttagaattgctaaattgctataaatattttctttcaacagctgaaaactatcactgtcttgttaacttaaactagtttgccttcattgttatgaaagcttcatttttctgatgtatgcttatgccagatgggaacctagctggcaattaattgaattagttagttcaatctgatgtggtgtgcacttcacaaacacttttgtaatgtggtctgaggtcctcttgtacgtggaaaggggtgctttgttctccacttaggagctcgggcattggaaatgtaactgattgttggttagtacactctgaatcccactcttagccaggttggatcaggtgaagccctgaggaggggccactagctttcttttgggtgctttcacgaatgatgataataggtgatatggtaatcagcatgaaaacaaatgtatttttttatgctcatctggaaatgtagcagtatttgaaagctgatggtttgcacttcatatggaatgcaataccattgttgcttgtgtgtcttaagaaatttgcacccaggggctttcttttgtgagctaattcattcttttattccgcaggacaaattggatatgctcttgtccccatgattgctaggggtgtgatgttgggtgctgaccagcctgttattctacacatgcttgacattccaccagctactgaatctcttaatggccttaagatggagctggttgatgctgcatttcctcttttgaagggtaagctggttcattgaactcaatttgtttttaaactgtcagcatccttgctgatgtttaaacttttctgttttggtgttgtaggaattgtcgcaacaactgatgttgtggaggcctgcactggtgtgaatgttgcggttatggttggtgggttccccaggaaggagggaatggaaaggaaggatgttatgtcaaaaaatgtctccatctacaaatccnnnnnnnnnnnnnnnnnnnnnnnnnnnnnnnnnnnnnnnnnnnnnnnnnnnnnnnn

SEQ ID NO: 30529 - DNA, 1932 bp, Oryza sativa
  unsure (1)..(1932): unsure at all n locations
cctgataattcttctgatttggatgagatattggctgacgaagaaacagacgaggaaatgttttttcgtggtcccacacggatgccaccgcgacctacccgagatgaggacaaacctgtgctgactccaaaaagagataggtaaatagggtaattttggtatgtttcattagtcgaaatatgaaggcttgatctatttgttcattgatttgcacaggcaatggcaagctaatgattttgggggcaacattcgggtccccactggcatcctgaccgtgcttattaagcattttttccctggcattgtcaagtttaaaggaagagatgagccagcatggagttggaaacattacaggattgcaccggacgatccagaaagcgctgtactgaatcgcttgccaagccgtctccatcgtgttgaggaagatttctgggtttgttttagagcattaccttctccaatatgaagtacactatgcattttattgtgtcttcagttttcatagtttacggccaatttgtactgtacaatagtaaagtatcttaataccacacttttcaatgtcaaacaggctaactttttgtagttgcagctttacttcaggtgggcagagggaacggaacaagctgctagaaaggttgtccgcaattgtatcaagcgccttttttcgcacctgatttatgaaactcgtatcctggctgtgctcaattaccaaaggaacatcttaaaggtagaaacttctcgggatattgcttgcaggacatatctaacagaagaagagtacctacaggtgctatggttgttcattgataatttgttgtcatctactgatcatattagtaattaataaatctgtgcttctcctataggtagaaccatggtggttcctaaaggcaaaaaatgagtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttgttatgtgcatctatgttgaaacatgtagcagatcatgcacagcagatcatggtataatatatatgggtataatatatatggtacccatgttctgttttaggagaagaagaaaaggcggatagtgtctcaaatggaggcctacacagaaggaaggggggaatttggagaggatggaccattcagatgtaacacgcatgtaactgggaagcttgtaagtgctgaatatttagtggtagtttatcatttgtgcatgagtactaatacactatttgatctgactgtagnaggcctataatgaagcttatgttcagctgcatggagcagaaagtgattggcgcaattctcccattgatccaatggctgtgcacatggctggtggtggaaagaaacatggtcgattcatgatcggtgatgggctcattgactcatcagcaatctttggtgacagttcacttgatgatccacgtcctcgcagaagactgtgaacagatcctgacaacacaaaccaaattgaagaccttgagcggcaactacaagaggagcgcgaggcaagggaacgagagcgtgaagaaagggagcgtgagaaggagagggagcggcaggagcgggagcaggagaaggagcgtgagtgtgaagagagggcacgggagaaggagcaggatagaaaggagagggagctggagcgcaaggaaagggagttggaaaagatagcgtttgaacagaaatcatcgttctttgaagttgctttaagagtaagtggttatgggatccatctagtagtgttttcattatttgagggcttgaattctgtgatggtcgcactaactagtgtacatgtgaaatggattgcacgctatacaacttaagctgaacattgacttacctt

SEQ ID NO: 30530 - DNA, 352 bp, Oryza sativa
  unsure (1)..(352): unsure at all n locations
cgagctcggtaccccattggattaaaaaatccaggtggaaagatcttttctaatttgcaaaccaaaacaattacttgagactgcatgtttgccatctctataggatcaaactgttttgcgcaaagtttgcgataaaagaagctcacctctgctaacacttcccacacatgagttggcaagtatccacggaacatgactggaaagatacgttccatcattatgtggtaatcatggctttttaacccattgatccgcatggttttcaaattcactcctctccttaggttcgacccatagnnnnnnnnnnnnnnnnnnnnnnnnnnnnnnnnnnnnnnnnnnnnnnnnnnnnnnn

SEQ ID NO: 30531 - DNA, 531 bp, Oryza sativa
gctcggtacccatgtgaaacttccacaagtagttgctgacgctgtcaatagatatctcaaacaagagatattataatgaaacacctttgcaaatttggttggaggccagcatatactgtgtgggtgtatcatggtgagacatatcctgcacgtcaaagcgatatatgccaaagcactgaagatgaagatagggtggcagagattgatcggatggatgagatgatagatgatgtccatgatgcttatgtctcagttgaggaggaagatccagagcctacagcgcaagctttttttcaaatgctgtctgcagcaactcaacctcttcacgaacacacacaagtatcacaacttgatgctatcacaccactactagctgtcaagtctcaatatgctatatcaaatgctggatttgatgcccctttaaatgtgatatgtgctcttcttccacaaaggcacaaactaccagcaaacttgtatgaggcaaaaaaagatcttagtgcattgaacatgccatatgaaaaagatagatgc

SEQ ID NO: 30532 - DNA, 753 bp, Oryza sativa
  unsure (1)..(753): unsure at all n locations
nnnnnnnnnnnnnnnnnnnnnnnnnnnnnnnnnnnnnnnnnnnnnnnnnnnnnnntcattaatgtgattcatcaaaagtctaacttattattcagaaatagcatcaatcagcatgtacaatctactattactaaaatatctctcttttttttggaaatggcaaaaggacaataaaaaaatgaattgttttacttcaactcattttcttttactcaagacaataaccacaaaaatggtactactttggtgcttcctgtgcacaaaatataatagcacacattttacaaggcattgagatcatatttcagctttctttaacgcaaatccttcagtgtcagaaggattcatggtacttctatatgagttaaccaaactacaggacagacttgaagtaaaactgttcactcctatataggattataaagataggatgaactcagcgacatggaaacaatagggtatatgataggagtccatatgaggctagacatgtatgtacctgtggcaaaacagttagcagctcaaggaagcttgggataaagtcttgttgagagttcatttcatcacttagccaattcacaatcccaccacctccccagtcctctacaggtacatgcaccgcaagagcagccattgcaatgcaaatctgaagatggcacaaaaggtagtttgccattataactgtgaaatacaaaattgattgcttaattacaagctatatactcaaataaatgtggtcttagaatgtgtgca

SEQ ID NO: 30533 - DNA, 1371 bp, Oryza sativa
  unsure (1)..(1371): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtccttgtcattgcaaatatcttcagtatccctgctgatggcaacttgctcaggatcattgttgagttcttgaccaagatcgattacaaaactaccagacagaccatcttcttggaaatagtggacaacattgctattaggaacagaattgtaatcttgatcattgggtacttgtagtctaccaattggctgcaccttatacacaacccaccaattagtgaggtcttgcacagatttacatgggtacggcatgtaatacacctgtgtcgcttgatgagacaaaacaaatggttcgaattttggaaggattgacgcatgagcaacctcaaccagaccatatcttggtgtatacctcactttgcttgggtcaaaccaatggcaattgaagagcacaagtgtgagaggttttctgccatcaaagctgatttctactatttctttgatgtaaccataatactcagttgtgtcactattttctccctgtcctatagtcaccaaaccactattattgtagttgcatttggcctctcatgttcatatttgtgtgttcggaatcgatacccattcacatcatacatattatattgcaagactcgagtgtggcatcctttagctacttgtctcaaatcatcactcatagtttcgtctaacatactctagcagtgaaatgaaaggaaataatgtgtcaataaattgtggcataatgttctattatggcaatattgaaggttatgttatagaaaaacataagtattattaggttattgacacaaatgcaattaacaggtgttaaactgcaaactaatgaaaacaaaaagaaaatggaagaaggcactattgattattaaggtatcgaatttcaaaactgaagttatcaagttattaattggctaggttctttttgttagtagaaattggcaatgattttattctgtccagatttccgacctaacagatgatcaattgagaagtgtctccatattaatgacatgtacatacatgttcagtactattttcataatgcttgtaaaaaaattaactcggattgtactatgaaaaaggcagatgcatactagcaacttgcattaatccaaatgtgctttactattgtaggtccaaagaagtcacctaatttagagttttagcagtaatactttattggtttgatggggattacataggttgcaggaacattcatgaaagaactaatgttctacagtttgaaaag

SEQ ID NO: 30534 - DNA, 2168 bp, Oryza sativa
tgtttgccatctctataggatcaaactgttttgcgcaaagtttgcgataaaagaggctcacctctgctaacacttcccacacatgagttggcaagtattcacggaacatgactggaaagatacgttccatcattatgtggtaatcatgggctttataacccattgatccgcatggttttcaaattcactcctctccttaggttcgacccatagccatcagggaatttcaatgtttgaaaccattctaatacttccttcttctgagctctattcaagcaaaagtcagctcttggctttacccactgactagatgcatgtttttggaccaggttcaattcaggtctgttacaaagtgctgcttgatcaaggcgagccttgacattgtccttcgtttggtctggaatgtcaaagcaagtattgaaaattgcctcaacgacattcttttcattgtgcatgacatcgatgttatgaggaagtactagtttgtgaaagtacgggagtctccacaaactagatatatgtgtccaatggtgatccttgccatagcctacaaacttatctccattagcagcaaggacaaggttatctaaccgggcacggatctcttgacctgagagacgaagaggtggttcattgctaactgtagtgtttgatagaaaagaatttgaatcacttctaaagctatgatcaattgggaggaactggcgatgacaatcaaagaatgagtactttccaccaaacttcaacctttttccttggagtgcctccatacatgttgggcatggcatctttccatgcacacaccaaccggaaaatataccatatgctggaaggtcatggatagaataaagaaatgagactcgcatgatgaaattcgtcttggtggcacgatcatatgtcaacacaccttgctgccaagcatgtataagttcatcaactaagggttccatgaatacactaatgtgtttgccaggataatttggcctaggaattatcaaggtaaggaacatgttgtgctggcgcatgcaaacaccaggtggaaggtttaaaggaatgacaaacataggccagcaagtgtacgaagaagaacccataccaaatggacagaacccatctgttgctattgctattctaacattgcgggcttccattgaaagcctgtgaagtccctatcaaatttcttccaggcctcaccatcagctgggtgtacaatcttgtcagtatggtaccgatgaccattcttgtgccatgtcatttgcttggcctgcgattcagacatgtacagccgctgaattcttgggatgaatggaagataacgaagtaccttcttggcaacagttaattgtttcttgtgaccattactgtcttcaacctccacatacctactctctccacaattatcacagtgtgtcttctgcgtattctctttcctaaagagcatgcaatttttagggcatgcatctatcttctcatatggcatgttcaatgcactaagaactttctttgcctcatacaagtttgctggtagtttgtgcccttgtgggaggagagcacatatcacatttaaaagtgcatcaaatccagcaattgatatagcatattgagacttgacagctagtagtcgtgtgatagcatcaagttgtgatacctgtgtgtgttcgtggagaggttgagttgctgcagacagcatttgaaaaaaagcttgcgctgtaggctctggatcttcctcctcaactgagacataagcatcatggacatcatctatcatctcatccatccgatcaatctctgccaccctatcttcatcttcagtgctttggcatatatcgctttgacgtgcaggatatgtctcaccatgatacacccacacagtatatgctggcctgaaaccaaatttgcaaaggtgtttcattatcatatctcttgtttgaggacgtgtgttgttgcagtagttacatggacacaacacaccagcacgtcctgtctccctgctgaatgccttgtcaagaaattatgtagtcttcgatatccactcagcggtaacctcgccacgctttcgacggcccttgtacatccaactgcgatcagtttccattgtacctagttatgacaaagtgacagaataaatttatgttaggaaatgtccttctattcatgaaaggttcaag

SEQ ID NO: 30535 - DNA, 2073 bp, Oryza sativa
ttcgtccttttttctcaacaaatctgtatttggtgtggaattctaaactaaatatatttgcctttgataaaccaaaattttgaactaaatttcgaactgaactatttacgtgtggattgcaaactgaaattttgtactaaatttcgtttggtcccaatacaatgtgaaatagctaaaaaaaatactcactacgttttatattactcgtcttgacttttttgttggtcaatttttttaaactagcaaaatgaacatgctttcatctaaattccatgattttcgcttccactcatattctaaagaagaggaacggacgtagtcgggaatgtgaacgtcgccattgtttcatgtcaaaaatgccttgccgtcggccgccgacggccgactgccctccgcgcgcagcagccggcggcggcggagcagtcggtgaacaccatccggttcctcgccgtggacgccgtggacgcaagctctgccctcgccgcgcaacccatctccctcgccgcggcaccccgtccacctgtctgacgcccgtcacgtcctcgccttcaccacccggcgcaccgtaaggaccgcgtcacgcaggacgacccgtgtgacaatgagaaaaacatgaggtgattaaaaaaagtagttaagttttgaataagattataaaaaacatagcaacatttttttttacataaaaccaacatattatcaaacaaatttgtttttgtagatgtagctaaatttttctacaaacttattcaacacctaaaaaattttgactacaaaatagtcaaagcgagatataatatgaatcggagggagtgcatgttattaaaattagttaacaattcctttgattctgttatgatttgtagaacttttgaactaaattttgattgatccttgcattaagtgcctttgctaaacaaaaactatttcctttttaacttcgttaagaattaaactttggtttgttgtatataataagaatttatttcttcaattaatttaatcaaatttattcaaatttataattttgattaaaagtgttgttcagaggtctatctcagaatttatttgcgtacatttcaagagaaaactttcgtttatctttaatttttctaaaagctatctaaatattcaaacctgtttttcttaggaaatgttcagctttatgtcttaaaatgtttttaaacaatgaacatttctaactttcaactaaaaaagatatcagcttgttgtcatgctgttgagattgggactcctatttaaaaaaatttcgtatggcattaatttgaaagcattcataatatataaacatcgttgagtgataatttggttgacaatgaacaaacacaattagtttgttactaatttgtgcgacccttccataagttgccagacattcactccaaaatatgaaataatatcagtcatcagttttgctgaacgcgtgagttatatctggacagtggccactgccacaccacataagttccaagttgataagttccactgaatgccaacatttccaaccaaaagtaccaaacttccagttcacaaactccagagcacagtaacatctatgaccaaaagtacctaaggcaacatgcacaccgaaatagctactagagtccgaatatggactcaggttcatgcaaccccttaggaaagtaaatgtatataactaagaacaaaagactaaaggcaacagccacaaccaacagctactcaggttcatggccatgaccatctaggtcagtttaattacaaaacacatccacatgttccaggcatgtagaactagtccattctttccagcagtagcaaagtcataattatcttcagattgcgctcgctgcgtcaagctgaaccatctaaattgcaccagaaacaatagcaacccctccatggtcagcacagaatgagtttccattcagagccgaagatacggacaaagcctgttttatgttacaaacaaaatggttaatattagtcctcataagttatatggggaacaattacttcatgcacacctgcactaccatgtatcaaatacttactgggttagtcaacatgaca

SEQ ID NO: 30536 - DNA, 3757 bp, Oryza sativa
taaagctgcaactacaaaaatttagcttgtttgacattaaaaagtgtggtataaaaatcttttagtattgtacagtacaatttggccgtaaactatgaaaactgaagcccaataaaatgcatagtgacctccatattggagaaggtaatgctctaaacaaacccaagaaattttcctcaacacgatgaagacggcttggcaagcgattcagtacagcgctttctggatcgtcgggtgcaatcctgtaatgtttccaactccatgctggctcatctcttcctttaaacttgacaatgccagggaaaaaatgcttaataagcacggtcaggatgccagtggggacccgaatgttgcccccaaaatcattagcttgccattgcctgtgcaaatcaatgaacaaatagatcaagccttcatatttcgactaatgaaacataccaaaattaccctatttacctatctctttttggagtcagcacaggtttgtcctcatctcgggtaggtcgcggtggcatccgtgtgggaccacgaaaaaacatttcctcgtctgtttcttcgtcagccaatatctcatccaaatcagaagaattatcaggttattgggaacctgaggaccttgttctacatctcggcaaggtagcagcgctcacagcctgatctgaaggattggaatcctccctgcagcccaagctcaatcgccgcatattgctacaaaattaagatatgcagtattatattaaacaggtcaaaaactacatagtcgcaacatggtataataatgcctattataaaatgttgatacaaagatgtagtacaccatagcattgcagatcatcacacaacatggtgctgtcattccaacccgattcaaccattcaacaacgatctaaacaagtagggctgtggcaaacactcacactcaccattatgtcttctgaaaagagggcaagtttttcctaaccaatatgtatccatcaacaagtacacaaatatgaaaacacattattttgactgtgcaaggactctcacccacatcattttgtagtctaatattgtttttatttacaaagcacaacaacttattcatatggtacttgtggtattacaagaaattaaaatgagatacagttcctagaaatcatacaccgaactatttctagatcctgggagaaaatggatgggttttctagaaccaagacccaactttacatacgattcaagaaaaaactcaacatatacataccaccagctggatggaagatgaggtgtgctcaagctgtacaacgaaggggagcctagcagatggacgtggacatgcaaggagcgcgtacggccagaaatgcacagcgttgctcggtggccgtgcggcggactgacgctggggtgcacagctatcctaccatgtgcgaataagagaggggaaaaatcagaaaggggaaaagtggcgaggagaatgaagcggcagggggtggggaagtgaggggatcgattaaaagggctaggggtttggtggtctctattttgggctgacatgtgggccttcggctgtaactcgcgcgggattctcctgttactcgcgcggcaacgaaaatcaggcgcgccagccggccgcgccaacggaaatcttggcgcgccatccgcctgcgccaacggcgatcccgcgcgccagaccaattattccgcgcacgtaacggcagaaactgtgggtcccacgctttaccgtgtttctcaattcgtcacacggcatttttagccacttcccgagtttttccttgttcacacacggtatactttaaatgttatcgtgttccatataacactctcggtaaccaactgaggtacacggtagtctcccactctctggtagtgttagccgggggttattcattggcagctcagttttccgtcatttatgataatttgcacgctatggagtagagccaaaaaatgtgcaagcgcttaatattatatatatatatatatatatatatatatatatatatatatatatatatatatatatatatatatataacaagttcttatgtaaattttaaactgttgaatagttccatattgactagcttttggtctaagaaaaaacgggccctaatttatataggcttggctttgcccctgcgctacatgattttatcatattacaccaatattatgagtatataacttttttgggtgataaaattggaattaagacccttagcagttggataaatccacgcatgtcatacgctggccattacacaaaaaaatatattctaaatacacatgaaaattactgtttggatttatacctttgttctaaataaatacttacttgacataaacaagattcatgttgatctgagtaagaaatcaattaaaccgaaaaaagagcatgcgtatgccttgtatgtaatcgaataaataaataatgaaattgaatgaacaagcagacgatgattagctgcatgctaattaggcagttctttacactaccatacgactaataattaataattaaggtagcaaataaacacgaggagactacgacatgaacaaacttaatttatttcccaatcaataatcaatcagcctagccacccggcctatctatccattcttctccatcagctaacctcgccaatcatgtacagtacatacaattgatatactagtaatttacacccgttacatttgcgtcttctgaaaccccaatcagggggcatgcaagtacacaatgatgcagatatactcctacttattggcttggagtatacatcaatcaatcaattatatatatactccctccgtactcgtaaaagaaatcgtttagaacaatgtttaaatcaaaccttgaaaatataaatcttgaataactctaaagttattgagtttgaaaatgtaaaaattatatgaatagatttatcttaaaaaatacttttatttttttatgtaagaaaaaaaaagaaaaatactttcataaaagtatacatatatcacttttcaataaatatttttatagaaataataaatcagagttgtgttttggaaaccgtgtcactgtcgaaaacgacttcctttacgagtacagatggagtatataattatagttcattgattaattattgtcgattggtcacggcagtgagaggcagatagcagcttagcttagctgcattatcttgagacagagtaccgcgcaaaatgccaggagacacctttcagaaagggcaccactgcctgcagcaagtcagcaatgcacagctagctatagcggcagccatgaccgcgagcgagtgagagagagctcgccgtcgacggcctagctaggctctcgccgtccgtcgtctctcgcgtcgccatggccacaggggatcaataattttgtgggcacacggccggagaggcgacggcgatggcgacggtgaggtctgattttggcacggcgtttcgtcggtgggggcagagtgtggtggagtgtgctgttgtgtgtggtacagcaggcgagatgccaacggatgatcagcttattatagcctccagctagcgacccatgggttgtgtatgtacttgctccatctcataatataaatgcactataaaatttctcatccgattctatggtgctatattatgggacggaaggagtaggtgccaaacagctagctagatgtctaggtgcgatcaaataatccttcgttctaaaataagttcatttttcacctattttatgcagtggcgaatccagggtgtaaat

SEQ ID NO: 30537 - DNA, 4322 bp, Oryza sativa
cccaatactttctctatctgtaaatatattattatgtatactgaggcagcctgcatccttgccatccgtaaatttctttactaatgactaattagacttgctaatgatcaattaggtggggctggcgcaccagccagccccaacggtggatccgccactgattttatgcatatcaataaaaaatcaaatagattaaaatactcccactttatcaaatttcaatgcaattattctctactttatctactcctaatgcatttatcctctacttacaaactctggtgcaatgattcttgaaaaataaacttattttagaacaaacggaaggaacgaaaaaacttagtcttagacagagggagtatataatagtggcttattccattatatacaacatattttttataggcttactcatctatgtagttcttttaatcttttatatgatataggtccaacacctaggtaccaggcactggatcttattgaataccgtatggtaacaagtatgacacattataggaagcaggtctgaaacctatggttactagattgctaggtctggtacttatcggtatcaagtttagtatccagtatcatatctcatttgatactggtgtttgaatctcctcaagatgaagattaagtatttcacgtaaaatgaggtgataataacgtgtgattaattgagttttaattattacaaacttgaaaatggattaatctaatattttagaacaactttcatatataaagtttttacacgaaacacaccgtttagtaatttgaaaagcgtgccacgagtatccaaattttaatccactcctttaagaagaaacgaacgggacctcgatatattatgggtaccagatctaatacgtatgagtataacactatattacctgttcatacaaaacagaagcaaatttgatcaccaatatgcacgcatggagtaggcatcatcaaaaagttacacaaagtaccatgtttgattatattccatccacctatcgaaagctaaagacataaaagctaaaacatggagcaatctttaaggcagggcctagctgcagccctatggtgcagtccagcaaggcttctagcaaaccttgctagcatggtcgtggctacctcgtcgaagaagcgctgacgcacaaaggaaagtgtcgacgagtgatactcggagaccgaatgattagagtattagggtacgttggaatgagaatctacgtatacgacatcaagcagacaaaagataaggattatactgattcgggccccttaccaggtaatagccctactccagtttatatgagattgatgacggaaaaccacatattacaatggaagtaagcagaatcgacaataccaacaagatcgtaatcgatatattcgacgagatccctcggcgacttggctcgacgaactccagcttcataaactatggtgggtgtgttgatgatgaaattctatgcctttcacccctccctgggggtcccttttataccgtggaccatcttgatctccaagtaagactcggagacatcggatcttgtacgatataacagaaactctatcccctccgagcaggattttggaaatcacttgaatcgtagagatatttttcataatttgtgacagattcccacggcgtacataggaacaatctgtgtacgtgaaggtatcccatatccgtatattccataagtcgaagaataggaggtatgtcttatccgtaaccatgacagaaagggtgttgaccttggcatgatgtgagcacaagatgtgaacacgcgacacaagaatgcatggctgtatcgttccatgtcgttgaccggatgatattccctagctagcattctcgtaagtttatttgcttgaagggttcaaaacgatagtgtaggactgccacctgctctggctcaaataccttcggcccatcctctaggccttatactccatcgttcgttcactacgagttgtagatgttgtagcctattgaagaacacatcaaggtactatcatatccctcgataaaggtgacaaaattatattcagaaatgtggatgccgcaagacaaactagggttctaagttagtatactgctaggagataaagtagtagtcatgttttcttatctcattcacaagccaacaaggcaaatatatagtcttacattgattgatatctggtagggaaataaagcaaaagcaacttcaggttcagcgaggcaacaacattcagggaaaacgacaatgctagatagctacagttgtccccgcgatcgttctcggtcgttggatcaaccaaacctccatcctcagttgtgtgatgcacttaagtgaaatcggcgaaatgttttcctcactgtcggcttctattcaaaagaaaaactctgaagaactctgaactacttcaattaacaagcgaactgaatcttcaaacaacttttgattttcatttccatttctatcctgctaacttgacggtagtgcttcatctaattgcatcttctatattggaaccaaaatacaatcttgtggccatgtgttgatctataccaatccacagaatccacgtatgtctgccttttagaccatgcatccatgttgtatagcgcctatgaggcgtttactataaagactcatcttccggttaccactttgaactatgaccactgtttgtttctatttgtttgtcaagaactaatggcagtgtattgtgttgttataaagtagaactcaaggatttataccagattatgacctcttatccaagtagaattcggggatcccaaataggatatggactaacaaggccttatcattatcgaggcagactacacagtccattaggtggacaggattcgttccttgctatatttttacccatattttggaattaatatatttttgtataagaataagtatgaggtattcctagtgatagcaagtgcagatatacaggtacgtcatatctaactataacactgatagaatttattggtcataagtaaaattataccaaatcattggaattttacattactttgaatttttggcacataatatgtactacatgattttccccttttgagatagatattagctttgcgatgggttgcaaatggtggcaagagatatgcccactagctaccttatatcatccaatcgcactagctggtattgattggcgcgagagataagtttattaggggacatgaatgtaagttgtttactttattaagggatggtttgaagtttgtgcagatttatttttccgtttgcaaagtatgggtattatatatgtggttaatagtttttctataccatgttcttcagcgagttaatgtttgtggtaaattgaaggcttctatagatgatgccgtcattttaaaggcttctactgtgctacccattttgattaagcattttactacttctacttggtctgtacactattatataattaatgttctctaaaaaatagtccataataatacatgcaaaggatgggagctgagaactatgtttttttagatatattgaagtgtaatgagaatgaatctaaaaacaatatttttatagttacattaggaattagacaacatccccaaagtagtacgtgaaaaatataagatatagtaaaaggtttttctttaaagcttatctataaattcacattataccatacaatgttttgctataggatgaataattatgtgcaacatttgtggatgattttgcctattcaatttcacgatcaaattcaatatagttaattttgaaccacaacaataataataataataataatggtatatttagatatgtggttgtgcttctttaccgtgctatttttttaggaaaatactgtgccattttattcaacaatttccgttgctcatgttaccaatatataaaactgtaaaaaatgtgacataattatcgtttgtgatatgttaaaattttcgttacaataaatttatacttaatcattacttaacatcatttcaccctatgtgatgtgaaatcaattaatccctactttatttcacgttgcaactcacagacacccctactagtatagacgaaagggacctatcggcattggaaagaaatgcgcaaccaaaaatagcacgaggaaggtaccgtgtgggcaaggaagatatagcttgacgttggggaggcctcattgccttctacatccccctcccatctctccttgctctccatggagatccagcatgtagggggctagggctagatcctcacgctggatccgcccttgcgtgtgtggaagaatagtagctagtctcacttcca

SEQ ID NO: 30538 - DNA, 1881 bp, Oryza sativa
  unsure (1)..(1881): unsure at all n locations
nnnnnnnnnnnnnnnnnnnnnnnnnnnnnnnnnnnnnnnnnnnnnnnnnnnnnnnnnnnatatagcatatggctccatctactatggtctatcttgctagggctctagcaaagctagcttagctagcttccttaagatggctagctccaatgaggtgttttcaaacatgcgcatgctttgctctccatccaatccagtcgatcgatcgatcgatccaatcatggagctagacccatcaatcattgtgcccatttccctttctttgatgtgtccgttttgattcgatattggccatatcacctcttatagctataccttcgcggctggccagttcacccaaaagcttactcaactctgtcgtaccggagatcgacgcccgatcgtatgatttcacactccctgtgtctctgatgtatgtagatgacgatgaacagtgtcccatatcggtgtctcgtgttggtacacctaagcattgtagcgggagctagggtgctgacagggacggcgccgaggtccacgtcatgaggggtagcatttcttgtcaagaaagaacacgtatgtgcaagatggcaaatttttttctctcctattgcgtgcttgtttgggagcaaggagatagagagagagagagagagagagatgcatagctaaataatgagtggccgtttcttcctttgcagctaagctcttgtacaagtccacactcaatgtgtgttgggtgatcgaattaagtgggtgaaaatatatagtttatatgtcagtagtgatctacagagcagtgaatgacattgatttctagcttagctacagcttctctctactagagctagtctactatatcattaattgtgttgttatcgaagtttaagtcaacctagctagctagatcgagtaatatggacttcattcttcctttattaatataagagaaacttaggtttttaggctgcacgcacaacaaaatgttgcagtatattacaattttgatcaactatacatgtatctctaaaaatatttagcccaggcatagaaggatatgtttaattaaactatagttgatcaataaaattagtagtgaaattttagttttgaaatatcatccctatatatgtgtctcaaagtagcatcgagagcgagtatatatagattgtttcttggatatattttcgtaccaatttataatggaaatgtacaagaccatgcatatatgttccatcaacttaacttaactagtactattagtactattgtgtactactattgccttgtgagacagataatattcgtgcacattggagatttaggattctagctaattaatcgtttccaatacacacatttgagattgacgtaattcgcaatttcgtacacgtactaatgtatacatgcacatagacatagaaatagagtagctttctgcatggcgctgtagactggcctactgccttaaatgcgctcaatgaccctgcaacaaacatcaacctcagggagctcggtcattgtcccatccccacgatttaagcatgttatgttcggccagtctttaattaatttctccattcatatgcctccttggttgcaatgtactctcccctcgaaaaaaatccaaaattagatgtgatacattctaatacaatgaatttagatagagatatgttcaaattcatagtttctagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30539 - DNA, 1168 bp, Oryza sativa
  unsure (1)..(1168): unsure at all n locations
ccgctgtagctcaagtcggcaacaacagtatcatcatcagtagaaacactatttagtccccctttgattcaaaggaaattcataggaattttagagaatttcattcctataggaatttttcctatatagccctttgaattaaaggaatggatcttatgtaatcctatgaaattcctatggaatgtctaatgccatgtaagttttggaggaaatctagcatgaggtagaacctcatggaaacttccctttcagtctttatctctcctctaattcctgtatttttcctgtggtccaatcaaacggtctgtcagggttatggataccacatacctaatagtagttgactaaatctcggcaggacccaccacataccatgtcctatacggaaacaacctacggatataggaggtgttccggataaggaaagacaaccagagttctacatggaaacgacaaggactactcggattgtatccatattggttttcctagttctacttggacaaggggacacctatgggtataaatataagaccccctagaaggagacgaccacctcaatagacacctaccacaatcaacatacacggaacaatagaagccacaagccaatacaagccaacatacgccaagacaagacgccggaatatcgacttcagtaataagcacggctagtcccctacagtgtctccggatattgtcaggagagacgaaagcgttatctctgatctcgtcgggcacgaactcgaggaggaagactaccttgttgtcgactacaagtcagaccttcagaccgccatgtcgacaacagttagataggctaccccaaatattgtactggtgtgattatggtgaataagagcaataccggctttggccaacaggatgtagggttattacctgaaaattcaggggcccgaacctgtataaaaatcctcgtctccatctcttttacctcagtctcacgtataccctaataccaatgatccccataccatgcaaataccggaatcgcgacatcaaacgtcgacacggtcattcctatgtttttcttgtgttttacaatcctcagttttacacttacatttctatcaaaatcctacatttttcctattnnnnnnnnnnnnnnnnnnnnnnnnnnnnnnnnnnnnnnnnnnnnnnnnnnnnn

SEQ ID NO: 30540 - DNA, 572 bp, Oryza sativa
atgggtctgagaacacgacttgctttgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtac

SEQ ID NO: 30541 - DNA, 1080 bp, Oryza sativa
cggtcggtgaagacgtagacgcccaacagcggcggcataataggccaagacgcccaacaacggtggcataaaggccagccgtgcaggcggaaacaccagtcagcagcggcgaaggcaagccggtcggtgaagacgtagacgcccaacaacggcggcataaaggccagccatgcaggcggaaacaccagtcggcagtggcggatgcggcggccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcagcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggacaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtggacagcggacgaggcggccggtcggtgaagacgtagacgcccaacaacggcagcataaaggccagccgtgcaggcggaaacaccagtcggcagcggacgaggcgaccggtcggtgaagacgtaaacgcccaacaacggcagcataaaggccagccgtgcaggcgtaaacaccagtcgccggcggtcgaggcggccggtcggtgaatacgtagacgcccaacaacggcggcataaaggccagccgtgcaggcggaaacaccagtcgccagtggacgaggcggccggtcggtgaagacgtagacgcccaacatcggcagcataataggccagccgtgcaggcggaaacaccagtcg

SEQ ID NO: 30542 - DNA, 1320 bp, Oryza sativa
cgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggcaggccggcggtgaagtcgtagacgcccaacagcggcggcataataggcatgtcgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggatgcaccactctgcggcgactgaagctggccggcggtgaagtcgtatacgcccaacagcggcggtataataggccagccgtgtaggcggaggcaccactcggcggcgactgatgcaagccggctgtgaagtcgtagacgcccaacagcgactgcattatatgccatccgtgtatgcggatgcaccact

SEQ ID NO: 30543 - DNA, 11717 bp, Oryza sativa
  unsure (1)..(11717): unsure at all n locations
tgaagatgacgatgcccatcaacggtggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggnnnnnnnnnnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccggcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtctgaacatgacgggaacgtggctggggtccgtcccttcccttcgcagcccgaaatgcgcaacgtgctgcagatcagtggttgattactccatgcttgtttatgtgcaccaccggggaccagtgagtagatcacgtgttaatcggccgcacacactgacgggatagtgccgtactagaatcatcggcactggtgtacgaagcgctactgtagtagttgccgcttttcaccgatggataccagggaaatccaacgtgcaatctgccgcgaggtttaccgggcggcgggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatccgaatgggaaaaaaatgactgaaatcaagtcaaaaatgtggcgccatatttttagcaaaaccattataaagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgcctttgctagaacagtccttttcttctttcttgtgttcatccagttgactctcatcctgcttcatgctaagctcatcctctatggtctgtacatactctgctgatccaggtaatatacacaataaaggaaatgagttcagtgcatggccaatgtaaaacaaatattacttgaacaggtatgagaaattggatattaattgaaacagttaatgccctcagtttacaaaatgaactacttgtgcttctaaaatagtggtctccaacaataaccagccaaacaaaaatgttacctcctacagggtggttagatagcacactaactcttagtacagatatacctcctacagggtatgatattgacctttggcaattgcagaggaactgaacatggaaaacacccagcacagcaactggtatgggctgtttggtgggagcttaaaattctgagaaacagctagttggtaaccggcatctagttcattttctggattctatagctaagaatctggattgtttgagagagctgaaaattctgggagaagctgcagtagctagaagctctccaacaaggccgtagtcttacttgagctttctataacaccgttcatgcttcttggtactgttatcatattttgatgatcttaaaaataaccagtaaatggtaaatatcatattagtgaggcataaacccaaaatgccatgagcacaacacccagtataggttttacctactagatttatgctactgaattgaggggtgtgcatgaaacgcttgctcaggtgaggcagctcatgtttggcaagaatatgaataggattaaacaatgaaaactcaatctatggaatcccagaagtactccaaatttcaccataaatttcattaattgtcataagctgaagtcctcaagaaagataaggatgagattcattcatagggacagccactttagacttcagaataatcaaatgtttaccatcacatgcatagtccagataaggatctccatccgcatcatcagaacccagtattagttgctcagctaacatgtactctatagcagcatcaatgtcaccatccatgtctttcaaaacctatgtgatgtggcattgaccattaatatataatgactgattggctgctacggtcagcctaggctcgcagttgcaatacaagaaagtcgatttgttgtataattcatacctgttcaactgcagcgatattagaacatccagttccagccatcaccaatttaaccgatatatgatcatactttgatctgtctgaagatttcttcaggtcctttgcttttgtttgagcattattgcttgtgctagctacattggcatctgcctgtaatttcataacggataaaattaagattagtaacagagcaagttgagctacaacaggatctcactgtccttccagggacacaaaacaaccaacagtttacaatttggacagtgagaaaccttgataataactggcattgcaggaccttgacatggatcttccctcagtctgacactattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagactaggcaaggctcaactgcctagcgtgttattcataggttgaagaaatcatactgcaaagcttgtattgaaaattaccatgtggatgcatatgttttttctcttgagaatagaagctgcttgcaactccatatgaccagcccaagtcccatcctcaagcatagagtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcaagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacaacaagctgtcgctccagaaggccgtggcgcaccagcccgtgagcgtcgccatctacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaacgtggaggcgctgatcaggactccggcggcgatggcacaaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatataaacacacaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaa

SEQ ID NO: 30544 - DNA, 1215 bp, Oryza sativa
atcttgaatttattttcaattgctgggaagatctgactggttcagatggactgctactgttcaaaaaatacagtagttaggatagataaaagagaagtctttctttattgatcaatcaaaggaaaatagattattcaagcataaaatttatacctttcttaattatatcttgttaacttctgattcttttcatcattaatctcagaacctgagcagaaaaattgtgcatgtgctctccggagtcctgttcatgtcttcctggccactattcaggtctcccttgccactgcttcttccagcatcgaaatgttttctacaaccaaatcagactagagatcttaagaaaatcatgcccctttcgcagtaattcgacagaagcacggttcttcgcggcaattgtcccgttgctgaactgcataaggcttctgacctacgggctccgcctttccactgatgaagctctagtaaaatcggtgacccgtgaaggaaaaccagagttcgtgctatgatccttatttctgatactccttcattcaaaaatcaaaatagtattccttgacatgatctttggttgcttacagggaattgctgagaggtcctctgtactatgtcattgtgctgctggtcagtgttttggtcttctggcgccagtctcctattgggattgtttcgttgtcgatgatgagtggtggtgatggtaagatgttggatctcctgggaatttaggaaaatctgcagtttttttttgtaataccccagttcacttgatgaaatgaatgcttctgctaagtatatccaccttcttggttcttattttttcaggctttgctgacattgttgggagaaggtatggctccgcgaagctgccattcaatgagaacaagagctggataggaagcatctcaatgttcatttctggcttccttctatctgcactgtaggtttttgcttcagaatgcattgctggttcttttgcattgttactccttgttattgttaactcatggatcttttgcatcacaggatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatg

SEQ ID NO: 30545 - DNA, 6124 bp, Oryza sativa
ctatattaatattgatgttaatgaatctagataaatatatatgtttagtttcattaatatcgatatgaatgtgagaaatagtaaattaatttacattgtgaaacgaggagagtaccatttaatttctgtttctcataattttaaacttctcgaaacaggtccttaactagggttacgtatacctttgtgattggaagggaggggcatttcggggatatgagtgagttgagtggcatggcatctactctgtccggtcaagggggtttgactacggctctgagcggggatgacagctaggggagattgtcagggccttttctgacaccacaaagcggggagaggaatccatatactcccagtagtagtagtagtacgtgtagtactagcactccaagccaacctcaccaccaccgcctgtgtccagtgtccagtgtcctgtccactctcctctcctctcactctcccacaccaaaatcatcgccatcgccaccaaaatcaattaaagcctgatcgccaccaaacgtacgagtactatcctatacgctgtgccgccatctcagtatatgaggtcaaccgtaatagttatttagggcacccacaatggttatctataggctctctataagagatccatatcagcatattttcttacttgaaagagattaaatgaagagagagagagcaaagctatctactaacctagagatagtctatagagaaaaacgaggcaatagattagaaagctatagatactcatgtgtagatatactattgaggtggtatactattaatctaatctattgctgagatgtatatgttttataaatagtaccttactttaacattgcgggtgctcttatagactatatataaaagatccatgtcagcatattttcctatatggaaaagattaaatgaagagagaaagcaaaactatctactaacctggagatagtctatagagaaaaacgaggcaatggattaaagaggtataaatacccatatagacatactattgagatggtttattattaatctagtctattgctgagatgtatatgttttattgagagcaccttactttacccctgatatcttaacctgatctgtttgcttgcttagcgttgatgaacgatgtagattaccataacttgtgttgtcgtaatatatcatcttaaaaagttaaaaaattaataagataaatcaacatataatataccacttcacaaacatatttataagattagattcaactaatacaagctaagcaaaaatattaataaatttgactacgaatatataataaatagtttatgggttctttttctaaatttataggttgaattttaatttatatgtttgtgtagtggcatatcatgtgctatcttttgatctgtattattcaattctttgaaaaatttaactttttacacaacatacatgaaacagggaacatcatgtgagaaagaaaacaaatctatctccaaggagtacaagtacaccttacgtcccaaaaaactaatttttaacaatgaatctaattaagataaatattggtcagatttattatcagaagttaactctttttataactgagactttcttttacagttctccctaacttggtttctcgccgttgaataaccaggcaagacaatggaaaattagaggttgtttttatgcccaaaatgaaaagaccgaaatgcccctatctgcgctgcctttggggacggtgaggtgaggtgaggtgagatgatgggagcaaagcgacaagacagggggccacccacacccactctctctctctctctagtctctaccttccctctctcgctagaatagattagcataatagcccaggtagtacagcacagggcggtgccggttgatcccccagcaaagcgcagccgtcgcaccaaccccgcgattcgccggccgcctacctcgcgcgacggccttctcctcaccaccacgccgcccgcgcagaatcgcagaatcgtgtgtgcgttttgagccttttttgaccgcgcgcgtcccatgcgatgatccatcgatcgcgagcttttggcaaagctacgctacccaccacacaggcagcacagcagagtagctagtggaatcgaccagagaagagaatctctcccctactagttccttctcgcgttaatttctcggtggaacacaagctacgtacttcgtataagtaattaaattcttttcacaagaagaaacaaatcgtgaggaatcatgcaggctagctagggatcgaggagctacgtactactgtctgtaacgtaagcaaagcatctacgagagctagctggttgttaacctggagaatcagcacgtactacgtactaccacatgattaatctgtctacgatatcgtctctaaactaacgagctagtagtaatatatgtgtcgtgcatgcagggctagctatactagagaggtggttgtgtgttcgctgctgctcagctcggctgttcgatccggccgccgacctatgcatgtggagaacaacttatccgctcgaggaagtatccttccattttgtgcatatcatataaatagttaaaaaaaattaaaaaatttagcaagatagattaatatgaaatgtatcactttacaaatatgcaaattaaaattcaactcctataaattgtaaaaaaaaataaccaatgtagacgtgaatgtacggtaactattttcagtttagtttgttctttttattgcagcttatagaaattaaatttggttttgcatgtgatatattttgtattaatctatattattattttttaattttttaataactatttagataacatatagtaaacagtaaggttgtatccctcaagggatggaacttatcacttttttttttcttaaaccacagttaagtttgcagtgaccaggagttcaatgctgtgagacgagacacatgcatgcacgcgagcaaaagcaggtgaggtgagtgagggtttagcgcgtgtgtcggcgagcgtagatacgtgtgggactgtggggtaatcgcggtcttgatcacttggccgcgtgcgtgcgtgcgtgcatgcgtgcgttgcattaatccggacttgaaatgggagcagcgtacttggcttacccggcaatgcagagagacacacgtccctacaattaattgtcatttgctcagattaccatctgcaaatcacaacattgtgctagctagagtaccgtactagtgataccattaattaattgacagaagagtgtagccagtgcatgcatggatcggtacaatgcacgtcaattccatgtactcgatggacatggacgggcgtcgtcgtatcaggtgatttgcatgagtacgtactccgctgtgctcgatctcatgctatcttgtgctcaacaattattacaccacacgaacgtagtactgtactagtactccttttgtcaaaaaaaaaaaaaagcagtagtgtgtttctttgtccaacgaagtttaaccatctatcttatttaatttttttttattaatacttttatttttattatagataaaacatactttatgcgtgactttttttaaaaaaaaaatcatattttttatataagacagacggtctaatgttagacacaaaatctcataattacacttaaaaataggacggagggagtatatttttgtactctcataataaatcaacctaagattgaatgtgacacaatctaatacaataaatttggatatgcatgatcagatttaatttattatattaggttatgtacaattcaattcaatgttaattagtttaattatgaacggagtatattgcaagtacaccacgggggcaaaagcggaatctcgaatgtaaagtggtagcacaaactctgatctgattcggccaacaccaccatagcacaaaagcaagcagaagtagcagcaaagcttgtatagctcagcacgagctcgttctcgcacgcagttgcagcagctatagcggtaaccgtggcccccatgcgcagtagtgatcacatgacagcgcagcgagaccaagcgacctgcagctagagctcagctctctcatccactgtgccgctaatgatcgccgtccacgacaaacccaacacccgagaagaaaaaacgcagcaacagcaacagcaccagcagcagcagccacactaaccatttcgatcattcacaccacacacctgccagtctctccactaattgcacgaaaagaataaacaacaaaaaaatcacaggacacaggagagaaagaaagaaatcaagaaacggaggcgttgtgcatgcaatgcaccgtactcccaatactcgcagacgacgcgatggcgatgcacactcaaaaaaaaaaatatatagctactcctcttcttgcagccattccaaacaataatccgatgcctcgatccatgcatctccatgggttatttacatcgatcgtccttgctgcattgcatatgattgcaatggcgatcatcggccggaggagtcgccgctgcggtggtcggagacaagggcgtgaatggcggaggaaaggctgttgacggcggcgatgaggccggcgaagccctggcggcggacctcggtgcgctcctcctcgaggcgcagccgccgctcctccagctgcagcagctcccggtgccggcgctcccgcttctcctcgcacgccaccagcgtcctcgccaccacggtcgcgctcctcaccacgctcgaccccagccggctcagcccccgccgcttcgcctccggctccccgccagacccctcatcctcctccccgactccgacgaccccgacatctcctcctccgctacacaaataaatcacacacacattagtcaaccacttaattaatcgatcaatcaattactcactccgccccaaaacaatacagttttaaactattcatatccaacgttttaaactattcatatccaacgtttaatatttaactaatacacttattgttattagataataaaatataaatagcatttttaaatgtaactaatttttttaattatcaaaaataagatagaacggtcaaaggatatctacaaatgtagtattaattactgctaatataggtatagttttgttgatcgatacaaaagtccaaagtagttcaagatacgcagcgcggcatgcatgcacgaggagaaaacaaaaggtgctttttttttctccaaagtttcaggcttttttttcattcaaagcgagtgatttcgcaatgtaacgcattacgcatgcttgcagcatggcaggagtagagggtagtatcgtcgtggagtaaatctttcaattaaacccccataaaatatccggattcgcatcacctttcccatgcatgaactgcaccacactgcacgcagctttattctcccaacccctgagttgaggacattattattaccgcgaccaccctctcccgaaccccacggtaaaaaggtaaaaaaaatgtagcggtagtaaataattacgaccagctcaactcaacaacgtaactagcccaatcataacgcgggcttttaataacgtatagtggcggagctcagctcgctgcgaggtgggcccacatatcagtgtgagagaacagtagtaaatggtttggaggggaggggatgtaacagctactatgagtattaagtgtacggtgcgcgcaccgaccattaccggaaacggacgccggcggcggagccacgaccgccggagggagctgcagcgacgacggcggcggctgaggagaaggtgggtggtggtgatggccgtgatggtggtgctgctgctgcgcgacgagaggcttcggcggcgagggcggcggcggcggcgtcagcggcagcgcgagcggtggtgacggcggggtgggcgcgatcgtggccccgccgcgtcgcgccgcgcggcgggagagcacctcggagagcgcgtcgtagacctccggcgccaggttggtggggaggttgcagtccttgcgctcgtgccgctccatcgtccagtacgacgggagggggtcgtagttgtcgtcgaccgcaccgccggtgtcggcggcggcggcgacgcgggactcgtagtcgcggaccttcttgtagtcgcggaccaggttgtcccacttgtca

SEQ ID NO: 30546 - DNA, 12360 bp, Oryza sativa
  unsure (1)..(12360): unsure at all n locations
cagcgtccagttccccttgcggtggtcccggggcgccgaccccgacgccggcgacggcggcggcggtgccggccccgtcgcccccgacggcggcgtagcagtcaggtgcccgtggccgtggccgtgcgcgcggagcagcgcgagcggcgagaccgccgcccccgcggtcgaggcggatggcgaggggtcggcagaggagcccgacatgctcgctcgctcgcgcgcgcgcggcgcggtcgtgtcgtcgcgggcgtagcgactggcgagagccaaggcaagctgaggcgtttggtgttcggggagcgatgcgcgtcggcgtcgcccgtatttacaaggccgcacggcgttgtgtttttgcgtgtgtttccacccgttttttccctcgttttttttcctctcctaatcaaccgagcgtttagctggttaagtagtcgaggcgagcagaggcgttccatgtgagcgagtgggggctgagctgagctacttcgctctcttctcatgtgacagacctgacactgctcatcaaaactctgttcgggtctttttttttcttcttcttcttcttcccggtcttcttttcagttcgctgactcttgtttgtttcggtttgtaactgcactgctgctttaccttaatcacaggctttaattaattactgctacttaactattttctttctgtaacacgctgatactactaccttaggctaatggtgccaaatactagcatgcgttttgcaatttgccgtgggaacggagggagaagtagagagcaccatgcatgcaaatgcaaagcgtccgctagctgccggggcgtcctctcctcatttccgggcaaaacccggggccccttttatctgcaccggcctgccacgccatactagatactgctaccaatagctttttaacactttaaccccacactttaccatggacaggacaaagctcaatatagttatagactttggtgcaatgctaacatattaggagatatttaagtatttgctagttgctactcatagattacttgacgtttagcaatttgttaccctatgcgtctactcctatgtcacacgagtgttaaattgttgagaggtggcaaataattaaatgtctcgcatatactcaatctgtcttttaatagatggcgttattgattttttttatcatacgtttgatatttcgtcttattaaaagacgtgtgataaaaagtgaaagatgtcatttattaaaaaaaataaatacgagagggagtatgtatatatgcaattaaaatgattgatgcaaataatgcagctatgggatggagcacacgtacaaggtgaaggtacaagtaaatagtgcctaaattgttcgcatgagatgttgctcaaaaaaccatttcccaaacgtgcttggtggaaccgtccctatatatgttactgtgtgagaggtgcagcagagtcccctgtttatatgtgtgcaaaaatccaacggtggcgcactggcaactcccccagaatccctgcacttttcatcgaggagccttttcgccggtactctgggcctgttggttttttctgcagtttagcacatgatcaatcaaagtatcaaacaacagacacatggaaagaaaataaaataaataaataaataggtgaataaacgaactcttttgcaatcatttagtttgctttcaggagtccccacagatgtggttttgcacattaaggctttgacacttgggagcttgggacacagaagcaactaggcttaggtccactccatatgttccatttgtatagagacgtttgcactttggactggatgacatgttctcttctctcctttttgctgcattatcttggtgctagctaggcccctcctctcctctattgagcctgcaaaaagaaatgaggaaaattgaatgcacggatgatcctgctctcctagccaaatcaccctaccatgcaaatgcaagctagaggtgttaccgtaccgctgctaatcaaatccaagaacattcttcgccaattacggcttttttccttgtcctttgcttgcaaagtaaacgcgcgtgaagggagggggtttacaccggtggcgcggctcacggttttccatcttgtcacctcacgctgtcacacgttgcgctatggatggatggatagctcatagcctcatagccccatcggttgccccaaaaatatataataagtcaaaaccaaaatttaaattttgaaataaatttttcagcattatcttttaagtcgtaagaacacacacatatataaaagtttcatacagtcactgataaagtctaacgatcccttatttgctgaaacggctcgctcggcaatgcgttttccggcgttttttgcagggaacgcgcgcgcgttgtttgctacggagtacttttcacgaaattgattgggtcacattggcccaaggatttacgggtgacgcctctgaaaatggcccgttgggttgtaaaaagaagcgatctgcagactgtgagatgggcttgacttctacggccagcggatcagcggacagccagagcccagaatcataggcaccttctacggcctattccaattttgtactacctaaatacgaagttctttgtttttcatttcatttcatcacaagaaaataaagttctaagtgatgaaactgtggtggaatgaaaaaaaagaacaaaaaacagattttaagttatgatgaaatggaagttctgagtgatgaagctgtggtggaatgaaaaacaaaaaacaggttttaagttatgataaaatggaaatcaaaaaaagatcaaaagattggaggtgcggggaatcgaacaccgtgcctctcgcatgcgaagcgagcgctctaccatatgagctacacccccgttgtgacggtgagttgctaccaatgctgtagtataacaattcctaacgcctttaaccgtgataccttcttctaatccagatactatttggttcctgctaaaagggtagacacatttcttaccgtgaggagattgcattcgaaaagacagatttgctacttgaactgagtctgtgacctctgctgtacttcctccgtcccaaaataagtgcagccatggctttccgcgtccaactttgaccgttcgtcttatttgaaatttttttttaaaaaaattaaaaacataagtcacgagtaaagcactattcatgttttatcatctcataacaacaaaaatactaattataaaaaaatttcaaataaaacgaacgattaaagttgggcacagaaactcatggctacacttattatgggacttattatgggacggaggtagtattcagcaggctacttgcatattcagataagacccaacctggggcaagggaaatttcagaaccatgtgcaaacactctcaatgtgtcaatagcaccagaatttcattacaatggttgctctgtattgctttcaaacaggcatagttgcaaggaaaatattactgtcatcacaaggcttgccttgtgttgctttcaacaagcatagttggctacaaataaatgtgtattggtttattggaagctttctcatttaagaataacaaccagcacactcatcgatcatggcatcatgcaagatcgatgatgaatcacctatacaattgagtgctatatcaatataattttggtaacccgattgaactacttctagaggtacaaggaatactcattacttaactacttctggcgtagggctacaaatacataacgaacattcctaaagcaaaaatcatgctgctgcagatctttcattgccagggtctaaattcaatgcttgcagtaacttcggccatgattctggaattcctcctggtagattgaactccaatagtttaccacgtgctctgtagaagtcctccactggctcacactgcaaaaatgacagcttagagaggacggcacgatgccaaagtaaactaaatgtaaactttcccttattcagcttttcatttgcacataaaataagacaagccattagtgcatgataaattgagtataaataaaattaaaaaatgagtttatttgttttttaaagaaatttctatataaaaagtttttttttaaaaaagaaacacattgtttatcagtttgggaagcatgctaacggaaaacaaggaatttgcaactgccgaatgcccaaacaaacaaagccttagtcttttactagcaaattacaagtgaggaattcaataaataaaaataacacaagctagaacataccaaatcatgataaacacgcaatcgctcctttaccacctcttcagtatcatcaggcctagttatcaactttgattcacactgtggaggaggcagtagtggaggcatgtacattcgaggaccaccattttcgccctccatatcaatggacgctacattaaaatttccaccacactggctgcacatccttctaccaaggcattttgcaagcagagcctcttctcggagtttgaggttgatgaccaaatcaatatccgtgactccttcaagtatctcctaccaaagcacaaaatagttccagtggataagatttaacaagtagttgatgattgttggcctcaacgatatatgcaatataggcacaaaaatagcatcttaactgatccgtttatggaattatggcacacctaagtaaactaatgcatagctaccaacttatgcaaaggttaacaaattgatttgtctagtcgccaaaatgctgctagtaaccagatcaagctgattataaaggcacagcgtcttaatgttgaactgccaaagattaatactacctcagcaatcaagttacacattatgtgtatcaaattgcatgctatgtatatgatttcacctcttaaatatgaaaatgcaaatttgaaggcaaatcataattgtatactgagaagttgcaagtatgtgttttgcatacttacagtcaggtcaaataactagctcaccgcttgtcttatggttcttggaaaaccatcaaggatgaagcccagctcacccttttctgctccctcttcaagccgctttgacagaagatttattatgatctcatccgacactagctttccattattcacaatctccgcaagctgaaatcggatcagacacagaacaatgaaaaacatagaagtaatacattactattctcacatcaagccatctctttaggcaccctaaggatcattcttttcctgttcgttgttataaccacacgtactacaaaaaaatcttacataactcttacaaacaatgatcttaaccgcttgatttaactagatgggggttagaggaaatctagatttacttatagcataataagactttagtaagaacaatttagtacttaaagccttttccgtactcgatgcaggggatccatcaacttaacaaaagcaattgacagcaagaaattggaatctgaaaaacgcatgctctcttgttcattatcatccatccccatcaccatcattgtgagacctcgaagggcgaaggccaagagagaggaagagagaaacggaggcggcgtttcacctgctcggagaaggggcccggggaggcgagggcgtcgcggacgaaatcgccggtggcgatgtggggcacgcggagcatctgcgagaggcggctggcgtaggtgcccttccccaccccggggcagcccaggaacacccactgcacgcgcctcccgtcctcctcccgctcccgctcccgcccgcgccgcgccaccgccgccgccgcccgcgccccggccgccgccacctccttcgccgacgacgccatgctccgccgggaccccgcggcggcgcacgcccggatcgcgcgcgagatcgccgccatgggagaagcgaacgaatggacagagatttttttcccccgattttctgtttgtttttcgtgtcggagtagtagtatttttttgactttgccgtttgagattttttttttttgatctcttggagttcggggaaagcgttaggtatagagaggcgtagcgtgggtagcgtggcttaagcggtgcgctcacgtgcgtcaataggaaaagggctctcgttttctttttggaaagggaaggttagggttccacgtggaatcttgggagattctgccatcgtggacatgtcagctcaaccggtctccctcccaaatctctaagtgacgatggagtaaatacatatatatatatatatttgagtcggtttttaaaattatttatttttgtaatacagaaggaatcatataagaagtctgtttaaaaaactcgcatactaccttgagacgatctcgaactcctaaccacagctcatgattttctaaaaaaatatatatccaagcgaactcccacaataaatttcatcttaactaatccatataacaataataaaattaaaatatacttcacccaattaaaatatacttcagcacgaacattttttctagtatttataaaaatttaaaaatatagttacgtataaaatactatttacattttatcatctaacgaaaataaaaatactaattagaagatttttaaataaaacggagagttaaatgttgtattaaaaactgaattttttttaaggaagtagcgttttattgtagtcacaagatgacctgtcatcttcagaactatgcgtggcgccaaatttgtgttccaccacgtcgacgtcgaggtcagctgccatccaccgccggcgacggtcaaaggctcaaagcaagcaaaggcatgagacgagacagccgtgcacttctccctcgcaggttgcaatcacagcagcaaaagacgaacaagcaactccagcccaactactcacattcattcactccaaggttgttactagcattaattaattgaaactgtgtcccagtacaaagatctcaagcatgatctcgatttatttattcaataataacatgacaattacataattattaattaataattttgattcatgcagttaatcccctacatgaacttgaacttgtatgagtgattgaatcatcaagattccagggcataggcatggcaattgaatcaatccagattccatgacaatggcagggtggagcaggttcagttttttcaggtcctgcaaatctgaaggggagcaatgactccggccatctcctcgtaggccttgacctggacgaggtcagggatgcccttctgcatcaggatgcgcttccggcactcatcggcggcggcgatccccgacgagtaggcgccgtggacggaccccgagtggtcggcgctggccgcctcgccggcgaagtagaggttctccaccggtgcggcgaaccgcgccgacacgtcggccggcttcccgaccaggtcgcacgagtaggaacccagcgagttcgggtcagaaccccagcgtgaaaccaaatacttcgtctgcaataacacaaatcaacaagtgcaaattgtcagtcgcaagaacaacgaattcattcagataatgcgaactcgaaaatggaactaactgtggccatgatctgagatggcaaactcacaggttcagtggcgtcaggtagcattttcttcaggtgagacatgaccagatcaacggcctccttgtctgacagtttttccacttcttgagcaaatctaccggcggccatgtagacgaggaccggattgccggtggccttgtggaggttcaggaagtacccacatgctttaggcgttgggccaaccattcccagcacctcaacattaggccagaagactgtatcgaagtgcatggcgatcttgttctcgataccgacaccaaggtctgcgattgcagagctcttccatgagggcaactcaggctcgaacttgattatgtttgccttgagcacaccgagcggtactgtaatgatgcaagcatcggcagagtaacttgttccatcttcagtggtaactgtcactccattgaattggcgggcaattttggttaccctgaagatttagcagtagcaaaagcgagtaagcaaaactgtttagcaatattgacaagtgaaacgacaagtaattttgtggagccaaaatacactgaaaaagggacttcagtatgctgaaattaattgttgtgtttgtatgctcgggaggtaaaagaacacacctttgattaagccggatatctagaccttgtgcaagagcctgaattataggatagtatccgttcaccatcagaccatggccaccggtaagaacatgctcctgcatagttaagaggaatacaaacataagtaactaactatgcaagatggcaaacaattcgatgtaatttaccaatatccttcactaagcaaactaatgtcactataagaatgtgcagtgtgctaatatagactgatttcagctaacctgatcccagtttttcagagatatttcatcagcatctgcagcaaaccatgcctcaagccgacagacacaccattgcaagacttgatcatctatcccttgtaacctacaaataatggtaaccatatcagtcaacctctcatgatgcatcctaggaatttattaagtatgttgtgagtaaattgatagcatggtacaagaatgtgcatacttcagatgggggtgcctctcaagaacaagtgaaatcgcctgtagaaggggcatgtcatgttcctgctcatcacgcactttaactgtctgcaatgcaacagaaaattttttttggaacattaatgcaacagaaattagatagtgaactgaacatgctcttcaaacggcaccagaagtaccaagtataaatgagttcattatgtacctcatcaagaattctttcaaatgtttcttcaactttagcaactgtctcctttgagacctgatggccagccttatcaaagagtgcataactgtaacagaatcaattgacagagttgatgtaagaatcaacaaggattgtgcggatcggtaaagaaaagcgtaagatcaagagctaaaagattacctttctaaatcatgatcatacagaacagagttgtcgccactagtgcgatataatttcagcccaagatagccaatcaatggtgccaaggagttctcattacaaacgccgtggagcctgaatttttggaatgaacagtaagtaagcttgtatgaacagaatctaaagtgaatttctcacactaacaattcagggtgagactgaccatgaggctcccatatcaattgggcatccgaaagagtaatcggtatggacacgaccgcctacgcgatctctggactccaaaacagtcacctcaaacgaagcattggagagagcacgggctgctgcaacccctgaaattcccccaccgatcacgatgacggatggaggcgaagcacattgcctctcaatggtcggaagcaagaggcctgaacaaaaaatgttttttactgtcaggtatgtgaatcataagagagagaaatcacgttgaacatcaagctcactaatctacataatactgtagatacccaagttaccaactaactaaccaatttgtacccaactagaattataaattctaataatcttgtaaaatctaaagtgtgatgatcaccttccctatgtggaaaatttaattctaaagtacaatagatagatttctaaaaatactatgatcaatgggaaatattcccacctttcacgacgcaccactaccaagtactcctaccagataaaatttcagaaaaaaaaattacaaaaaagtgggaataattcatacctccagttttgaggctattgggatccatagccgccagcgccgaagccgaaggaagagaggaagaagaagaagaagatgaacacgaagaggaagaaggtcctcccgtccccgtacacgcagccgcgaggaggaactccgcttacaggagattactactaatactactactggaattacaattattactactactgctactagtacgtatgggaatcgagatgaagaacatgaacacgaggaggccgtcctggcggcggctggcggcgtagcagcggcggtccgcgaagcagctcataaccctatcttgggctccaaaccggcaacacccgcgaggtccccctccccacaattcaactccaaatcctcaccaccacctcgaggagaggtagatcgcttctcttctcctgcgaggtgggtttgatctggttggcgcgtgtgattttgggtggggtccttcggttcggtttggtatgaagttgatgagggggttggggcgagtcttatatggagcggaggaggaggagtcggagtcggcgacgacacgggatcccagcttccgcctttgcgtttgcgtttgggtcgcgtagccgcgtttggctcccggacatgtgggcccaaatgcggtggaaatagttggcgtcggcaccagtttgtttttatcttttcttccttttacaagaggaactactagaacacagataatatatatactccctttgtattttaatagataacgttacgtttgagtatcgtcttgttaaaaaattgtgcaaatacgtaacatataaataatgctttaagtaattttaatgataaaacaactaaaaaatatggtaaatgataattacgtattttttaataatacgattagtcaaacgtgtattcaaaactcaacgacgtcatctatttaaaaaggaggtagtattgagtccgttttttaatatgtggttgttgacttttagacatatatgtttgaatattcgtcttaaatattttgtgtaaatatgtaaaatacaaatcatggtaaaatgcattttatgataaaacaaaatacaatgaaaataaataatagattttttaatgaaatatgtatttttgaaagaaaaaaaatgatttttaggtggtgggggagggaattaatgtattctctgtttgtggctattacaatttacaagtctgatgctacaggatgggatggacattgcaaattgtggcagcagatgttacagtggaatgaatgcgtttgatatggttcacacgatggtggaatcgtttccgaatatgcaggatgctgtatggtttattattagtggagatctacgtatgaaagtaaagaaagaaaaacctccactgtttatgaccattgaactgcaactagcctgcatctacaaccctatatacatgcaaaatgaagcaaatgggggcgcaagccaagttcgatcagacgattactagtttactacagccctccagtctcaaggcaaacactgaaaactaaaataaattcagcagtactgactgggaatgtgtaaatgaaaagcaatatccatggattcagagaacaaggtctgttgatatataattattctgtttttatttgaatacacataaacgatcaaactgtgaaacggtacaggatctgagataattaggaaactacagagcagcagctacaatattaaccatagcagctgcaggataaacacggtgctaaataggcaggctttgttcttctttcacagcctggatatctggaaggggaccatgacttcagtcatctcctccctcatgataatcttcccaacctggaaaaggtcggagatgcctagctgcgtcgacagatgcctctggcaatcctctgcagcaacaatgcctgaagaataagctccattcacggaccaagagtgatcgatgcaggcggcctccccagcgaaaaacaggttgcccaccggagcacagaatctttcatacaagtcagctggctttcccaacaaggtcgcaggaataagacccaagcgaattcgggtcggttccccaccttgaaaccaaatactggacctgcagttgtgtagcacaagtgttagagctactgttcatagtctgaaattgacagtactcaactgtacatggtctgaaaatgaattttgaggatttaccggttcagtagctcctggtagcattttcttgagctgagacatgacaaagtttacggattcttcatcggatagcttctcgaattcatatgcgaatcttcctgctaccatgcatacaagaaccggatgccctgtggctttgtgaaggttaagaaagtaaccgcaggcatttgatgttggggcaaccctgcctagcacttctacatttggccaaaatacactattgaagcggagggctattttgttctcaatgccaataccaagatcagatattgatgaaagcttccaatctgggagctcaggttcaaacttgatgatatttgctttaagtacaccaagagggacagttattatagcagcatctgcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30547 - DNA, 702 bp, Oryza sativa
  unsure (1)..(702): unsure at all n locations
tcttttaccacctcttcagtatcatcaggcatagttatcaactttgattcacactttggagaagccagtagtgaaggcatgtacattcgaggaccaccattttcgccctccatatcaatggacgttacattaaaatttccaccacactggttgcacatccttctaccaaggcattttgcaagcagagcctcttttcggagtttgaggttgatgaccaaatcaatatccgtgactccttcaagtatctcctaccaaagcacaaaatagttccagtggataagatttaacaagtagttgatgattgttggcctcaacgatatatgcaatataggcacaaaaatagcatcttaactgatccgtttatggaattatggcacacctaagtaaactaatgcatagctaccaacttatgcaaaggttaacaaattgatttgtctagtcgccaaaatgctgctagtaaccagatcaagctgattataaaggcacagcgtcttaatgttgaactgccaaagattaatactacctcagcaatcaagttacacattatgtgtatcaaattgcatgctatgtatatgatttcacctcttaaatatgaaaatgcaaatttgaaggcaaatcataattgtatactaagaagttgcaagtatgtgttttgcatannnnnnnnnnnnnnnnnnnnnnnnnnnnnnnnnnnnnnnnnnn

SEQ ID NO: 30548 - DNA, 285 bp, Oryza sativa
  unsure (1)..(285): unsure at all n locations
taggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgtgaagggagtgaacgcgtccggcgcatttccaaacgctatgtgctggtagaagggaccctctatcggagcgcggctaacggaatcctcctgaagnnnnnnnnnnnnnnnnnnnnnnnnnnnnnnnnnnnnnnnn

SEQ ID NO: 30549 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnncaccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccggaacagccgaagggatgggcgcaccccgatgaacatctcgcacaagtgcgcgaagatggccaatgtcattaccgcgttgggggtgaggtgcgccatctggagatcgtaaaactccagaacatccacgaagaaagaagaaaatggcggaaccagccctgccatagcaaaagggaggaagaagacggaccgccccgggtagcgtggcgccgggcatccttcgcccagcgagactatctcccggccggtcgcagattccggcatgaagcggcgcagcagcccggcctgtctctcgctcacgatgcgggaaggcggagcacgctaccgtcaagcggagcggagccccgtgcatgatgccggaagaa

SEQ ID NO: 30550 - DNA, 358 bp, Oryza sativa
gaacgcgccggagaagttgttgttggagaggtcgagctcgtagaagtacgggaggccggtgaggtcggggacctcgccggagaagttgttggagttggcgtggaagagcgctaggtccgggaacgcgtcgacgaagccggagaggctgggcgcgccgaggccgtatccgttgaagtcgatggacgcgatggtgagcgtggtgttgtccttcggcgtcgttgcacccggcggcgccggcgggtgctcgcagtagaagcccttgtacatgtcgccgccgaagtagctgtcgcagaggttggggccgacccacgacgccgtcacgccgcgcgggtcgctggtgatggtcgccttgaacgcc

SEQ ID NO: 30551 - DNA, 617 bp, Oryza sativa
tgagagatgaaagatagtgggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaag

SEQ ID NO: 30552 - DNA, 524 bp, Oryza sativa
ttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctgaagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatattt

SEQ ID NO: 30553 - DNA, 14308 bp, Oryza sativa
  unsure (1)..(14308): unsure at all n locations
catatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatttaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggcttttagtcccacaaaaggttgatcatcgagttggccaacccggcttctttgaaagttttatcactctcgtactccaggtttgtggatgccctaggaatgggctgtacgaaatggaaagccttcttatccccgtcctccacttgaggatagcagaatgaccacaggagctgcggcgagatggataaagcatcagcgaacaatgtaggagaagagacaaaactatggaaatttatttcagtgttctaaccttaataggatccgtgtgaaggaaattcctctggatcctcctaccatcaggtaggcgaattgcaactctgcacaaaagctcccgacttcctttgggttcttcagggagaggaggatagttcagcttagcactcaggctaggctcattttctacctcaggttcaatcttttcctcactagtgtcagagcctttactctcctcaagagaagccgctactgcccgtgctagttcttcgtcttcatcctctgtggctactacgggtacaggggttttacctacaaagaaatggaactgtgaacatgtgcttttggtcaaccttgaaatgcattgcacgtaaccagatcctaacataataataaaaaaaaacacacacacacacacacaatcaatgctgcgaaattaatccatcaaaatatccccttaagtagtggcatccatatgaccataccggtaatattgaaaattacaaattttctttgtgcatgtcatgccatgcatggagagcttacgctaacttttgttatgcctacccctcttgcaaataaatctgggtagttgcttatcacaagtcaaatttgaaataaccttaacttacaatcgacacacaaagaccatcgttgtcagagggtggcaaaaccagttgtgacttttgcctaaagataactgtgattagacatgatttaaattctaattcctaactacacaacaaataaattgttgttgacatatagactactgaaatattttttttccttgcgtctggtctatgttatgcattatcattgttcaagatgagtgttaatggaaagtgatatgtcagcgatgattcatatccaagtttgaaacatggctaagacaagtactgccagaaaccatacatttccaatgattttcctattataaaaaatgtccattgagtctcgtgtccatactatccaattattgtgttatctgggccattaagaatccttaatatctagaagtacctgccaaaaacaagttgaaataaaccactaaaacttattgccagctatcaccaacaggataaaatctggtgacagatgatgtatgaggatagaatgactcgtaaggccaatcctccgactcccataaaggtcagtgattatgccaggcacatccaccagataatcatcgttatatcataattcataacaagagtaaatttcacaaaactacaggtattttgaccaaattatcacaactacagatttaaggagttgtatcacaaaactacatatttagcaccaaatttatcacaaaactacagattttagattaagtatcataaaaatgcatatttaatattgaacttatcacaaaactacaacttttggagtttaaatccctagcaccattgttatggtggagctataaacatcattactttgtgatttaattgattctaaacctatagttttgtgataatttagttactaaatatgtagttttgtgacacttcatcttaaatgtgtagttttgtgataaatttggtgttaaatatgtagttttgtgatacaccgagttaaatctgtagtttggtgataatttggtcatagtatctgtagttttgtgaaatttactctcataacaattacannnnnnnnnnnnnnnnnnnnnnnnnnnnnnnnnnnnnnnnnnagtgtaagaacgacctaactgtagttggatgatacaaatgaacaccgctcccccttatccaattttgtaaagcatcaaatgctagtacagctagcctacccccaacttgattgggaacaaaggctgatgctgttatactaagtactagaaaacaaaacacaatgcacctagaggcaccctcacatgacaatcatccctgctactttttcaagaattggacatccactcacaaggtttgaaagttttgattgtatggaagccccatatctttaacagatgaagtttcgattgtcacgaacttagcattaactatgcatctattccacaaaaaagttatttcaccgtgttaaaagataaatccatataatgtgaagaaagattgcaacgaaaaaagataggctcaacatatggttatttatgtactaatgtgcttggttcatataatagttctgcagaaacaaactattcgagcttaaatgtttcaaagggaaaaaaaaacatcactgctagttaacatatctttggacacaagccataccttgtttgccgatagaagtttcctgatcaacttttcttggccgtttttgaggttgagctgcatggtgctcctttggacctttgtccaggtaaggcatcaaatcctgtggacagttcacatgcagacagtaacaaggaataccatgtcaaatcacagttaagattccagtattagaatgtggaagtaagaatgttatcactacagaagttagtaacatgagagatgaaagatagtaggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaagcctctaactttgcctacatttatgaaattcattgtttttagaaatctgaattaaattggtaggttatagaaaattaaaggataatcaaattagtattatgaagttcatcagctccaggctttcacatgaaaattagtagcagtttactagttctcgtgcactggtcattagacaacaaatgaatttgcaacaactaataaaaacatcaatgtactttcaatgataaatagtgtgaacaaagaacattaagaagcatgtttgaccatgcctcttgttgacaaaagggaggcaatgtttgcttgagtaataaactgaaccttagcagctaataaaccgaactaattatttgacaggtaggattgttagcagctgagataaatgaagagttcgtgggttacatggcgtgctgctccatgataacaattcagtatgtcactaatagaatattgcaattttcccaatgcataccaaatgcccacagacaaagcaggttattgaagtttgcaggcaaaggcagcacatggtcatgttagagataaaaaggtaacaccagacgttaaataagaaaaaaaggatagctgaccttgtcgaagggtccattgaacatcaaagcaaatggtggacgatacaatgccgccagattatcacgagaactagatgcagcattctgctcagaatcccaaacagcagattgccttgactcctcttcaaagttacgaaatgcaactgttgaattaggccgaacgctgaaaagaagtcataaaaccgtttcaaatttagaaaatgatagattttaaattagtagtccacgttccaggaaaatcatgcaaaaagtttggttctattagtgctatacttctctttggttactgtggctcaacttgagtttcatctctagcctattctaattttctttagagtaaaaggctgttgttttagaattttggttttagcaaagcaagacatagaagcctaacaaagcatgtcggcccaaaagaaaagagtacaacaaaatttgggccttatcatctccaaaagaaagagtagaacaaaaattgcatcacttcccacactttaggtcattaggtgtggctcagcgctattccttccagatttaacaaaagtggactataacaaagaaccatagtaataatgtcatatgtattcaagagatgttgcatctaccaaagaaatggctaaacatcagcaaaatcaaccccaattataataaatacttggcacagcgcatttaagtatatatatctaagtatacccccttaatttgcagtgccattggggcagtcccagatatgccatcggtatcatagagaataagggataaaataagagctgtgactgatatgttaatggtcattgtgttgtcctaatgggtagaaggataacaccccgaataaaaacattcctaactttatctttttcaggaggcaacaatctctcctgttttgaaaataattggcagcaaatgaaatgactagatgtttcttctgatcagtaaattctggttgagttcgagctagtgattgtcatcatatctgttggtgacaagtaaagatatctaacttgtagccatgaacgaaatttgttggtgaccaaccaaataccaataatctcattggttgcaaactatatgaaagagatgttagtccacttggcaggggaagagagggcaggaggcttgactgcaaattagtggtactagaaaatggtgctagctattaacatagccaaaggtgcaatttaggccaaaaggtttatatcccatcagcaagccaacaatgattaccaacaacacatgctaattccattggacgagaacaaaattactataggttagtgacatctattcatcaccaaccaaacacacacatgccttttatgaggacttaagcttcgatttgaagccatcaaaaacttaaagctcccctaaacagcatggccttaacattgtcggataagagtttttttagacaatcacatgccccatgtaacctatcccaatttctctttgaaccaaaccaatgattctaggcattactagtaccgattttgtgccaccgatacaccctatttggctatttacatgtatcagtacatcacataaaccacaatcaccacaggggcagcacagatattgcattgaactagaagttgtctcacacaaagtcttaacacttatactgaggaactcaatcccaggaacccaactatcataaagagtttgctaaccaagcactagacttacacgaccatgggggcatcgccgtagagagtctcccgctttgtgggcagcggtgcccgcacatcctcttcctccccaagtccctgcagcattccatcacccagtgcagcagctgggggcggagcgaacctgcccatcacagcacacggtaagcgtacacaaaccaacagaaaactcaaggacccaaaaaccaaagcccaaacccgagaaatctcgcgccgatccacctatgacctacctcatcgcgtcctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagagggaaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcggggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttaaaataaaaaaggttaaaaagataaacaaaaattgattcggtggccggtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagcaagcagagcgagatctggaaggcggccatggcgcgcctcgcgctcctcgccgtccccgtcgcgctcctcctctccctctccttcctcctcctgcgccccgccttcccgccgctccccttctcgcggcagcaagcggcgtccggccccgaccgccgccgccttcttagggtctacgttgcggagcttccccgcgcgctcaaccacgggcttctcgacctctactggtcgctccccgccgccgactcccgcatcccgggcttcttcgaccccgaccacccgccgccgcggcctccgggcgcgcactcgccgtacccggatagcccactgattaagcagtacagcgccgagtactggctcctcgcctccctccagccgggctcgtcgtccgcgcccgccgtcagggtggtcgcggactgcatgcacgcggatgtggtgttcgtccccttcttcgcgacgctgtccgcggagatggagctcgggtggggcgccaagggcgcgttccgcaggaaggaggggaacgaggactaccgccgccagcgggaggtcgtcgaccgcgtcaccgcccacccagcgtggcggcgctccggtggccgtgaccacgtcttcgtcttgacaggtactgtgattcagttggaaattggaaatgtgctttttattttttcctgagtgaacttaagtgatcaaaatggcataatggaacgggctgttgatcatattaaccctccattgctcccaattggtgtgggttatatgttaagcattcgataggttaagttatgcttgttgtccgtctattatatactcaatcccaactctcaactagtatatgattggaaactagttttttctcctccatactcaatcccactttctgactgatatctacagggtttagctactcaactctaaaaactgtgagctgatttaggcttgaaatcattttgtgtgttctgttagttaccggctatacatgtgatttgttgctcggcgcctcagtgtaagacttaccaagttcccttttccaaacagagggagtgtgcccagaacagtgagcacattgacatgtagatttaaccatgataggaacctcacaatgcactcataaatttgaaattagttatgtgcatacttggaataggggggtcaaggtagctggttttggtttcttaggcacgctttacatgttttcttgtgtaagggagtggcatacccttgaaatgccatcattaaagaaaaacaattttgaaccatgtgactttctgtacatttgtcatcaaggggatattggtaatcctcagtgtttcggagcaaaagacacaactgttttgcaagcaatgtaggaatacaagatatactgtttatgttttcgttgtaattgatctgcatagtagcttattattcttttgtatgctcaggttttgttaaatattgaggcattctttgacagaccctgtggcgatgtggcatgtccgtaaagagattgctcctgcaattcttttggtggttgattttggcggatggtacaaacttgattcaaactctgcaagcagcaatgtttctcatatgatacagcatacgcaagtgtcattgctcaaagatgtcattgtaccttacactcatttgctccctacaatgcacttatcagagaataaggaccgccccactcttctgtacttcaagggagccaaacacaggcatcgggttcgtaccatttatcatactaataagcatttaatgtatgcatggcaatatttatcttctttgtagtatctgaatctaagcaattggaaatgaaaatggaataaaagaacatgttagtatgatatgggctatcttaaaattttattttagaacctgttgagtctgaatccacagctctttgatattatttagagtaaaggggatcctctagagtcgacctaaaggcatgcaacgttgtgtcatcccagtccctaaactcgcaaatcgaccgttcaggttctcaaacttgttcgactgtgtcatcccggtccctaaacttgtagatcactcgtataggtcctccaacttgttcagttgtgtcacctcagtccctaaacttggatttgaatatcatctgggtcaaataggcgggtttaaagactttatatttaaaaataattcataactttttcatgtgaactctaatgaagacaaactttatatcaaacttgtagccctcgacgcgatctacaactttgtagtcgatatttttttttattttaagtcattttttgtcccagaatgtaattttaaaattaaaattacaannnnnnnnnnnnnnnnnnnnnnnnnnnnnnnnnnnnnnnnnnnnnnnnnnnnn

SEQ ID NO: 30554 - DNA, 1713 bp, Oryza sativa
  unsure (1)..(1713): unsure at all n locations
aagtttagggaccgggatgatacagtcgaacaagtttaaggacctgaacggtcgatttgcgagtttagggaccgggatgacacagcggtacaagtttagggactggtgatggactttactctattatttatgtatctacaaggaaactattgccatttgaagcattatgctctcaacagaacttttatttacaaaccagctttgtttatgacttatgagattgttgttctgtactactgtgcatctctatacagctttatcttactataacttctgaaattttctttcagggtggtttggtacgggagaaactatgggacttgatggttaatgagcctgatgttgtcatggaagaaggttatcctaatgccacaggacgtgaacaatcaataaaagggatgcggacatcagagttttgcttgcacccagctggtgacaccccaacttcatgtcgtctctttgatgctgttgctagtctgtgcatacctgtcattgtcagcgatgagattgagctgccctttgaagggatgatagattacacagaattcgccatttttgtctcagtcaataattctatgagaccaaaatggctcacaaactacttaagaaatgtccccaggcagcagaaagatgaattccgaagaaacatggctcacgtccagcctatatttgagtatgatagtatttacccaggtaggatggcctctgctgcacaagatggtgctgtgaaccacatctggaaaaagattcaccagaagttgccgatgattcaagaagcggttacccgagagaagcgaaaacctgatggaacatcgatccctcttcggtgccattgtacatgactcgcgagacatgattgttagtattagcaatcaatcccccatgggaggagttagttagcattccctgccaatttatggattgtttgtagtgcaaatatgagagaaatttcaacagtaggtttatgctcttgttgtcaattgtatttcgtctggagtgattccccgcattgctccatgtgtgaggtttgttggttcactgccatgagaattcatatatgaatctgcccattcggcagacaattttccatattactcagagagaagcttgagacagtacgtagtcccttatatttgttgcttctaaatgatttggctagcgttcacccaaaatgcatgcatgatcatgagcaaaataccttttgattcaacagaaagagatccaatctatgatgtttggcagtaccaaattcaggacatgaaaagcaaaagggagaaattttatagtctcaacaacatgaactgtagccaaataacagataggctgccaacatggtggccaaaggaacggagatattgtcatccacaacatcattgacaggaatacactccactacagtagctgctaatgcaacaagagccagtttaccaagtgccagatcccagcagacagtgaagtaaccaaggcaagagaagtagaacagcatcctgtgatgcaaaagatccatgagttaacaataacaaggagtaacaatgcaaaagaaccagcaatgcattctgaagcaaaaacctacagtgcagatagaaggaagccagaaatgaacattgagatgcttcctatccagctcttgttctcattgaatggcagcttcgcggagccataccttctcccaacaatgnnnnnnnnnnnnnnnnnnnnnnnnnnnnnnnnnnn

SEQ ID NO: 30555 - DNA, 444 bp, Oryza sativa
  unsure (1)..(444): unsure at all n locations
nnnnnnnnnnnnnnnnnnnnnnnnnnnnnnnnnnnnnnnnnnnnnnnnnnnnnnnnnttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgtccccgcctatacggtcggttggtcacaccaccgttgatgggcattgtcatcttcaccgccggcctgccttcgtcgccggcgactggtgtccccgcctatacggtcggttggtcacaccaccgttgatgggca

SEQ ID NO: 30556 - DNA, 603 bp, Oryza sativa
  unsure (1)..(603): unsure at all n locations
agcatactgaagtccctttttcagtgtattttggctccacaaaataacttgtcgtttcacttgtcaatattgctaaacagttttgtttactcgcttttgctactgctaaatcttcagggtaaccaaaattgcccgccaattcaatggagtgacagttaccactgaagatggaccaagttactctgccgatgcttgcatcattacagtaccgctcggtgtgctcaaggcaaacataatcaagttcgagcttgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacatgaagaaaatgctacctgacgccacgaacctgtgagtnnnnnnnnnnnnnnnnnnnnnnnnnnnnnnnnnnnnnnnnnnnnnnnnnnn

SEQ ID NO: 30557 - DNA, 3679 bp, Oryza sativa
ctacatcgctgtcgctactaataggcatcagtatcttcaacacaagctgcctacgtttgccatggctaccgactgttttcttcacttccatggctgcatgattctgccagtgttgattggccttaccatcttcatcgccggtcgtctcgtctgctgctgactagtaccctcgtttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcaacttcatctttattatcttcggcactggcaaactctattgctgctacttcgcaagttttgctacttcaccaaccacgacgtctttatgagcctcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcggggactacacaactacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaagtaaagcatctacaacagctataacattaatttgatggattattatcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggattttgtcatcacctttgatctacctcgtctgtcaccgactgattattttgctgccatggctacacaactttatcgctgggctccttcatcttcattgttagttgatctgtctgccgccgactggtttcttcgcctccatggctatgcgacttcattacttttgattggtatcactatcttcgctaccaccaatatttttgccacctctggtgggcaatattctctctatattggttgtcttgtctctatgccaactgcgtcagctaccatcaatgaacaattgtgactacgtgctcaggggcttactagcttaaatacaagtattatatcttcaatttggacttgctccggatacatgcaacatgaattcatgatcatgggtctattttatatgctcaaagactggactatttattattccccgtaagggttatcaattgaatacttgcgccagtcgggattcaattgttacatctattttagagtatcccataagggataaccactcagatcagaagctattcatatgagctacgcttggtctatattacccggaagatttattactcgggagcatgttatatgcgtcatcctttaaagggcgtcgaaggcatatgttttggcctaagcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcatttgattggatacaatatcattgcttttcgccacgtaagtgtgcatttttattgaccaatattatggcttaggctgattatatgttgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcctatataaggtgggcaggaagccctctagggggcatgagacaacctgatcgtcagattaatacacactcggtggattcaaatccccaaacaggagtagggtattacctctcattgagagggcctgaacctgtctaaatcctttgtctccgcatccatccacttttaggtctcgtgcgctacccccttttattattgccgaattcatgtttcgacaccacgtacacggcggcgatggccgcgtgtgcgtcaccggccagtctacgatgggtagctgcagtacagcgaccgcagccatccatcagtgacgggatcactttaacggcatgatgcaaatgaagatagtattgccctattattagtgacaattgacaatattatggcatgcgattagcttccggcgcattacagcgcgcgagtattatttagtggttttctaggaggtgtaaagcgtttcaaagcaaagattaccctctcagcaagtagtcagagtcttatccgatgaagtacatgttaaattaggatactatatactactaagtgatgagaaagagagagaaagtgaaaattggaaccatgccattatataaaatttaagatatgccattttgacccacatgtcattgactcatgtgagttctttatgtcattgagataccgatgacatatcttaaactttgtaaaattataatggcatggttcttgtcgatgacattggaccgggagtatcgtgactagaggcttgaggcagacacaaatcgccacgtgggctggcacccacggggggggggggggg

SEQ ID NO: 30558 - DNA, 5588 bp, Oryza sativa
  unsure (1)..(5588): unsure at all n locations
nnnnnnnnnnnnnnnnnnnnnnnnnnnnnnnnnnnnnnnnnnnnnnnnnnnnnnncgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtggaagtggaggtaggtatgggccgtcccgtcagaaggtgattcggatggcagcgatacaaatctccgtccattaatgaagagaagtcaagttgaaagaaagggagggagagatgatgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctctcgcgaaccttccacagattgggagcttagaacctcacccagggcccccggccgaactggcaaaggggggcctgcgcggtctcccggtgaggagccccacgctccgtcatctggcgcgccaggtagggggctctgtgagtgatcttctgagctctcgcactctttcgtgttcgccaagcttttcctgttcagcccaatggccgagcaagcaaaggcgcacgacctctccccgagtatgagcggtgacgacggggagctaaacccacgccgtcgagctcgtactccaccgccccctccacgccaaagtcctaggcgggagaaggcgctcgagagggccgaaggatccgcgacttcgacatccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctggatgctggtgggcggtcctccgccaccaaggcctctggtgctgctaccaccggctccgcgtcgtcaagacggagggcgcggcgagcggcagccgctgttcgccattcggccgccactccttcgtcaacgcctctgacccgggaagatctgcgtgggggaccggatgcccgcatcagtatcgagcgccggcgtaatggccgacgtgctccccacgcaacggagggcgcctcctcgtccggagtgtcacctcaccacagacgcggggatcagccctccgtgcccccggttggtggtgtcggctgtagagcctttgtgacgagccttcggaacgtccgttggcccccaaggttccggcccaccatcgccgaaaaatatgacgggagcgtcaaccccgccgagtttttccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcactcgtacattcagcggttctgtcaagtccgcaacaccataccatgcatccctgcacacacggtgatttacgcgttcagggggggtgtgcggcacaatcgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgacaggaggaggaagaagaggtcagcccacaccgacgacgagggtcatgtcctcgctgtcgaggacgcttcgcgggccactcgaaaggggaggcctgcgggcgacaaaaagaaggaggccggcgctcctagtagggagcgcccaaccgacaagtggtgcatcgtccacaacacttcccttcacgacctcgcggactgccgtgcagtcaaaagtttggctgagcggacgaggaagtgggaggaggagaggaggcaggagcgccgagagggcaagtccccggcggttccttccagcaatcggcgaagtgaggccaagcagaaggcccccgccgaggacatcgatgacggcgatgatgacctaggttttcaagagccttgggccaccattgccactgtcgatgggggagagtgtgctcacgtttctcgccgagcctcaaggccatgaagcgagagcttctggccgcggcccctactcatgaggcgacgcgccgggcgcggtggtcggaggttggcctcaccttcgaccagaccgaccacccaccgtgcgttgcccggggaggacagatcgcaatggtggtttcccccactgtttgcaacgtgaagctggggcgtgtcctcattgatggagaaccagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggacccgccaactttcgcacggagcaggtgaactttgatgtggcggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgcttgcttgtatggagcagcgcgcggaccgcctcgccgtcgcgtccaagcccgagggtggcgacgagaggcttggcacatccgcccccgccgccccgaggcagcggatagtcacatgcgacgaggtcccggtcaaggagattgccctgggcgacggcccgtccaagaccacacggatcggtggtcttctggacggcaaataggaagacgcgctcgtctctttcctgcgggcaaacgctgacgtcttcgcatggaggccggcggatatgcccggggtccccaggaaggtgattgagcaccgtctcgccgtgcggccgggcgtaaggccggtccggcagaaagtgcggcgccaggccccggaacgtcaagccttcatccgcgaggaggtggcgcgacttctggagcccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccaacagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcagatctagcggaaacttttgagagtctccgctccgcccgcataaaactgaaccccgataagtgcgtgttcggtgtacctgcgggcaagcttctcgggtttttagtctctgcccgaggcatcgaggccaatcccgagaagatacgagctatagagcgcatgcgccccccagcaagcttagggatgtgcaatgcgtcaccggttgcatggccgccctaagtcggtttatatcaaggctgggagagaaggcgctacccttatttaagctcctcaaacgctccggaccgtttacctggacggaggaagctgaacatgccctcgcccagttgaaggcgtatctcagctctcccccggttctggtcgccccggagccagatgaacccttgctactttacttagcggcgaccccgcaagtggttagtgcagcgttggttgtggagcgcgatgaggataatcctcattcgcgcatccccaccctgtgctggcttggcccgggagagagcagggaggagaggcccccgagccgaacggcggcccaaggcccccgacgaccggagttggccctctgcccgcttgtcagatggtgccaggtgcccccgaaccccaggatggcctgagggccactgcgggaaggccgcacctatcaccctctgaccccgaggctaatcctgtgcccgctcgactcgggagagagcagggagaagagacccccgagccgaacggtggcctaaggcccctgacgaccggagttggccctttgcccgcttgtccgacgacgccaggagcctccgacccccaggacggccccggggccactgtgggaaggccgcccctgtcgtcctctgaccccgaggtcgtcggcacagaagacgagcgcgcctcgcgaggccgcttggacgaagagcgccccagggatgtggcccctagcgaaggggatcggccccaccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcatggtggttacgtcttaccccctcggccaaatcttgcataatcgagagggtactagacgggtggtgaaatgggcaatcgaactttctgagttcgatttgcactttgaaccacgccacgctatcaagagccaggccctcgccgattttgtggcagagtggaccccagctcccgagcccgtctcagtccccgaggccagctcgggcccctcacagctgcctcacaccgcccactgggtgatgcagttcgacggctccctgtctcttcagggcgctagtgcgggggtcacgttgacctcgccgagcggagacgtcctcagatatttggttcgccttgactttcgggcgaccaataatatggcagagtacgaaggactccttgcgggactcagggtggcagctggactggggatctgccgcctcctggtgttaggcgactcccagctggtcgttaaccaggtctgtaaggagtaccggtgctctgacccgcagatg

SEQ ID NO: 30559 - DNA, 1645 bp, Oryza sativa
tttgaagaaaggcttgcctagccgttggcgcgacccgaccccttagggaagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaacgcgtccggcgcatttccaaacgctatgtgctggtagaagggaccctctatcggcgcgcggctaacggaatcctcctgaagtgcattcctcgggaacaaggcgtcgagcttctcgccgatatccatgaaggcgaatgcggagcccactccgcctcgcgtaccttggttggcaaagcttttcgacaaggtttctattggccgacagctctcaatgatgcggtcgacctagtccggcgatgcagagcgtgtcaattccacgccaagcaaatccatcagccggcccaggccctgcagatcataccgctttcatggccatttgctgtctgggggctcgatatcttgggaccgtttaggcgggccccgggcgggtttgagtatctgtatgtcgcgatcgacaagttcactaagtggcccgaggcttatccggttgtcaagatcgataagcactccgcacttaaattcattaagggcatcacagctcggtttggagtgcctaaccgtattattacggataacggcacccaattcactagtgaacttttcggcgattactgcgaagatatgggcatcaagctctgcttcgcctcacctgcccaccccagaagcaacggccaagtggagcgagccaatgcggaaatcctcagaggccttaaaaccaagaccttcaacatcctcaagaagcacggcgattcgtggatcgaggagttgccagcggtgctctgggcgagccgaaccacgccaagccgagcaaccggggaaacgcctttcttcctcgtctacggcgcggaagcggttctcccatccgagctcaccctgaggtcccctcgggccaccatgtactgcgaagctgatcaagatcagcttcgtagagatgacctcgactacctagaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccgatgtgggagggtccgtatcgagtgattggtgtcccccggccgggctccgttcggctggccacgagcgacggcgcagaactgcctaacccgtggaacatagaacaccttcgtcgcttctacccctaagggggatcgggtatcaggatttaggcttgggccaaccccgcacccccctcgggcgtgcagggttggccgggggctgccacatatgcatattcttatttctcttatatctgtacctcaataaaagtattttcgatttcctaaaggctgtatctgtgctgttgtttccttttgaagaatcttgacttgaaataggtcactcgtgttcaatcctgccctcgggggctcgggtcggctaaaatcgccaaacggggcccagaaccgagcgggt

SEQ ID NO: 30560 - DNA, 9722 bp, Oryza sativa
aatcttgacttgaaatagtcactcgtgttcaatcctgccctcgggggctcgggtcggctaaaatcgccaacggggcccagaaccaacccgtgccccggggcgtggtgaactccgggggagaatcggcaaaaacccacaatcgggtcacccattaccctcggtcaccacgctcccggcctggccagtctcgacatgtggatctctccaggcactagccccgaccggagccatttgagaactaggacctgggcacgagcccttgttcaagccaagacacaagagaaccgcgggacagacatccttgtctcatacacacaacaaatagaattaacacaaaaaatttcctctttatttgattgcagattaaattagtctatacaagcagggggcccgaaggccttaaaaaaaaagaagatactatttaaagattggcgggggcctgggggctcactccgaacgcacccggatcgccggcctcgtcgccgctattgccaactccgccgtatcatcctccccgtcggagttgagggcgaacgcgagccgaggggccggaaccctcgaagctgtggacgatatggtcggcggcgtcccggacttgcgcgcgtgcgccgtcctcggttccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccttgggtggcggcgtacttcgcagtctgcccgccccagaggcccacctgccggccggcgcggtctagacgggagacggcatcccgaagcatgccgggccctacctcgcctgccaagcggagggcctcgacctccccggcggacgagtctagcgcgccctgcagatcggcgatggtgtgtccggcagttgcgaggcgagcggttaagtcgctttcgcccgcggccgccccgccgatccgtgccctcgcgtccagctccttctcccgcgcctcgagctcagcggcccgctggttcagcgcggtcctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggtccctctccacggcgcaggcacgctcttccagcgccatggcacgggcctcaagggcttcgtcgcgccgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcgacccacttccaccatggcctccaccgagcgtcgcccctcttcgacacgcacccatgcggcgtcgagctccgcccgctctgcttgcagggcctccacttgggcacttaacccgtccaacaccgtcgtgtttgcgacggccaaggcccgcagaaggggttctgcgctcagtggagcagcagaaggcgtggggaagagccgtctcggtgaggatgccgcgcggctcggcccgccaatggacgtgccggactcagggatatcccccggacctagcttatcctgggcgtcgcccgaggaattgggcccaagcgatgcgcccgcggcctcgtcgcaagctgcctcggaagtcgtcgccgcctcggcctggtgaagtctgacctcttcccgagcggcttcttcagctaggcgagcttggacggccacctgaacagcttcctcggcttctcgaaggcgatccgcggcctcttgccggtcagtttcacgggtcgcctcagaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgcctccgggcctctgtggacgccgggtcctcggactcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtccccctcatcttgcggggccgtttcttcttccgctccccctcgggctgcgacgtcggcgtggccccctccgggcgcctgctgctggcacgcgccgccccgccccctcggggaggagatgagggaggggttccttcctgcttcctcttcccccgggcgtcggcagggtggccgctccccgggcccccgtcgcgaggcccagaagcacgaccccctcccggggtagatcgttcccccctgcggctcccgaccgcgccatcgtggcctcgaggagcccgctcctccgatgccccgaccgcctgcatgatggtcaagatggaggcacggtctggatcactgcagagggggaggactccttgaggaacgagggatgcctccacggagctgagattcagcacccgttggaccactatcttgaagtcctcaggagcccagtcccatcggaccccctggtgggtcctcatacagtcctcggacccggtgtactcccaggcgccccgggcgcgccgctggagtggcgcgatccggcgacgaagatagtcgccgaacaccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaacggaacagcggagggatgggcgcaccccgatgaacatctcgcacaagtgcgcgaagatggccaatgtcattaccgcgttgggggtgaggtgcgccatttggagatcgtaaactccagaacatccacgaagaaagaagaaaatggcggaaccagccctgccatagcaaaagggaggaagaagacggaccgccccgggtagcgtggcgccgggcatccttcgcccagcgagactatctcccggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcggaggtagggcacaggaaacaaggagttagggcgcaagcggcgaagacaaggggaataatggcgaaagaaaggaagcaaatctcttcctcggcaactttatacccttgccaacgctgtgcccggctcctcgtttctcgcgcccactatcttgccccctcgtttctcgcgcccactcttccactaatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcacacgttactcgagtaatgtggcagtcttgaagagaccgttcattattgacagccgagtaaccgttgccgatgtgcgtgatttgcgactgatgggtttctgcccaactgtggagaccggtcccacctgtcaccaggccttaggaagtggcgtcacgcccgaccgcttccctcgaggagggtaatcgccccggcataacgccgggggctactgtcgatgacatgggaccgggagtatcgtgactagaggcttgaggcagacacaatcgcccacgtggcctggcacccaccggggggggggggggggtcgggcccgagggtggtgtgttcgccctcctctttgtctccccgagggggtcggaccgctcccgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtgaaagtggaggtaggtatgggccgtcccgtcagaaggtgattcggatggcagcgatacaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggaggggggggggaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcacctcatcccatcccaattcccaaacccaaactcctcttccagtcgccgacccaaacacgcatccgccgcctataaatcccacccgcatcgagcctatcaagcccaaaaaaccacaaacccaacgaagaaggaaaaaaaaaggaggaaaagaaaagaggaggaaagcgaagaggttggagagagacgctcgtttccacgtcgccgccatggccgcccgcgccgccgccggcgcgttcctgctgctgctcatcgtcggcgcggccaccgcggcgccggacatgtcgatcatctcctacaacgcggagcacgggcgcgggggctggaggaggggcccacggaggccgaggcgcgcgccgcgtacgacctctggctcgccgagaacggcggcggctcgcccaacgcgctcggcggcgagcacgagcgccggttcctcgtgttctgggacaccctcaagttcgtcgacgcccacaacgcccgcgccgacgagcgcggcgggttccgcctcgggatgaaccgcttcgccgatctcaccaacgaggagttccgcgcgaccttcctcggcgccaaggtcgccgagaggagccgcgccgccggggagaggtaccgccacgacggggtggaggagctgccggagtccgtcgactggagggaaaagggcgccgtcgcccccgtcaagaaccagggccaatgcggtaaggaatttcttctctttcctcatctcatctcccttgtgcgattatttaccattgaaagcttagatgcgattatctatttgtcacgctaatctcggatctaagtagggcaatttcacaacagttaattcaggttcacagctagtaatcttttgcccctacttgcaaaacagtgcagatttccttctgatatatacataatataatagtagattatgattatatagtcacacaccgtctagtctctagaaaagatgggtcatttttctagctaaagctgactttcccccctgaatgagcatatctgatttaatgacagagttattgttcttttaatacgatgataatttactggaccgaataattgtttggaattctatggtaaggatttattacgtagtggatgcaggatgtattcttggaaaatcctctcattgggttaactgtgtaaggtatttgttctcttcgttctttgcttctggagttggcaacggctgtgacttgtgaatcgtgcagtgacagcggtgtggacttgaacagattcaaagcccgccgttggttggggctgacttgctcagtgtggtttccttgtttccaggattgtagtttagcttagcttgttttttcctgattttaggactgccgtttctgtggttgtgctgcttttgtctttatatttttaaaggtctttttcggtgcatctatcagtcaaatactttggacaaggtgaccctgtaaccaactactaagacattaaaccgatttgatgatgttgctttgcattgcaactattttgggcctttaagacttttaagggatatcacaccttatcaacctttcgtgttcagtcgagcaaactttttatcctgtgctgggagctgtttgctgatattagcctacaggtgtcttcaaactgcttttgtgggtaaaaacaggggtgaaacaaatgtctgcaaatatcttactatccatcttgatcttgataatattgatacaattaaacagtttagggttcttgcctcatattacaattggttgcttgcggtatgattgcagttgttgctctcttggatgacactagttattttgatggttactgacatctttggtcttgaatggtgggatgcaggaagctgctgggccttctccgcagtaagcacagtagaaagcatcaaccaacttgttactggtgagatgatcacattgtcggaacaagaacttgtagaatgctcaaccaatggacagaacagtggctgcaacggtgggctcatggatgatgcctttgacttcatcattaagaatggaggcattgatactgaagatgactatccttacaaagctgtagatggcaagtgtgacatcaacagggtattaacttattttctgatgaataacttcatacattcatctttcagttcccacattatgcaaatcgctaatgtttcaacgggtgcattgttttaggaaaatgctaaggttgtgagcatcgatggctttgaggatgtacctcaaaatgatgagaaatcacttcagaaggcggttgctcaccaaccagtcagtgttgctattgaggctggtggccgcgagttccagctctatcattcggtaaatgaacttgcagatatcaccccatgcatataggaggttttggtcgtaacaactattgatttttacattacagggcgtcttcagcggtaggtgtggcacaagccttgaccatggtgtggttgccgtcggttatggcactgacaatggcaaagactactggattgtccgcaactcttggggcccgaagtggggtgagtctggatacgttcgcatggagcgcaatatcaatgtgaccacggggaagtgtggcattgccatgatggcatcataccctaccaagagcggagcaaacccacccaagccatctccgactcctccaactcctccaacaccacctcccccatccgcccctgaccatgtctgcgatgataacttctcttgcccagcgggcagcacctgctgctgcgcattcggcttcaggaatctctgcttggtttggggctgttgcccagttgaaggtgcaacctgctgcaaggatcatgccagctgctgcccgcctgactaccctgtctgcaacacccgggctggaacctgctcagcggtaatctcctcgctttcttgttcgttcttactgcaactttatactgcctacattctattccaaagattgttttcatcatagtattctgctccgacaagctatacggttttgaaaaggcacgaggctttcatgatctgaactcagcaaatatttgtcatcatgctttttctgaaaaaactagacattaaggttgctttggctccaaagatagttcagataactgtaatgcactaactgacctttcttctgttggaattgtgcaagatatttgaacgtacgaactgaccttccttttgttggaattgtgcagagcaagaacagcccattgagcgtgaaggctttgaagcgcacgctcgctaagctgaacaccgcatgagctcatcgataacatgtaatcggcgaggagaggggatgaggcagcgtggagcctttctgaaatttctgcttccgtgcctccatatatcgttgtcgcattttgaggggacagcttatttactctactgcctgccttttatcttacagtgatctgtgtacatagctcgatccaatttgtactcttatttatcttctccaatttgtactctatataatttatcatctcaagaatacattaacgaagatcctgttttaccgttccaaattctcattattcacttctgtcgaaatatagctacaactagtacatctgatcagtgaatttcagaacactgattacttgtaaggatacaatggaaggatgcaagaatgttcgtgtttgcatccttccctcttattgcgatgtgatatcagattgttgtcagcaatgcgtcaggctgagatttgcggcacaaattggtaggccgttttccgtttattgaccaacagttacaaagtttggaatcatgcgatctgaacgacaaaacgctgacaaagttggtgatcgctgatcagttcagttgccaccacctccgccgccgccgccttcttcagctgccacagccgaaggcaacgccgccgccggcggcctgaagcccggcaggtcgcaggggatgtgcggcacgaaggggcagtgctgcggcgggtcggcgtagaagcgggcgcactccagcgccggccgctggtgggggaagttggggatgcagttgaggcgcacgttgagcaccttgctccggacgagctcgaggcaatggcggcggccgacggagtg

SEQ ID NO: 30561 - DNA, 10412 bp, Oryza sativa
ggcccgcagccacacgtatccagcgacggcgccgataccttcccttgtccaccgcgatcgggcctccacgacggcgcattgcgcgacaccatggcgaagtgagtatggctggggtcacacaccacgccgtgcaggtgcagcgcggcgagcaggagcgcgagcgcgagcgcaagcaggcgcgcattatggcctgaagccgccgccatggacgcacgttagatggtggtgagacgtgggggggaagacgagttttaaggaggaggaggaggagatgggtccatggctccatgaactccattgacatggaatggatcagcacaagtggagcgtgctttatgggaaaaactatattcattttttaaggggatatcatctcgtttttacatgtcactcccaaaataagtgcagttttaacaccgttcatgctcaacgtttgaccgttcgtcttatttgaaaaacaattatgactagtatttttattgttattagatgataatacatgaatagtactttatgcgtgactaatatttttattttttttataattttttcaaataagacggacagtcaaaacgctggacacggatatctatggttgcacttattttgggacggaggtggtaaaaaatttagtgtagcagattatggctcggtttagttccaaactttgaatcccaaaaacgtcacatcgaacttttctacacacacaaactttcaacttttccgttacatcatttcaatttcaatcaaactttcaactttagcgtggaactaaacacaccctatatgtgatatgtcacttcaaacatgcatattcaaattcaacttatacaagtaaaaacaaaaatagcaaatttaactgtgaaaagaacacgtaatttacggttaaatttgtttgttatttttgtttcaaattacatatgtcgaattttaacttgcatgtttgcgaaaagatatatcatatattgatcacaatatatatcttgataatttttttaaaaaaaattttgataactttttaaacgatacgcacaaaacgagaggatgtcccgacaaaaatccacttccgctttatgggtgaaaagaggtgggaataggagagaagttgttttgccggggaagagaggaggcaatggcagccagcaaagagagaggcggtagtggggttggcggttaattagtcgtcatcgacggtaggagtgaagaagaagaagaaatgaagcagcgctcgtgcgtgcaggcagcggcggcgtgcagctcgcgaccactggccgagccgagcggggcgtgcacttgattccagggcgaagtggctacgtgcctagctcgcgaagtgaatacacacataatagtatggcagtgtgcggtcaaggcgttttgtgattttgagttgagttgttgatgatgggtcagtgcggggaaggcaatagcgtcggctttcctcggcaggagggcagaggctgcctcacgaccgggctcagtgctctgtagtctgtacataccggtagtatatgattggggcactggggcatgacaaaaggcacaatgtgtgtatgtagcaagtggaacatcatcatcttctgggccaggagcaaagatatgttcatatagcatattagcgtttgctaaacatgaagtcagcatgacatgactcggccggaagcaatatttgccgtctgattcataatagcaaaccagaaaaaaaaaggtgtcttctctttgccagaataatgcttactatattccatatcacaaataagtgtgcagatatgtgtactgtggagtatagaaaaagaatgttggaagatggagaacttatctgcttgacccagtgagtagtgaccctacaatttggatacccacccaagtttttatgttagtgtcccaaaaaggctctgcactggtagtcttgtaccataatgctcacacatattgaattgccaataggcgtcccctttcggatatgcctaagccaatttgtccactggtgcccgtaatggccttagcccctctaaagagaggtgttgcatactggagcctgagcagacaacttaagtttgaaaatatgttatcaaggctggctcatgcataatttgtttctacaatgaactgcacagaatttccaaatatgcatgtggttgctctgacttgtcttgttaatttttcttaatttctagcatagcgattttacaccaacacaaaatacttacatgatacataagttttgcagcaaattaatacaccagaatagtaaaaactgaacacaacggttcataagtagtagagaaaaatggctggccctagacgattaccaaagattcaggtatgcatgtgtgcagtttggcatcgaatgagctcactaaagtttattagggaactatttaacaatgagaatcaagaacactaaaaaaacggtttagtgcaccagcaaccaacatatttgtatatgccggctacagaaaatgatttcaggggaaaagtatatatcattatccacaagatatgtgcccatgataaacctcagcatgtgtcatgttacttgaaaaaatatacaaagcattccatttctcaaattgaacagagtgcatgtaaactacatcagcagtcaaacatgacatcttcgatatccaagaatatttccagtggtggttcacaggtatggagagtaactgacgaggttcatgaccaaccacatatgacaaaagaggttcctgataagacaaaagatgatcattatagagaagtatcatttctcaggaacaacagaagatggtctcagaacatttgtaaatttcatgtgtggtaacagttcaactccagaaaaacaaacttctgaaagtgattacttggttgtatttagagtgccttgaatgccattcctgggctggtggtttctctttttattaacaaagggaggacatcactgcctcgcctttctaagaaagaccatttttgccttagaaaaatacaacagaaatacagaatacggtgagaagtaactctatccatttgttcaacgagaatttatctcatctttgctgcccttagcccttaggtttttgtgggacttttcgagtaacaaagatccactggcattgccgttatagcatcttaaaggttttttgaactattgcaacattatgtaaacttgagattgcaagagttaaacaaaaatgttgtccatgctatcatgttaacgaaatgtgtagcatactaaatatgtgaaacacaaaagctattagtggtttgttggatttagagtataccatgaactagtaaaaaagattcaaaccgtcttagaagctcacccaatgtagcaaaaacaccggttactcagtcttcttttgcttggttgattctccagtcttgctaatgatggtatctaagtgccttgatagtacactgtgcgccataccaatcttttcatcgacttggtcctggtacttctcatacaatggtggaactaacagagaaaacattacacctagagaaaagccagaatgatacaattattacatatgagctatcataaaagaacgattgatccatacatgaataggtccaggaagttaaagagaaacaaattcagtagtactcaccaatgtaaatgagcgtaaggaagttgaagagcattccaatgtatgaaaccacccataaaatcaatataacctatatgaccaaacaaaataaggggcataagaagaaagcatacaaaggcaggtacagccatatagacgtacagttgtgtgtgtactagtgggcatggatgtgtgtgtataagagagagacctttataaaaacactcctatctctcttgatggcaatatcatggccaacagccaacaccttgttgatccatacaagagcccgatctgcagctttctcaacaaccacatctgagacctctagtttagggagtggtggaagaggcctgcaaaaatcacaactttgtgtcaaacttggatagatgatatgggcaatggaagtacaatgccagtcacagagaacaacataaaacaaccaaagtgccaaaaacagctctttctttttcggtttagcgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaacacgcggtgctgtagagccagggcaaaaacccacctgttgagcagcgaggcggacttggcccagaagaagaggatggcgacgaggaggagcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcggggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatttgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaacaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcaaagaaccgcccccttccgcggaaacggcagctgttacaaattccacccgagcagcagccactttcaacacacacgctcacccgattccccgcttcgccgccggcgctcgcatcggtcaagtcaacttgacgcccacacacgcaccgggcatgggcgcggcggcggcggagcaacatcaacagggcttccgcccgctcgacgaggcgtccctggtggcctacataaaaggcacgcccggcctattcgcgcgccttggggggccgcctggacgccctcaccatcaaggaggtcggcgacggcaacctcaactttgtttacatcgtcctctccgacgccggctccctcgtcatcaagcaggtccctatctcctccacgcgccgccaccgtcgccgttgccacacatgtagtacgcatcttctgtctccgttctttcgctgacgacgctgcaatccaggcgctgccgtacatccgcttagtgggggattcatggccgatgtcgagggagcgcgcctatttcgaggcctccgcgctgcagaagcaccgcgccctctgcccggaccatgtccccgaggtctaccacttcgaccgtgccatgtcgctcatcgggatgcgctacatcgagccgccgcacatcatcctccgcaagggcctcgtcgccggcgtcgagtacccgctgctcgccgagcacatggcggattacatggccaagacgctcttcttcacttcacttctctacaactccaccactgatcacaagaaaggaggttggttgatttattacaggtttggtttgcctgtgaaaattgagaagggagaaaaatgagaaccgaattgatggcatgttgtgttatgtgaattgcagttgctcagtattgcgataatgtggagatgagcaggctcacagaacaagttgtattctcagatccatacagggtcgccaaatacaatcgctgcacatcacccttccttgataatgatgctgcagcggttcgagaggatgctgagcttaagttggagattgctgaattaaaatcaatgtaactagctctcctgattaaaccagcgtttctctttccttttcattggagatgatggacatgatttgcatatgcaggtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggtgtgtatggatttattggctaataatagtaaatgaaagtgcgtaatcttacctgggtggttaagttgttttgcgtttgctaagataatggcaaccacatgtcttcctgtgtactaatttcgataggatagaagtttggaacatgatacttgtatcctatagaataactagcaattgatattgttgatatatgccgtatgtaacagagggaggagggtgctcagcagacgatgaatgtccctgagtattactccctccgtttcatattataagttgtttgatttttttcttagtcaattttttttaagtttaaccaaatctgtagaaaaatagaataacattttcaatacaaaacaaacatattatcaaaatatattctatgttaaatttaattaaactaatttgctgttgtaaatgttgctaatttttttctataaatctggtcaaacctaaagaactttgactaagaaaaaagtcaaacgacttataatatgaaatggagggagtacttaatgggaactgcagaaatgacaagttatgatatggcaaagtgcaattgcaacatctagattctagaaggtattttcatgatgtttcgccaggcataaaataagttctatgtctgtacatattttgcaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggtaattaaacagtacaattatgtagagtctgtactactaagtcaatttgctgaatcttatttacgtctagactatgaagatatactagacctgccctttttaaatgtaagaagctcaaaggcacagtaagttagtccaaagtagaggtttccgatgccaattttgatgcagcacttctttttcataaatgtatatcagtatgtgctatcctaaaagagatgttccagaagaccacctttgacgattataagtatgactgaaaaccgtcataaatggttaaattggaggctattcaggatattatgttgtgagaagctaagtgtaaagaacttaaaatcacatttaaacgccattttcaaattttttatctgtgttccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgagcaagtgattgtgcatgtacaatcgtttgatcgggactgataaggctaaccatctacacaacctttctgattgaggagacaaaagttttcatctgtttaccatcagcgattatctgtgcctattataaagcagaattggccggttatatgtgggctgggcaacaacaatgtatatagccaaagtagtccatacagatggacccacatatgtgggatttacctattgtaaccttcatactccctccgtttcacaatgtaagtcattctagcattttccacattcatattgatgtcaatgaatctagacatatatatctatctagattcatggacatcaatatggggtaccgagctcg

SEQ ID NO: 30562 - DNA, 3082 bp, Oryza sativa
ttacattgtgaaacgaaggatgtaatatatataggtagttagtagtattagaaggagagagaaagcagagataaataatatattttattctatataggcaactcatatgtttatgggtgacttttgctatttgcttgatatggactagttctacaatgttgttaggtggctgaatgaaatattgtattctttatggactagttctactatacattatgcatgctcaagtgtggacgctctgcaagattgatgtttttttttcaccacttggctaagtttgtaagaatcagtcggttgaatggcaaaagcttccccaaacaatttaactttttatctagattcaaaagaatcttaataaaagctaaaaaactggttttccctgcttttttatgctctcacaactagatttccatttctcagaatttaatctacaaagtaggttttccttagcttcctcgtagatttttttttcgagtaaagtgtacgagcggtacttaaacttgtagcggtatgtcatctagatcccccaaactctcaaaatgcatatccaggccctagaacttatcaaagtgtatcatctaggtcccaaatcgacacatcccctcttggatcctacgtggcgctgatgtgacctgccacatggacgtgacatgtccttttttttcttcttttctttttcttttctgttttcttcttattcttgtttttttcccctctcttttgctcgggtcacagacaaaggagaagaaaggaaaatgcaagagaagaaaaaaaagaaagaaataaaatttttaaatgggtcctatttgtcagtcaaaattatgccacatcatgttcgtgtgacatgccacatccgcaccacgtaggatcctgaaggatttgtggtgatctgggacctagatgacacactatgacaagttctgtgacttggatatgcattttgagagtttaatgacctagatgacacaccgctataagtttaaggaccgcccgtgtactttacacatttttttctggattctatagctataaaatctcataatatgattatttagggaattggagattttggaagaaactgtacatgctagaagttctccaaaagacctatctatactttgaacattctagttcatccggtgaatataatagagtttgtcaactttctcactatggttcgcttggtcatgagaatactataatgatttttgtcttgtgagctagtttcatgccgtttaatatggaggactggcactttcatgctgcttttatttggatatgatgtcattttgaagatacatgatgctagcattgacggcgacatcaagccgaagtatggggccaaacacagtcgatatattctccctgtttgttgaaaagaacagcgtggaacatgcgtaccaactgattaatcgttcggatgctaccttatcaactcgcagagttcattgaagggacacaataattgtgaattgtaatcctctaaaatatcacaataaatttctttttctaataaacacacaaacgaacatagtaaccgtttcattctatcaaatgaatatatggtccttatcttagagctgtttttttcagaaaaattatgtaggcatggcatgtttctatatatctatatgagaacatttcgattatggttgatttgctagaaaattccaacttcaaccgaaggcacaccaccattggtagcctgaagcatgagtgaaagattcattagtttttttttattttttcgagaaaacaattttatttatttcatccgtcctaaaatactgctataagtgaacaaacacttattcagatttattagcaacatatattcatgcattataacagatcgaacatacaattgagacgagtaagaaagggctaggaaggtaattgaggataaagtaccgtatcatacggaggttgtgtacatgatttgagaaggagcggacaaatagactgcacgagcggtgggagaaggagatgaacggaggatgactcaactttaatactttctccgtttcatattataaaattttctagcattacccatatttatatggatgttatgtctagattcattaacaatggtcaattgtagaaaatttttataatatgaaacagatggagtggtaatatagagataacataaatgatggtatattttggaacagagaggaaaattcaccaaatccaatgaccagaagccacattcagttcaaaattagcagtatactaggatgtgtttagtttgtgtgccaatttttttaaggatacagacacatatttgaagtattaaacgtagactaataacaaaacaaattacagattccgcctgtaaactgcgagacaaatttattaagcctaattaatccgttattagcaaatatttactgtagcatcccattgtcaaatcatggtgtaattaggctcaaaagattcgtctcgcgatttacatacaaactgtgcaattgttttttttcatcatatttaatcctctatatatgtgtctaaatatttgatgtgatgaaaaagttaaaaaaaatttaaaaaattttgaatctaaacacggcctggattgaaaactcaaagatagcatgaactcctcaagattagctcacactgatgacacgactcaactgaagaatccgccttgtaccaataacaagtccaggttcagagaaccgcccccttccgcgaaagcagcagctgttacaaaacccacacacctccgcgcagcgcagccttccacacacgcgcactcgattccccactcctctcgcgggtcgcggccacttcgccgccggcgctcgcatcggtcaactcgacgccacggccacacacgcaccggccatggccgcggcggcggagcagcagcagcagcagcagcagcagggcttccgcccgctcgacgaggcgttcctggtggcctacatcaaggtcacgcccggcctcgtcgcgcgccttgggggcagcctcgacgccctcaccatcaaggaggtcggcgacggcaacctcaacttcgtctacatcgtcctctccgacgccggctccgtcgtcatcaagcatgtccctatct

SEQ ID NO: 30563 - DNA, 17551 bp, Oryza sativa
  unsure (1)..(17551): unsure at all n locations
aagggcctcatcgctggcgtcgagtacccgctgctcgccgagcacatggcggattacatggccaagacgctcttcttcacctcccttctctacaactccaccactgatcacaagaaaggaggttggttgatttattatacaggtttggtttgcctgtgaaaagggagaaaaatgagaaccaaattgatagaatgttgtgttctgtgactatgaaaagggagaaaaatgataaccaaattgatggaatgtttgtgttctgtgaactgcagttgctcagtactgcgataatgtggagatgtgtaggctcacagagcaagtcgtgttctcagacccatacatgctcgccaaatacaatcgttgcacatcacccttcctagataatgatgctgcagcggttcgagaggatgctgagcttaaattggagattgctgaattgaaatcaatgtaactatctttccagattaaaccagcgcttttcttttcttttcatattggagatgatggacatgatttgcatatgcaggtttattgagagagcacaggctcttcttcatggagatctccacactggttccatcatggtgacaccagattctactcaagtgattgatccagaatttgctttctatggcccaatgggttacgacattggggccttcctggggaacttgattttggcatatttttcacaagatggacacgctgatcaagcaaatgatcgtaaggtatgtatggatttattggctaataatagtaaatgaaagtgtgtacttttacctggtccacaaatgtcctcttttttttttatgtgacaaaaagatagtttttctttttgggtggttaagttgttttgcgtttgctaagataatggcaaccacatgtcttcctgtgtacttgtatcctatagaataattagcaattgatattgttgagatatgccgtatgtaacagagggaggagggtgctcggcagacaataagttgaataacttgccttactcatcacttgaatgtccctgagtaatgggaactgcagaaatgacaagttatatggcaaagtgcaatggcagcatctagattttagaaggtattttcatgatgtatcacggggcataaaataagttatatgactgtacatatttttcaggcttacaagaaatggatcttgaagacaattgaagattcatggaatttgttccacaagaagtttgtcgaattatggaataaacacaaagatgggaatggggaagcatacctgccccctatatacaacagctcagagcttttgcgccttgcacagaagaagtacatgacaagcctatttcatgacagtcttggatttggttcagcaaaaatgatcaggtaaataaatgttgaatagtataggaagaggagattactgcgaatattggacacattctattgagccttaggagcccgcatatataggaaataaatagggtagagataaggaagtattatatttaacatggtattagagcctcaggggccagtatatagatacatgagataaggaaggattacagatatggaaaaaatccacataaatcaatcatatcctaatatgactctaactaccatatactctaatattaaacagtacaattatatagtctatactactaagttaatttgttgaatcttatttacgtctagactatgaagatatactagacctgccctttttaactgtaaggaactcaaaggcacgctaatttaggccaaaagtagaggtttccgatgtcaattttgatgcagcacttctttttcataaatgtatgtcagtatgtggtgtcctaaaaaagatgttccagaagaccacctttgacaagcataaagtatgactgaaaaccgtcataaatggttgaattgaggcaattcaggatattatgttgtgagaagctaagtgtaaagaacttaaaatcacatttaaacaccattttcaaattttttatctgtattccgatgccttgtgcatgatcctcaagcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgcatgcttcccgaactactaaacgatgtgtttttttgcaaaaaatttctatatgaaagttgctttaaataatcatattaatccatttttgaagtttaaaataattaatactcaattaatcatgtgttaatggctcacctcgttttacgtatctcttcaatcccctccttctcaaacacacccttagacctgattacttacagcttgtacaagttatggttggaggttcagtaatttcagctgtaccttttcactcttcttttccatcttaacataaaccaggcaggaccgcaggagttgttttgttggcacaatttgcgagttggatggggaagcttgatatatgaaattgtacaggccatcaaagtcaagccgctctcatgtctcatcatcagtcaacagccacgggaagtcagaaaccgatggaagaatggatgtcaactcatcagccacaataatcgaccgatcgcctcgcgctcttctcctcctccggaatctcggatggtcggatggagcccgcgacgagccgggcgccgcgcagccgcttcgtggtgtggctgcacggcctcggcgacaccggccgcgccaacgagttcctcgccgacagcttccccaccacggccgccttcgccgacgcccgctgggccttccccaccgcgcccaccgctccggtcacttgcaaccgtacgtgaatcgcaacccctccaccaatcaattggtcctcttgattcattggcgattctacgttcgattattcgattctaactaataaacatattaataagtatattagttaataattagataattatatatatcggatcttggtaatttttgttatgtgttcgtcgctggactgatgcactctctccatctccgtttcttctcaggcggcatgctcatgccctcgtggttcgacatccacgacgcgcccatcacttccgttagatatctctgccacaacgaaaattcccctgtttatgccatgcttgcagaagccagaaaaggaacaattgtgatgttcacttgagtctggatgtgtgcaggtatctgtaagggacgaggaggatgtactgagagctgtccaaagcgtgcacgcgatgatcgacagagagatcgcagccgggacgaatccacaagacgtattcgtttttggacttagccaaggaggtagaactaacattgtcatacgacgattaatatatgttcatctgaagaaagtttgataactaaacatctgcacattttaggtgcattgggcatagcaagcgtgctgcttcacccgaaaacattaggcggatgtgcggtcttcagtggcttccttcccttcaattcctcttttgctgtcagagttactgcacaagcaaagaaggtaatggtaggatcacatcgttgctcatattgcttaataagccaaaatgacttattaaagaataaaaaactaatttatagataaagcttatatatgtatgtgtttcttagcggtttaaaagctaatgctgaaaaaaaaactacgttaaaaaataattttaaaataaagttcaaaaatttaaatttggctttaattttgatttattagggcaaccaataatgctcgtagtattttaacggaaaagaagagctagagctaatgaccagctcatgcatgactgcaatggtaaataatcatgctacagctacaatgtggcttgcagacacccgttttgtggatccatgggcaagcaggctctctaatcccaatcaaggaaggcagagatggaattaaatttctgcgaggacttggcatgagttgcgagttcaaggtaatcatacacatttgcaactgttcgttatgtgctccgctactagtagcttgctgatttaacatttcagaattcgatataaacgtttctctcacttgttgccgtgtatgtgcgtaggtatacgacaggcttgggcattctttggaatactacgaattggattactgtcagcggtgggttgagaaaattttgcacaggagtggaagagaaggcctgatccgtagagtctcaaggaacatcttcttgtgcagtaacctcttcaacagttcctaagaagagaaaccacaagacacaagtacatcaaagtactgaagtacgaattgcagcttcaaaacacaactcaaggcctcgagcaacccgtttgtttctacggctccgtttgtttagacttataagcgtcgaaaaatctaaacctaaacaaataagtttcttcgtttgacttttctaaagctataagacactcttacaccgttaagttaaaaactaggttaaaagaagtttttttagggcatgtgtgatttataagctagtgaatttaaatttaaatttagaactttaaatttactggcttataaattatataaagaaaaaaaaactaacttaaaaacctaagcttacaaaaaagtcctaaatgtattctttctcaggagatgggtacacgtgcgttgtttgatcacactattttccttctaataaaacttctatacgagactttcagttcaaatcatgtggaatttttaactgtagctttaaaacttccaatttaaaatctaaaaactttcacactattactacctacgtttcaaaatgtagtaggatgagacccatttagaaatacgaatctggatatgagactgccatattttgggacggagggagtaatactttcggtctaggacatcccgcttgcgtgcaaaaggggcccaggcccaaaactggtgaattcgtagaaggcccgcacgagcggacgaagcgctaggcctaggcctgggcggacggcgacaggcggggacggggccacccacgccgcgcgctctctcgtcgcatcggcagcagcgcagctcgcctaggacggaggcgacagttcggacgctacacggcacgggcacggcaggatgaggatggaggcggacggcgcaaagcgcacgcccaaggtgtgatccgacctgaccggcctccgtttcgcgtctccgttgcccacgaggcgattccccccgcggcctagctccttcgctgccccgatcgatcgctgacgctgaaccccgccggccgcatgggcatggcggcggcgggcgggtacgggcgcgtgctgtggctgcacggctccggccagacgggcgaggagagccgcgcccaggtcgccccatacttcgccgcgccggagctcgcctccgtccgcttctccttccccaccgcgcccacctcctccatcccttgctacggtacccaaaaccaaacttttatatatacacaaaatctgttccaaatccaaggcgcataaaaaatttcagagagaaacaggaacatatctgaatgtctgtttccaccattgctgtaggtggcgaggtgatcacggcttggttcgccatcccggaagttcctattactgctgtaattcgtactcctaactattaaaattccaaaatgctgttcaacttcattcaaaaagaaaatacttgtgcttggtgaatactgacttctcttgctagcatggcatcgtttattggttcaaaagtaacaacattcttttgtccttcttagagaactgccagagatgaaaaggaagtgctcaaagctgtggagcgtgtgcacgaaatgttagacggagaagtagctgctgggacgagtccttcaaatatattcgtttgtgggttaagccaaggaggtagtaatctgcatgcttctggtaatggcattagttaggactcacaagactatgattttaattgccttttcacaggtgctctagccatagcaagtgttctactctacccaatgactttaggtggctgtgttgtgttcagtggatcacttcctctaagcaaaacatttgctgagagtataccatctgaagctagaaaggtaacagagctgcagatatatttgcaacgagcatttggtgatcacatcctcctgcaaatgggttgatttgtttgtcttcatactgaatcttcaaaatttgcagacaccagttttgtggtttcatggcatggctgacggggtggtactgtttgaagctgggcatgctgggtgtgcatttttacaagaaattggcatgcactgcgaattcaaggtggtaatgaagcatatttgacaaaataacagtttttctgaagaatctgtctgtttgctgactacaatgttctgtttttctttcactaataaaaatgaccaggcttatcctgcacttgggcatacattggtggatgaagagctccagtattttcgacaatggatcaaggatcgtttatctcaaggaactggagttccagtgccatccttatctgacaagatggatctccagtagctgcttgtttttttagaaccaaagggcaggaatcctaggccccaatttttatagctccttcttgttcttgatgtggatattctagtccaatttatggctaccattcattgttggtacattggtgctacatttgatgtactgcgaaatgcctttttatgttgtggaattatgatctgataaaggtttatgatccttgcaatttctgccattccatcttagaatttgcattgcgattcattcgatccttcaatcaacacatacaatttggcaaaacttacaaaatcaaacccccaaaaacagttcaaacctttttaatcccaccaattgcagtttggtcaactaccataccggctcatagcctgtcgcaccgaccaagctgagtgacgcgtcacggcccagttgacttcggcccatgacccaatgagtagccgcctccgctttctcttgtccctctccgccgccatctgcgtatactgcctcctctgcgtcgtcctccagcgtcaagcgcctgccttctgtctcgccagccgccttgtacccgcgcccatggctgctgtggcggcccgcaaccggagcttcgtgctgtgcctgcacggactcggcgactccggcccggccaacgagcccatccgcaacttcttctccgcgccggagttccgcctcaccaagtgggcgttcccctccgccccgaactcccccgtctcctgcaaccgtacgcctcgttgcccccccgcgccatctcgtcttctctgcttcggatttgctcctgattcagtaacgagattttcttcctccttgcagatggcgctgtgatgccttcatggttcgacatccacgagctacccatgagctctgtgagttcactgattccacttatctaagctgataatttactgtaccagtaggtattgatcttgttcaaatcttcaacgagtagggttctccacaagatgacagtggggttcttaaggctgttgaaaatgtgcacgccatgattgataaggaggtagctgatggcatccctccagagaacatatttgtttgtggattcagtcaaggaggtaggactagtgctttgcattgtaagtttctgaagtggtaagaaattttgtactgtgaactaagtattggagtgcatgttcgttggcaggtgctctcacattagcaagtgttttgctttatcccaagactctaggtggtggcgcagtgttcagtgggtggctgccttttggttcgtcagttactgagaggatttcacctgaagcaaggaaggtatgcaatcaatcgctttattcatcaagtttagtttaatgaagtttcataaggtgcaagcgagcagtttagttcaatcgcttctggaatatatgcctgcattgatatgatcataaattcatacccaggatttgtctctgaattaaatatatctcataaacacaagttgggttgcagattcatttggaaaaatccatgtgctgtctatcgcagcagttactgatcaacactgttcagttgtcattgagcaaacttaagaaatatggatgtactaaacggtagcaattctgtcaaactggttgaatgtaaagatctgacttacctgaatgatatcaaatgaatgtaaagatctactgtggcccaaacttgcatatcaattgtatgtcagttgggtgtcagtataatcaaattcactagaaataagagcttaccttcaccttagtgcttcggtggtagggtaggatgaaatgaaccaacgctggatctttttttttttaatgttcacccggggggggggggattttccccacctaaattttcatttagatggacaaagtgggaggtaaagggtgataaaaaggatccagcattacatcagggagagagcagaagaaaaccagtgtttccactgtgtcgctacagggtgttctctatagttcattatttccgccctcaaagttgcatcctctacgcatcagcgtagaagttgttgaattgacggcgcttcccctcggaagaccacatcgtgacgatggttccaaaggcgccagaagcaaagcaggttgaaggctcgatactcgacgaccagaatgatcgccggaggttgtagctgccccataagtagggcggaggtgactgagggttgaatcctgattgcagaccagaatgccgctgcaaatttagtagtgtttattccattgtaattgaacttccataaatgtgtgaatgataactttgactttcataaatgttaggtcaacccttctctgtatggatagaaatttgatgtgaaattaactatttatatgtatgatttattaagcttagattctttttttgggtctgttttcaacttttcagactccaattctgtggtcacatggaatagctgacaatgtagtattgtttgaagctggtcaagctggtccaccttttttgcaaaatgctggtttcagttgtgaatttaaggtaattatgtatcttctttttttcttgcacataagaggacctttgatttacaagctggttctaattgtatcaagttatcatctgtgtttgtttaatcaggcatatccaggtcttggtcactcgatttccaaggaagagctatattctcttgagtcttggatcaagaatcatctaaaggcctctcaggagaaggaaaattaacattgctttggcctgccgtcactctgtggtacataaaatttggtgagaatatgttgacctttacggacactcatttggaagtttttatttgggattgatcaatgtgtcaacagatatttgactcgtaacggccatagccgcacatgtacaatcgctggagtttgtatgttcctggcatgaccaactgcaccttagaatttactatatagtgacaaagtattgaataaataccccgtgttccagttaactgtccaagtgtccaacattccggtcccttttgcttttcctatagttcaattctaaactctcaaattgaatacgttgccacactttgtgagacagaacatcccttttgccttccctatttagttcaattctaaactctcaaattgaatgcattgccacactttgtgagacaggacataggctgtgggtgtctttagttcatgctaaaattggaagtttggttgaaattggaacgatgtgacggaaaagttggaaatttgtgtgtgtgggaaagttttgatgtgatggaaaagttggaagtttgaagaaaaattttagaactaaactcggcctgtgtttagtaccacgccaaaattgaaagtttgaagaaattagaacgatgtgacggaaaagttaaaagttgaagaaaaaagttggaatctaaacagggccaaatgcaaggaaaaaagatatgcactactgtcctttgactttgagtggaagagactcataggctggcggtggatgcataggaggatgactacaggactgttgtttggttggcaagcaagcatttggtctgtcatgtgttatgttcctcaacgatgtcaatttcaaagttttaatgcacaaattcaaacttaagtgactgaactgtcgtgttcctttcggaggttttaaacttgtcatcacttttaaaccccaatgtcaagttgatcgtttccgtgtgcagaccactgaccatttcagcgatgtgtgatcgcgagacacttgactttgctgctgctgccaatgattttgtgaagagtggtgaacgaatagtgcctttttcgaactttagctttcaaaacagaggatgttatacgtacatgaaaattcgtagtctactccgcttgacctatttggcctgatcgtagatgtctacttaaagaatttcggaataacttaagtcattaccgtttggaataaaatgtatttcgggcccccagtttgtttggaataaaatgcaattctgcccaagttgcattagaaatacgtatacacaacttgcaaaattaacatgtagtacatataaatactagaataattcaagttttactgcaagagacccgataaattgagctaagcacacttcgggccttatcttttcgcttatgcctatacttatcagctaaattttaaattttcaactttaaacttaaagttgattttgagatttttttcatcgatgtttatttttcagcctttacttttagatcactaaaagcatgtatataaaaaaaattttcacaaattactttttatttgtaaatatgtcgtttgtcttattccgcgaataaacgaaacgatgggtgttcgtctctagatcaatccttccttccagaacagcatgtatcaaatgtctctcgagatccaagctgacgcccaattaggccaaccgttccaccagctaacgatatttttgtacccccaacctattgcgatttagggaagaaaatcttaaacgagaagaagcatcggaggacgagaacggcaacggcagcacggggaacaggcgacggggaggacgctatatgttgcagtagaaaaacgcgaccaccacgacggcgacgcgttctcccaaccggtcagcaagcctcccctttcgacaataccaacgcgtacaaaagcccaagtcgccattcccgctccttgtgctcaccgccaccatctcacctcgcctccccaccgctcccctttgtctcatcttcaccgcctctactttactctacaaactgtatgatactccataattttggagtatgtatgtagtgctagtcaggtacagccaagaacgcatcctcgtcgtcgagaccaccttcgtatcctaggcaaaaatgcttcctgctgcaatccaacaagacgaacatttttggaggtttagatgtactttagtcttctttgtttaaaacataagattaaataaaccatccccgcaaaaaaaagattaaataaaccacatgaatagaaaaaaaaacatgaaatgttgatagaaaaattacggagtactgtaaaacatgattgtttagttagatagcaagaaaaagatatgaattggctgagagagataaactcaacttttcagaaagttttaagctctcgttaacttttcttcgaaatttgtatagcattgtccatttcataaaatttttttaaggaaaataagaattcaatcttttatttcaaatatctttgtaggatttttttagaactaaaatcctctaaaatttttgtgtttttcatacaaccagggttttaaattttgaaatcagcatttctgccgcagctgagcaatagaaccgaaatttcagaaaaaaaatcgtacgaaattttttgaattttgacggattttgtataaatctgaataaaatttgatcaaattcaccaaaaaattacaaaaaaccgaaattttcgggcgagatgttagcatttcggtgggggcgaaatttccgaaatttcaaacactgcatacaactcacggggcctaatttgagaagattttcgtaagaaattcataggaaacagtgcgtttgaaaatgatggacgcatatgctgctgactgcaattcagggctccggcgccgctgaccattggcctctccacggagcgcactgtccctgtcgctggcgactgtgctgaacgagagtgagagcgaccgatcaanatttaacccgagtttggcccacacacacttgcagtgcagacgtactcccccaaaattgaatgacatttaggacgggagaattcaattcaagctactccaaaattgaatgagctatgataaccatcctccaaaatcgaaatcgaatttgagatcaaatctcgcaggagcaaatggagcccaataatggaggaggtatactgatgcctccgtcatacaagggtcccctgcctctgcatccgcactgcggcgtcgtcatggctctcgttttctttttgcctttgcatcttcgcagagcagcgcccgcctgccaaactgccgatcgaaaacatcagtagtagccatcaaatgcagcatttcttcttgtacgtctcgtttctttttccaaccggcctctgcctctgcctctccgtgctgcagcttgttgatctctctacagagagaggtgcagtgcagagcccataaattgtcagcaacctgcttcctgtccttcatctcgtactgtagtactacgataacagtgacagtcaggctgtgtttattcagcgcaaagtttggattttagttaaaattagagatgattgtgactgaaaaattatgtgtgtatgacaggttgatgtgatagaaaaggactgaagtttggatccaaactttggatctaaacacgggctccctttgcatttggtactcagcttgtgcttaatagtagcacatcaatgtgtcactgatgagatggaggaagaactaaagaagtcgtaaaatctcagcagtggtggcaaggagtattaaagttcaataaagctttgcactgattgtactaaaggaaatactaacaaattttgtggagtacacgtccttgggtgaaaactatagctcgttcacggctaactttcgttttgcaatttgcacattgcaagtagcactaatttctattcacattcttttcaagagtaccagtgcagtgcaagaggaaagctctaatgcttctttttcgagccgtccaacagggtagctgaaaagaaaaagggtacaaatgtactaaaattcaaaaaggagaagtaaaaaatttaacatgaaaaaacatgcctttttttggctggaaaaaaacccaggtggtgtttgggaaggagggactaacaccactgcagtacttgattacttatccatgaaggagtctgaaccaaatttgatgttcctttaccacatttacaattgtgacaacaacattgccttctttcaaaaagatgctgaagacatgttggtcaaatttgctgttcttttaccacattcaagattgtgatcaagccttgcttcaaaaagatggtgaaaacatgttgcttagcagatactattacactgcctgtggaactgttagaattgactacatcaaggatgctgctgtgattccattattcagggagatgaaccccaactagtgcatggaacacgcttaacgatcatggaaaaaacaattggctttgcacatatgcttttccttaatagaggaggaatgtacaaccaggcaagcataacttgatactgcctccatttgcagatatcccataaaagaggatttcttgcccactcaagctttacaaaagtttaattaactaaaaacattcctctccattgcagtaggaatcactcaacagttccatccatacacatgatgcagccatcagaaccagatgctatgctagtaccatgaagtcaatgcaaaaacagctactcctaaattacaaggagaagaaatggaaatgatattgttctcttgcaaaagaagttcattgttgaaccaaaggagcaaaaatatggtacagtgaggttgattgaagggaagaactgtaatttggattggattacactacaccatcttgattttccctccaaacctcagtgctcatcagagtgcaagaaatcaaaagaaagaacagcaaaaggagcatagagctgaggtgctcttgatcaaaacaactactgatactgaccttgacctgaccttcttggtcgtcttcttccttctcctaatctacaagaacatggggagcagcagctgcaggaggaggaggagctcagttccaagctccccacaccttctccccgatgaagcgcaccagcctccccaccgtgctcttctcggcgttgctgctgctgctgctgctgcaatcgccctcgctcaacgtcgtctcgtcgtccgcatcgccgtccatgctgtcgccctcttcctcctcctcctcgtcgtcgccatcgccctcgtagtcgccgtcctcctcgccatcgaagccacaggcgtggtggtggtgttccacgctggcatccgcctccttggtggcacttgcatcctcctcgcagtcgccgcctccgcgtttgccgccgcggcggcggcggggagggcggcgcggcgggccagctccgccgccgccgctgcctcctccacggcgtcgatgatgcggtggatgacgtggcggttgggggacgcgtcccaacgcgcccagaagctcttgtagcagccgaagcacccgcaccccatctccggcgggtgagccccgcggcggcggcggcgtcccccggccgccccacctccagacagcaggtaggcgagcacctcctgctcctccgccgtgagcgccgacgccagggccagcacagcggccggcagcacaaccgctgccgccgcagcagcatccgcctgcgcctgctgcgccggcgccgggtgcaccctccgtcccttcccctggtacaacttcttcatcctcctcacccccaactactactactcactcgcacttacttcagccggagttcgccgggttaggtgcccaccaactgctcgaccaaaagccaacctcggggacgggttggtgcgggtaggtggcgggctcccgtcggctacgacgttgctgttcgcagccgctgctggatggcgcccgcgcagctcgtcctcctctctccttcgttctccgcagcagcagcagcgagagggaggagcgcgtcgtgtggtgtttggtttggtgggtgcgaactctttagccgaggagacgggggaatctgacgggtggtgtacgggaatctcttgcagtcgtgcacttgctctctcctccctccggtccaatcgggggttgggtgcggtgcgaccgcgcgtgtgtggcgccgtatcggtcgcgacggcgaacgcgagtccatgctacgacctacgaccacgtaaacggtcctcctcacggctcttctcggtcttccccgagcaaccgtgtcgcatcgcaacacgcccgtacattacatatgcgactcgtgctgctgtaccccacacacacctggtctcatgggccgagcacattgcaaattctgatctcgcaagcccaagcccagtttaacgctgttccaaactttccaatcggcttcactttgcacattcctgtcacactgccttcttcagagatcactgcagaagactgaagaaaatcgccaacaaaaagccatatatcgcgccttcgtggagcacaaaagagatggattgacgattcacggatcacattctttttttgtgaacaagaaagatccatgcttgtattgtggtcgaacacgccttctctgactgctgctgcttgctcattcattcgtaggggttcctgaagctcttgaggagatcggggatgtcgtaggcgagcatgtcgtcgacgccctgcaccagcttgggcttcagcctctcgaacttgtcgaagttgtaggcgctcagtgtctccctgtactcatccacgctggggaagtcgccggccggcaagtgcagctccttctgaaccttggcgaactgctcgtcgagggtgtcgagcagccgctgctgcgccttggccttgcccatcagcgccggcatctccttcttcaggtggctgattatgtgagcatggaccttggctgacctcgaacgcttcacgaattcgttgatctgaaaacaccaaacagtttttcagtgacagaatgaatggttagcatgagtgagcatatatatgtaatcttgcaagaaaaggtgtttctgatgatgatgatgatgagcttctcactcgacggtcacaggctttctttggaatgtcattcaggtcggagagcaggtcttcttgttctttctcaaacagttctttacccagtggcccagctactgtctccctaatgggcttgtcgttaaatgaactgtcacatgttaatttggaattgtcagtggtaaggttgtgtgatctttgcaaaaccatcagattgatcgatgcattaccatatgtnnnnnnnnnnnnnnnnnnnnnnnnnnnnnnnnnnnnnnnnnnnnnntttctgatctcatgtagagtcgcgccgcgccctgcggccctgattcgctgtagttgtaactgcggtgttcactgtaatgtgtatgaggttttgctgaataatgtggactttcttttccccaaccgtttggttgttgcatctttttggcttcaagaagctcactgccaaactgtttcatacactaacttgcttagcatttttgaattacgggttgcagtaagaaactaaacttcaggccagagcagtttgtaattggaagtgatccgatgatctcctaagattagagattgttcaaaggtttgaactctgcatatgtcggggtttcctaattatcccttttcctgaaacctgcatatttcgtttttattacattaccaataatgcatctatccgatcccttatctacaaagtaaagaggctgctttactttaaagctaagccgcgatagcagttcgataagttaattctgctagcatgtgtcattttctctagagcttgtaactgtgctatatggtctcttctgcaagcaatccacaaggtttttttcctagatttacattacatggtcaatcaccgcgcttgccattccttatcggctcatttatgagtttgtgttccccatctgacttgattgttgcctagaattgatatgcatttatgcagtgtctctgcgattgtatcg

SEQ ID NO: 30564 - DNA, 695 bp, Oryza sativa
cattcggtagacggactgcagtgaagcgaaatcgctggtaggccaccgcgaatttttgtcggggcgcgcgcgggtttctcgttgagacggggcacttttgtagttttgtgaaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgtgtgtttatatatat

SEQ ID NO: 30565 - DNA, 618 bp, Oryza sativa
ctggttaccaacagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcagatctagcggaaacttttgagagtctccgctccgcccgcataaaactgaaccccgataagtgcgtgttcggtgtacctgcgggcaagcttctcgggtttttagtctctgcccgaggcatcgaggccaatcccgagaagatacgagctatagagcgcatgcgccccccagcaagcttagggatgtgcaatgcgtcaccggttgcatggccgccctaagtcggtttatatcaaggctgggagagaaagcgctacccttatttaagcttcttaaacgctccggacccgtttacctggacggaggaagctgaacatgccctcgcccagttgaaggcgtatctcagctctcccccggttctggtcgccccggagccagatgaacccttgctacttt

SEQ ID NO: 30566 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnncataggctggcggtggatgcataggaggatgactactggactgttgtttggttggcaagcaagcatttggtctgtcatgtgttatgttcctcaacgatgtcaatttcaaagttttaatgcacaaattcaaacttaagtgactgaactgtcgtgttcctttcggaggttttaaacttgtcatcacttttaaaccccaatgtcaagttgatcgtttccgtgtgcagaccactgaccatttcagcgatgtgtgatcgcgagacacttgactttgctgctgctgccaatgattttgtgaagagtggtgaacgaatagtgcctttttcgaactttagctttcaaaacagaggatgttatacgtacatgaaaattcgtagtctactccgcttgacctatttggcctgatcgtagatgtctacttaaagaatttcggaataacttaagtcattaccgtttggaataaaatgtatttcgggcccccaatttgtttggaataaaatgcaattcttgccaagttgcattaaaaatacgtatacacaacttgcaaaatttacatgtagtacatattaatactagaataatttaaggtttacttgcagagacccgttaattgagcttagcacacttcgggccttattttttcgcttattgc

SEQ ID NO: 30567 - DNA, 663 bp, Oryza sativa
  unsure (1)..(663): unsure at all n locations
atggcggcgccgttgaatcgatcttggtgcaggcctttcatggcttcgggttcgaccgtcgaggtcctccagctcctccattgcttgtctgttgcctctaaaaagctcaccaacggctaccacggggcctgtttccacctctgtgcccatcactgcggggcccgcctgcgcccaacccgtcgccggccgccctttcctgcctcgcccctccagctgacccacacgaggggtgcggggaggccggcgagctcgtgccgctctgagcccgtgtgtcgccacctggggaagctaagatccccgggagccaccgtcgccagccgcaccaccctttagccgcgcgcgccaccgtgggcgccaaccctagtgccatgcctgtgtgaaagcagagagcgagagggaggaaggaaggagaaacatagaaagtgaagaggggaaagagagtaggtgctgacatggacacaccgacatgtggggtccacgtgggttccatgctggctcagctaccatatcggataaaaccgggatcaaacccatagaaggatctaaagttgacggttttgtaagttaagggatgtcgtatatctagttttgtggttaggacacaattnnnnnnnnnnnnnnnnnnnnnnnnnnnnnnnnnnnnnnnnnnnnnnnnnnnnnnnn

SEQ ID NO: 30568 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnnnnnnncacgaaagacatatacccataggccatagacatcactatacatacacaaatcaataaatatactccctaatacatactcaaagacagaaaccaatgagaattcctatactaaaatcccattaaaaacatagctgtgagtatataatattcgtggcaaccagagaccaagacttaaatagtgggtggtagtcatgcaccctccaccacgaacatcaccgatacttcctctccatgtataattgtctaaacttgttttaccagtgttatgccttgtatattagagtgggtaacttcgcggatcagaggtctgaggattcccgtataatttagggtgcaagcaagcaagcagtagctggactatttatcatgggtccccactccaactcctcggcggattcatcacgcaagatgcatgtggtcaaagctttacttacatatagttgcagcgattggctaagggatgcaaagttgcaaacatgtgggttccttccgttcacctgattaaagaggaattaatagcaacacaagttagcaactcgagtaagcgggccagaaagcaggctggagcggtgatttcaggcagcccacccaacgttccaaccaaacctaccgttcgtgtgggccactttttccggccgcgcagaggacgatcccaccggcaatgctggattggcccgtc

SEQ ID NO: 30569 - DNA, 774 bp, Oryza sativa
  unsure (1)..(774): unsure at all n locations
nnnnnnnnnnnnnnnnnnnnnnnnnnnnnnnnnnnnnnnnnnnnnnnnnnnnnnnnnnnnnnnnnnntctccttttgtattgttgtatatgaacagcataggttctaaaggatattctgtcgtctcattttctgttctgcagagctacctttatatctcatcttaggaatgctttgtggagcggtcagtgtggtatttggccggttggttgtatggttttcgaatttttttggatacttaaaagaaagatacgattttcctattgtagtataccctgctttgggtggactgggagctggcctcatagctctcaaatatcctggcattctatactggggtttcacaaatgttgaagaaatactacatactgggaaaagtgcttctgctcctggtatatggttgttaactcagcttgcagctgcaaaggtagttgcaactgccctttgcaagggatctggccttgtgggtgggctatatgcaccaagcctaatgattggggctgctgttggagctgtttttggagggtcagctggatatttgataaattctgctgtacctggtaatgctgctgttgcacagccacaagcttatgctctagtaagttgctctgttttcctttttttttttcatattgcttgaagcaatactgttatttctacatccttgtatatacaaaaactaattgtcagaactccaggttggaatggctgctacactctgatgaatcccctaatgattttggtaaaaatcattaagttaaggtggatacacatc

SEQ ID NO: 30570 - DNA, 582 bp, Oryza sativa
attttcaagcaaaaacatatttcaaagggaaaaattggaagtaacatcctaacctcctttacttccccatatgttccaaaaatctggcgaacttcttcattggaaactgagggatccaagttaaaaataaccagagttccctggtttaaatctttatctgatggattctcctacaaaatcaacatggcaaactgctaagtactttatggtaaagggactaagcatttgaaagtgaaccataacataataaaccttcgggatggagaaatgaatgtccaactttctcctcctcagaggcttgttctgcaatccacgcatcgcaccacgtgcagctcggatatcaaaataagatatcatcacaaaacctctatgtttcgttgcagtataaagtgttcggatatccccatattgctgaaatacaataatggatattgtaaagatcaactgagatacattataagagaagtgcagacataacactgactatgagttgattagacagcacataaagttgttcagttgcaaggtatacctactgataagtaacactaacaaatcaatctcagatggcaataattatat

SEQ ID NO: 30571 - DNA, 686 bp, Oryza sativa
gtgggagacgggaccccccccccccccccaacccaacacgaacgaagaattccaatcgcacagcgcaaccgcatcatatggtcatcgtcatgggttgggctcgcaccgcaccgccgccgccgccgccgacgcgccaactggtggtgctaccacgccttatttagccacaccgtccccttcccgctcggtgccaacgcgcgcgcgcgcggcgaagcgaagcgaagcatatggctctcctcttgacgctgatcctcctctccggcctcggattcttgccccgccatgccgacgccgcgaggggctacgtcaccgtctccacatccagcttcgcggtgagctccacctgcgccgacgaactccctggacgaggtacgtagttagtagtagtagacagcgagcgagcggggagatcgaactgttgcttctggtttttggggccggattgtgatgaaagattgggattcgttgcgagtttcagctgcctcgccgcggaacggcacgtcggcggtgctgcggctgacgcaccggcacgggccgtgcgccccggcggggaaggcgtcggcgctgggatcgccgccgtcgttcctcgacacgctgcgcgcggaccagcggcgggcggagtacatacagaggagggtgtcgggggccgccgccgccgcgccggggatgcagctggcgggatccaa

SEQ ID NO: 30572 - DNA, 442 bp, Oryza sativa
ggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctccccaggtcggctagaaattggtcatgagctttctttgaacattgctctgaaagcgggaacgctttct

SEQ ID NO: 30573 - DNA, 2246 bp, Oryza sativa
  unsure (1)..(2246): unsure at all n locations
ggtggctgatcaccaacggtgcaggtcttgcctcttaccccattgataccgtccgcagaaggatgatgatgacctctggagaggctgtcaagtacaagagctccatggatgctttctcccagatcctgaagaacgagggtgccaagtcactgttcaagggtgctggtgccaacatcctacgtgccattgctggtgctggtgtgctctcaggctatgaccagctgcagatcctcttctttggaaagaagtacggctcgggcggtgcctaaactggcagaaaatgatgacgaacaagtgtttattcctggtcctgcactaacgggatctggtgaattttgcctttttaacattgaaaacaataataattcttgtaggggagaacactccccgacattcgttttttggtggaagcgtttatctccaaacattgtcataggcggaggcgttaatcgcaaacagtttaccatcatagggttgagtttgagttgagtctggccggctctgttatgtctggcgattttcctaccatacattaccctcggtgaaatatcgaaagattattgagttgctgtcttttgttggtgttactattttgcaatgcttcattatttctactgtttcatcctgttatattcctgatagcattttgcattgcgtttctctacatgcatgcaatttattgctctatgaatttcacatactatacaggagcatttcatgtttgtctctgtcatgtgaaactttttgtctgttaatgtgaagtactaagattcatttgcgtgattgaattccatcttcatgaatagattgaattacatctaggtgccagttgagctgaactgccgagaacgtatataccgatccgaacataggcaagatgcagaggacacactagctctctttccaccgctgcagcgtctaagataccctttccactgcacctcctgacgaaggctcccacgcaccgcggcgcgttcggccttgttctttttgcatctggtccatggttttttggggtgtgcacagtagaccagattcgttagggaacctccatttcattcaacaaattcctgttcttgtcttttgttctaattatgctagtaaatgttttgttatttaattaattgtgtggtagatatttttttaccttcttggcaacaactttggttccacatttgcagttgcaatagtgtaacaatgttttttttttctgaactggaatccaagatgattttgtgctgaggtgccgctcattgactatagtggttgttactaacgaagttcaatccagcacccctgaatatcaggtccatcaaactaaattaccagtcgtatttcagcaactgaatcattgaactctatttctgtccttggctgtttttgagatttcacataatatacttccatgcactaaattgctgcttgaggtcacataaaatttatgaattgcaggaacatantaattttttgttaatttcttatgtattcaaggttcaataaaaatataataagatgaattttgaaatctgtcaaacatattccaatattccattcctgcaggaacaagatgttagttatgttgatgcggactggggtcttcatagacaactctatacctcactctactttagttatcgaaggacagttcgcagtcagattcttctttcacagcagagcttatggctctcatctttggacatgttatatgcagcactttgcaacttgcaattgaacaatgccatttacttgtcagattacactactgttgtcaaggttttgcaggagaggaaggatatcatgcaagcaatcgaggacactggagcctccggccactctaccattttcagcaagttttgcagggacaggagtccaaattaggtggataccgggatcggggaacaaaatggcagacaaactggtgttgtgagctagagataggccaaccagaagttctctttcctcagattggcatgacttgtaacactatacttcttctccagctagctctcagctatctgctctttcagggagatccaccctcctaactcaggtccatatgtaacggggagattgttactccgctatgaaggaattcagtaacagaatccagctttttttctggtacgaacaaatgttcacactggagccattcagtatgcttagagcaattgagatactctggacataaacgaaactaagcacttgaggtctgcaagagccagaatgcaagtgggtacccgcgaatc

SEQ ID NO: 30574 - DNA, 270 bp, Oryza sativa
aacatcagtcaaaacaaacacaaaatcaacaaaccaacaaggaagatggcatgatggacacaccaagacaaacacaagatcaacaggaagctgacatgaaaaagaaagccgacatgatggccaagtacttaatgctagcaggaatattggctgcgagtgtggcctacctcacgggcctaaaaccacctggtggcctgtggagggatgaaggtaatgggcactctgctggcaacccggtcctctacgacatcgacaagcgtcggtacaatg

SEQ ID NO: 30575 - DNA, 367 bp, Oryza sativa
  unsure (1)..(367): unsure at all n locations
agctcggtacccaccatgcatgaataccaggaaccatttcccatcaacggcatatgtatccatatgccactggaagatggagcaattgcaacaggggatccctttggaaatgaagaggacaacaatcagaacgagaggacagcaggagaagagttatgaccattgctttggagtcgccgataaatcttaactgcctagagaagagttttccttcccaaagtgtatagaagtgagaaagattggttagctgcgaaagtttgtggtgtggcatggcgcatctactagttttttttgtggcaaacgatgtcgnnnnnnnnnnnnnnnnnnnnnnnnnnnnnnnnnnnnnnnnnnnnnnnnnnnnnnnnnn

SEQ ID NO: 30576 - DNA, 6613 bp, Oryza sativa
ccaaaatatatgtacttaagtgtcaagtgtcaaaatatgtgtggttttctgcaacttgaaccataaaacatgtagttttgtgaaatttactcttttttttattaattcctcattccatctaattctaagtaagatgcttgctttggtcttggtcttctggaatattgtttagagcttttgggtaaagcctcatatgtaaatgttctactaccattcccttcagattccagaccaagagaagtatcccttttcctggacctggagttgattattcagaagcgcagaaacaaacctgaaattcaacagtttttatgatttcaactttggacatagaaactattaagctcttctttatgtatcatttatatctttcttaaacactcttgcctagaagaatttctttcttgtgtctcaaaagtactttacatttataattctgattatgaaaaagagattcactttgattctcctagctcagaaactaattaggtgtatttccccctgcagcaacctatggcaacttgaacaaatcatttcatgatacatgtgctaggtccaatctgaacgctgtacagagttccaatccggtggcgaaaaatcaggacacaaagacagcatcaattgatgctacagcaggaaaccctcttacaggtcatcatgctacaccaagcgtggcacctgttcctccaaaacctacttttgctaaccacagtgaaatagcaaaaagtgttcaacgtgttctgcaccaaccagctaatcatcctagctggattccgccatcaactgagtacatgcgttctcgtttggactgtcaaatatgcaaagtagctatcatggatatggaaagtttgcttgtttgtgatgcttgtgagaagggagcacacttgaaatgccttcagcattatggtaataaaggtgttcctaaagctgagtggcattgtccaacatgcctgacaaagagtaagggcaagcctttgccaccaaaatatggcaaggttacaagaactgctgtcgaaccaaaggctactccaccaccagctggaacgcaggtttcttcgcaaggagcggcagaaaatattgctgtaaaggaaaatcaccaaaaagtggctgtaaatggtaatcttctgaatcaaaactccacgcaagctggcagtgttgctcagagcagtactgttttggctctaggtgttactgctgctgttgcacaatcacagccgctttctatatccagacttccagaaggaaatttaaataatgatgcagccttatctagtgaaaagacggggaatgtgggtccttgcagtagcattgcacatcgtaatgaaaagccccctgatgaactacagagcagtggactgcctgctaacagtaagactggaacccaatcagggaaatctcctaatgaagaagtgtccagtgtattagtttcaggcagtgcggattcaacaaatgataccttgcatgagcagaaatctcatgaaatttctggggaaaaatgctcagacaactcttctattgttgcttctgaagcaaatatcaagtcaaaagcagactctgagctcatttcgggcagagatgtggaaatggttgataatgatataccaccaaaggatcaaaccaacaacattgccactgaggacaaacccagtactcaagaaacctctgaagcacataaaatggaagttgtggaggtgagcgccaatactggaatacaaataagccagggtgacagtgctggcactgaagagaatctccacactgaagtaacttctgttccacacatgatcaatgatgtggcaatggctaccaatgctggaacaccaatatgtccaagcaacaacgttgccattgaagaaaagcccaagtctactgtaatttccgaggtatgtacaaccaaagatacggaaatgactactgatgccactttagatcaaaacaccaatgttgctacagaagaaattcctttgcctgaatcaatttctgcaactgaggatgctgacatgactactgatactggaataccaacaaatcaaagacaggaagtaaatggattggctgaaaatggcagaaaagaacatcccctgggagaaacagataaacacaaatctgaccatagtacgatgcctgatatgtctacagccccacagataacatcaaatggagttatgcattcaaaagatgaagctgcatgtggccatgaaggtgaaattgtggacatcagtgcagcagcaacagaggaaaacaattagattcagatatagtagattgcatccaattccatttgcaggtgtgttctaatctaaccagttatactttatggtgctagattgctagctgtattaataattctttttccagtattagtaaaggcttctttgaaacacaggattctgggatggaaggagtacttcactatgaatactcgattcctaaatagccttatattggttgttccctgtttatttgacttagggtcgatgctatctttaaagcgatactccacatttgaatgctgttttatgcgtttcaacgatgtcatccgtaacatatttactggctagtggacctgtcacctgttagcgaatattgtgctcgagaccttgagttatctaaccattatgcagtgctgctagtttttgctcaaattctaagagttaaaacctttgacaggcatatcagaaattcaacaatttgtacctgaccctatattcaattatttttacagacgcgatcgtgatgaagccacctgtagttcggttagtgcctagcgtagcttcagtgattaaccatgctgtcaacattcttttggaccagtcaccataagttcatcatgtgctgccggccatttcccatgaggtttgtgctacgcctctacatctcttaaaacctttcattcaaaattaaatgggcagctggtctcataatagaaactatgctcaccagacaaagcccacaatttaatcacttcaaccaacttatctttttttgcatttctgttgacatgtggtttcttttaactcgtgcagtgcctacttcctactggacttgctggaatcaatgtagcgcgcatgaaggatgttgttaccttaccgtagttccttcggctatcactcctagctatatttagtttctttacctgtcttgtcttcctctgcgctgatcttataaaggctgtaattacataggatttggttgagtgactcataggttctgtcgtaatgatatgattttttaccgtaaagttcatcaccatcggggccagtgcaaggtgcactggtgttctcgattgtttgatatacccgtgaatctctgagctgtcttacaaccgagtgtttcgcccagatttctcaagtattccagtttttggccggttctgaagtttacctgaaacgagcgacctgagaaggacggggacacgttcacttgggagttgtgatgtaaactggttgcgagttgcgacgcgcaacgtgccaggttagtgtcacaagatagctgcaattacacatctatcttatttgcatttctactcttccgagacttatgttgtgcaattgcaaatattatatcatcaatattacaccatatatgtcgccatatgagacatcacccataggatagccaaggtaactaacgttgttacggccggtctgactgtctcgctacgagcctaagatatcacccataggatggccaaggtaactaccgttgttacggccagcctgactgtctcgctacgagcctacgaactagtaagatcagaaagtcggtaaatttattctcgaaagtaggctaggcgaagatatacatggtagaatacaacaccacaattgacagatcagacgaaacacaccgtgctccactgctccatgttcatatggccaggaacaggaggcagcacagcataacgcacgtccgcgacgtggcgactccgcggccgccgctggacgccaacggcgcgggcgccggagcggcagctcggtcgcccttcctcgacgaccctggcggtggcgtcgtaccagccaccggagcccgcacgtcgacgcgcagcttcagcccgccgccgcacttgtccgggtcggcgctgacgaagtacctcgacccttcgccgccgaggtcgacgcggctgagcccctccgtgtacatcctgacggggctcccggcgtcgcacgactcgaactcctcctcgccgccgacctccgcgacgccgccgtcctccgccgagtacgcgaaccctgacaacaacagcaagttctctgaaactgaatactgaacagagatcgacgcatgcattcgtcatggacttacagagggtgtctccgacggtgaagagcctgtccgcggaccaggcgaggacgtcggaggccaccgcccaccccgggtcacctccgacgacgtggtgacgacgtgctccggcggccgctgctgctccagcggcgacaaccagaatgagaacgccagctgcggcggtggcagtcgtgacggagacgatggccatgtcgtcgaacgaatcgtacgcgcgcggcacgaccgagtggcgcaggagggaggagcggacgcgcggtatggtcgatggatgatgacacacggtcgtcacacgcatcgctgctttagattggatcaaatgtctcgaaccaaccagtcctctctcctctcgatcacgagaatggtaggttcaaaatccataaaaaagacggagagaatgttaggttaaaacctgctgttctgttctggtaatggccatctcctgctttctcctttctcccagtgatgcaaggcgcttgatttgctatgcagctaatgtgcagtatttgactaaccagcgaattccaatttgttcgatgctcacaacgctacatgaactagcagacaaacacctgaaaaagaacacgagtactagtactcttgagtattgaagtctcagagaggaatacaggggaaaaaatgcttgggagagatgccatgccgcgctatgttgttcaacttcaaacaagccattatagaacgaaccagaaaggtcattgggaatgcatccccgcttctggacgagtcaagtttggtcaacgtcggactgccaacaaggccatcggatgatcgcgtcgtcccatcggacggtcacgaagccgccacgtcgcgcttgtcaccacgctggccactccggactcgtggactccaccgcagcagcagcagcagcagcagcagcagcagtgaatgctactctcgctctgctactcactcctggcgccggtgacctctctgccactccaccggacggcgacggcgaggcgggtgagctctctcgccgcctccggctctcctgccaccgggcctccacattcggcgtcgcactccttcgtcttcgcgtgatccggtaagccgtcgccgctcgtggcaacggagatctggttattttggtgcttgatgtgtgtggatgagctgagagtttcgtggattagtggagtctaagagatggccttggcttgggtggtgggattggcgcgtcgcggcggcggaatgcgcttgtctgtctctcgacccctgatttggttagtctcgatggttccggtggttttgttcttaggaatttccgaagaacttcatccagttgtcgaccaatggcgttgtttgtagttctagatttggtccagttgcgtgctcggtggagatgatctcgatgcagagctatctccatatgaattatcgattttggttgcgtttcacggatggatttgtttaggtttgagataaatgttgttggcctgttgaaactcccaggtattgagctgttttgttgttgttgttgtgtgcggcagtaattaatgttttttcccttgggccatcagctgtttctgcgattggcatttaatagtatttctgtcaattggtgggggagatgtgatgctagaacgatttaaaatgctagtagttatatgtgtctcttataatcatatctgaccaattcaaatgctcagcctggcagatcgggatcgactaagcattggcctttgcaagttttgaagtgcatttcaccgttgcttttgtcttgagcaagagtttatagagccatacagctccgacaaaaggattcacctattccagaatgtctgctttgctccgtgaaacttcgtgtggatcattgctgcaaaaactgcaggtatgcgtgtgaactgctccatacttgttcatgtcataactcattagagatttttttttttgcttgtgtatttgtgttcaagtagaggttcttcttttctatttttgaattatcagtcggtatgggatgaagttggtgaaagcgaggaggaccgcgacaaggttctatttcagctggaccaggagtgtttggatgtctacaagcggaaagttgatcaggcaaccaaatcaagggatcttcttctccaggcactggattactcaaagacagagcttgctaggctcgcttctgcccttggtgaaaaatccatagatataagtgtaagtaaatatgcgcgtcttcgtccagtacgcataggctaatttcagtctgaattaatactggaaagaatgaggcaggctcgattcactaaaattttcagtattcaaatatgagttgttgaaatactgactactgatccac

SEQ ID NO: 30577 - DNA, 1584 bp, Oryza sativa
agttttgcagggacaggagtccaaattaggtggataccgtgatcggtgaacaaaatggcagacaaactggtgttgtgagctagagataggccagccagaagttctctttcctcagtttgtcatgatttgtaacactatacttcttctccagttagctctcagctatctgctctttcagggagatccacctccctaactcaggtccatatgtaacggggagattggtactcgcctatgaaggaattcagtaacagaatccagctttctttctgctacgaacaaatgttcaccactgtagccacttcagtatgcttagaacaaattgagatactctgcacataaacgaaactagcaacttgaggtcttgaagagccaagagtgcaagtgggttacccgcgaatccacttataggttaaaataaacaaatgctgtgatcacacctccattgcgacgtttcttcaagtgaccaaaagcctgacgagtagtttaagcccccgacagggccctgtttatctgggctggttagatggctgaaataccggcaaattggcaaagtttgcctggtggacggtgtgtgcaaattgcaatgactccagccatatggtactgaaaatgagttggcatcactacatcactgcgcctcgccgcattgaaatgtggaaatgaatggagttgccctgcgcgcagatctatgattgggccgtgatggacgggcccgattcaacgggacaagccgacatcacctgggacaaaaacggactggctgggcaggtacccactcagatcttcacctacccgatcagtaacacacagaaagcagaagcaggtagtaaacccagaccattctcacatccatggctcagtagatgtggatctccattttgacttcgaacgctagctgctttgccagtttgccactgaagaattgagacagacagccagacaggatagttaataccactttttaaaaaaatggattaattactggaccaaccccaatgatcatccagacatcatctgtgcaaagcatatatgcaaagaaaagaagagaaattggtggtggcatactggcatcgccttaactaacgcgctacagttgtaccactgccgctgcgcgcaggtcgtgacgctcacgtcgtcgccactagtccactccctcgcttcgcatctcgcctctggtgatgagagcggacagagccgagctgagggaattaaaacccccttatcctctctctgcccccgggctgccattgctggatccaaccatctgcccccgccacgcctcgtctcgcgctagccgtctcgcgtgcgtgcgcgcgcgtcgcgccgcgccctcgttttggagccttgcgccccgctactttccccttgtcccgaacccggaatccgcctcggcgagcgtccttgctttgcttctttggtatctgtgctcccgtttgctttgccttgccacgctccttcctcctcctcattgtctcctcccgtggttcggctcattctgttcttgggttgacgcgggctgcgtgcgtgcgtgcgtgcgtgcggaggcgatgtcgtcggcggtggatgccatctcctgttcca

SEQ ID NO: 30578 - DNA, 4401 bp, Oryza sativa
aggcccccaaggccatcgacctcggcccgcgtgtcagcatcaaggaccagctcgagaaagacaaggtaccactactcattcccgccattgctcgaattcttgcaagcacccgccattttatacaacgcatccaattcttcatgcgtttctgcgtgttcttgcttaattgcaggacgacaagagcctgagtcggtgaaaggagcagctgctcggcagcgtggatttgaactccgtaggaggtaaaaattcctcgaaccaaatccatttctactaaacgtttttagctgcgtcgtctcgtcgtcctcgcgatctcgtttaatggcgccggccggcacatgcaacagcgttgcatgtgagcctgagcaccgccttgtgcccttgtcaaagatggtcccgtgataatgcacctgtgtacctgtccgtgcttagcccccgttctatgggccacgactagattcatccatcgtctatagtattcatccatgcatgcaccgcccccgtgagctccgtgttgcattctactccgtacatttgtgatttgtacgtagaaaatacggtagaacagcaaaagaaaaagtgaaatatgttgggcttggctggacgggtccggcgttttcaatgcaccggttagatggtcctgttaataactcctgtactttgccgtgcatgttcggcttgtctgataatgaatctggtccgggctcctaattgaagcttgaactaatgctttcatctgatcatgacattgacaatgccttctgatcttaatactggggaacagtgcatttctgttgttagtttatatgctagggtgttggtgcttttaagatcaaatggattttgaatagtggcctaaaaagacacatttttgcatcgcataattctagcgaaccttggctttttgtctatgctttttagactagtgttgaataaaccatgattcatatggttgtggttgtttaaccaaataatccgaggatgatggctagctgcttcacggtcggttttaggatgatcattcattcggcatctgcttgtcttccattagaattttaaactcaaaactacggccaatcatttggcctacacgtcctggccattaggatgcaataatgtcccaaaaagaactgacccaataatgaggtctgaagtctgaacctgtcacgcttgattttatcggtgcagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaaggtatacccaaacacgaaaaacatttaattaggtctccaatagatgaacaattaattactactaaaattttataaaatccgatggatttagcgcgtttgaatttgtgcaaacgcactcatggttttggttcctcccgttggggcgtgcagttgacagccacaaggagatgctcggcacgttcagcccccagccggagccgtacacgtacgtgacgccggaggagaccacgccgtccggcatgtttgcgaggggatcctactcggccaggacgaaggtacgcatgacgcgaattttctttgtcagatatcagctgcttcaggaaacctgcaaggttcagtcgctcagcaatgtgttgttaatttattcttgcagttcctcgacgacgaccggaaatgttacctggagatcaactacaccttcgacatacgccgagagtggccggcgttgagctaatgatcagctgagccgtttttccggtggtggtcgccgagtagaagggtgaggcgccggccggccggcattcatgctgtgtgttactgtcgtcaccgttgggagcagaagtggacattttttttttcgtctcgtttgcgtcttatccactcatttttttttttggtttgattcaccctagggttcttttgtatattgttgccctgtctgtcccggttgtttgctgtgttaacgccgtgttagacgtacgctttgtcagttcaagttgatgttatgctatgtgttatgtcagtgtgcgtgtttgagcttctgtcactctgtcagggtcctgtttcgatcgaactgcctgtttgagttcagagcaacgcagctgcatttcttgtaaacactgggactgtatctgacgcttcccttacaaatttcccattctgtgtgcttctctctgcaattacacgaaagacatatacccataggccatagacatcactatacatacacaaatcaataaatatactccctaatacatactcaaagacagaaaccaatgagaattcctatactaaaatcccattaaaaacatagctgtgagtatataatattcgtggcaaccagagaccaagacttaaatagtgggtggtagtcatgcaccctccaccacgaacatcaccgatacttcctctccatgtataattgtctaaacttgttttaccagtgttatgccttgtatattagagtgggtaacttcgcggatcagaggtctgaggattcccgtataatttagggtgcaagcaagcaagcagtagctggactatttatcatgggtccccactccaactcctcggcggattcatcacgcaagatgcatgtggtcaaagctttacttacatatagttgcagcgattggctaagggatgcaaagttgcaaacatgtgggttccttccgttcacctgattaaagaggaattaatagcaacacaagttagcaactcgagtaagcgggccagaaagcaggctggagcggtgatttcaggcagcccacccaacgttccaaccaaacctaccgttcgtgtgggccacttttccggcccgcgcagaggacgatccagccggcaatgctggattggcccgtcaccttccccccttttcgcgcagcgcgcgtggcccatgttttggataggtagacttcgcggcccaagctggtgggtcaaattcagaagatatagtcggccctgctcctcggcgaccacgtccgagaggagcccgaggcaagcaaaagcaacaggatctggcggcttcacgtcatcacgtgaccagagtaaaactttcacgcttggaaagcggtgagcacgttcagaccccgtcgtctcgtcggtcgcatgtgaccggggcgagagacgagagaattcgcaagcaaaaccatcggggacgtctctctatcaacagcggtggatttcgccgttttcctgggcatgcgtgatcggtctcaactccgtgttttccttttttttttcccccgtacgccgtcacatcgccggcgatcggatccgcgccaaataacaagcaaccgatgtgcgcactggcgaaggattcgtccagctttccccccgcggcgcgctgtgtttgtcgtgctatcgctttggatgccgatggaaataacgtgcgtggaatttagccgtccttgttgagttattgtgtgttggcgcgctgcaagcctggcgatctggcgctttcggaaaacggcattaaccaggaagctggaacgacagtgcaggacagtggaggagctccggtgtcagctcggctccgtacgaactcgtcgatgcttcccagggtcttcgattcgatgcatcacgttgtcgaaccgttcggccagaaaatgccatacttcggatgtgtttagtttcaaagttttttttaaaacttctaacttttcatcacatcaaacctttcatacacacgtaactttttataacttttcagtcacatcgtctccaatttcaaccaaactctaaactttgggccaatctaaacacaacctgattaattcaatactggattactagtacttcggtttagagaatgagctcttctctgcattgaatcatcctggagacctgaatatttcgatagctttgcggataaatgcgcgctgtgtgcagtacgtgtgcccaaggtacgcgcacgcgtgtctgcgtgacgggttcacgttcggcgggagcacggattgggggggggggggggggggtatgtgttgtacaggtaagaggtgtttggtttgttctggctgtgaacagtggcacgtcggaacacgccaaagaagaggcccgtggcgacgacgctttcggcaggggataaaaaccccacgaaaaattatggcaagggcaacaagatttgtcggcatgagcagcaagatccgctcgagctccgggtaaacaggtgccggacaaattttggttttcttggttgctttttgagaacatgagcacacgaaagctggttgactcgaataagaaaattacacgagagagtttcttctcgaggaaaagt

SEQ ID NO: 30579 - DNA, 12132 bp, Oryza sativa
attcacaaaaggatctttaatttgtattcatatagctggtgctccattgctcctactttctagggagataggtgtgttcttttgagttcaatgtaatggaacatacaaacaataatttaactattattacaagattaaaaagaatggatttgaaatagcatcttataatgataactatatatgtaaaaagtttttaaaaaaatcctcctatttaggaactcgacctatgtgcatttttgttcaattttgagaaaagaaaaatacaccgataatatgtaaaacggacactcatattgttaaagtctcgcaatcgaaacctcttccaatgtaaagcattcaatgtcttctattacgtatcatctattttgcacaaccctttaaagtccaaataagttagaccttggttccaatcgtttaagatgtggtaagcccaaagaaaacaaacaataaaatgttttttttaaaaaaaaaactccatatctgtgttatttctttcattatagcccctcgtagagcccaggtgctatttccttttccttttctttttctttgaaaaaaaaacaacgaatgtgctaattcttaaccctgaggaaacctaaaatcggagacataccagcgaataaacaaacaaaacaaacaaacgaaaccgacccacctgacctcctgtcctcgtctccaccacttcccctcccctctcccgcccccacgaaatctgggaggagccacgacgccattgccaacccttcttctcttttccccccaccgcaaggaaagcacttccggcgagcgtcgacgacgacgaatcgtcgcgagaaattcggaaggtacccctaccctcgtccccccccccttccccccgtcgcctcgccgcgccgccacgcgcccatccacgcggcgtgcgcgagggcgcggacgatctccacgttcctgttttttttttctttgtttttcgaggggggtttggttgcggccgttttgatctgagatcttgttgcagtcgataggggaggtcggggaggaggggggagatgtcggggttcgtcggcgtcgtggtctccgacccgtcgctgcagggccagttcacgcaggtggagctccgatcgctcaaggccaaggtgacctaaaattatccccggtttcttcagttcgttgtataggaagccgcagttcgcctctcattcggggtggaattgatgggttttttttttttgtcggggtggcagtttctatctctgaagagagactccggaggacatgccacgacgaagaacctcccgggactgatgaagaagctgagggggctcaatgaggtgatctccgaggaggagatcgccgcccacttgtcccagtcttaccctgacgccgaccaggagattgagttcgagtcattcctacgggtacaactcggttattttctgaattcctgttggtactgacgagaggaatagagcgtcattgcattgttgatttgattggaatgggattatgtgtggtgtgtttgtaggaatacctgaatctgcagtcaagggtgagcgccaaagaaggcggaggtggtggtggcggcggtggcaagaccgcgtcatctttcctcaagtccagtaccactacattgctgcacaatctcaaccaggcggagaagtcgtcttatgtggcgcacatcaacacctaccttcgtgaagacccgtttctgaagaagtatttaccaatcgagcctaccgacaaccagctgttcgatcttgtcagggacggtgttctgctatggtgagagatggtctttacagctaaccaaagggtgcatatccatttactcgttgaacagaaactgcccttgagtcatagctgatatttgctcatttatggatcatttgctcagtaaattgatcaatttagctgtacctgggaccattgatgagagagcaataaataagaaaagagttcttaacccatgggagaggaatgaaaatcacaccctgtgcctcaactctgccaaggccattggatgtacagttgtaaacattggtacacaagatttggtggagggaagggtatgcaacgcattccctactttaaattctttttagtaattcatggtgcattgtagtctatgcaaattatttttaccactaattttcattcaggactacattgaaatactttaatgccctgtaggtgctaggtagtttgggtacaaagtatgctgtcaattagtcattgtcaccactaatttgctgcataccattttatccttcgctgtataacctgctaattggttccacctcatatttccttgctcatttgctgtatgtgttattctttgatatgcttgtccatgtgtcagatgttttcagccgccttccctttgtgacttcttctatttaattcaagaaattcactaaaagttaagttgtggttaacatgcttcttttttgcagcctcatttaattcttggattgatatctcaaatcataaaggtaaatgttgcactgagttttgcattttgatgtttgacatactatggttaaactcctgcctcatcatataaagatctttttgcacttatcatcagattcaacttttggctgatctgaatctcaagaagacaccccagctggtggaattgtttgatgacagcaaggtaaataaacattctgtccttctattaatttaattcacatgttcttagaacaaaattcattttactgattattatgcaggatatagatgaagtgttgagcttgtcaccagaaaagatgctacttcggtggatgaaccatcatctgaaaaaagctggctacaagaaaaccgtcagcaatttctctacagatgtgaaggtgcatatgacatagaacaaagtgacattataattaattgattatgtgcagtttgataaaagaagctgcccttgtgctaatccactgtttggcttgcaacatctttgcatttgggtttcattgactaagcaacagatggctttgaaaattatttatgactcactcttatgctgtaaatcccctttctaaatgcgtatgtgggaaaagtgaatcaaactacattcatttaattaatattacttcaatctccaatgttcacatacgttagttctgtacaggatggtgaagcatatgcttaccttctaaaagctcttgctccagagcattcccctgaaaccacattagagacaaaggatcctagtgagagggctaaattggtacttgaacaagcagagaagttggattgcaaaagatacttgactcctaaggatatcactgagggttctgccaatttgaatcttgcatttgtggcacaaatattccagcatcggtaagtagtatgtttcttgtttctccaaaggcattaacttttcttttttttatcataaagctagctaaggtattttccccatgttgcagtatattcactttaaaagtttcttagctagctgccaatgaattggtcatctgcttatcacttgaatgctattgttccatgatgcacaggaatggtctaactagtgacaccagacaagttactctcaatcagactgcatcacgtgatgatgttctattatcgagagaagaaaggtcctttcggatgtggatcaacagtcttggggttgactcttacgtgaacaatgtttttgaagatgttcgccatgggtatgagattatttgaatgagcatttgtgtctgtctccaaatgaattgggcacttacatcctttctcatgcagatgggtacttcttgaagtactggacaaagtttctccaggatctgtcaattggaagctggcctcgaaacctccaattaaactaccattcaggaaattggagaattgcaatcaagtggtaaaaatcggaaaggagttaaagttttccttagtaaatttagctgggaatgatattgttcagggtaacaagaaattgattgttggtgagtgtgactgaatcaagtctttttagtggtttctgattgatgttatctgtttagcacacaattgaagccatatctgttgtttttcagcacttctgtggcaattgatgagatttaatatgcttcaattgttgaatagactgagatcccactcccaaggatcccaaggaaaagaaattactgatgctgatatactaaaatgggcaaacagcaaagtgaaagcatcaggaagaacatctcaaatggaaagcttcaaggtgttattaatttctgtttaattagttttaatttgttgttagataactccagttaataaattttcttatcttctctcaggacaagagcttatcaaatggacggtttttccttgaacttcttagggcagtacaaccgagggttgtcaactggagaagttgttacaaagggggaagatggtctgttcatatgcacgtttgaattactatttgatgataatttctgactgtttatatatgtatccttttggaaaaccgtagcattggctgattcactatttcctttcaattctgcagatgaggaaaagaagctaaatgctacatataccattagtgttgcaaggaaaatcggatgttccgtgtttctgctgccagaggacatcattgaggtaagggatgctaataagcatgaaattgagcgtgcaacttttaccatcacagatggaattaaatgctttaccttcagcaatttatctagcatctgggctaaatgctttactgtctacattatttgttgtctgtgatcctcttctcttttatcttgaaaaatgatggttattatctgttgactaatcgtactcttatgtttctgtttcaggtaaatcagaagatgatcctaacgcttacggctagcatcatgtattggagtctacagaagcaaccacagtcacaatctgaaacgtcagaacaatcagagccatctagtatggcttcggatgcagcttctgatattgcttcggaggacgctgcttcaataacagctgcatctgagggagaagaggtgaattcgctatctgatagtatgtccaatttgaccacatatgatgctatttcaaatgccccgccagcagaaaatggaaatggtgtggcaggatgatgatgattacacgggctgttcttctgtcctgatagcggttttattatggtggaactagtaccgtcatggtgtccaacgtttgctgccagaagtgatttttttcctgcttctgttccaagcctacttttgaggtagcatgatagatacagatacagatagatagagttgccgtttgttcatttaattttgctctatacatacgacagggaaaaaactatacataggtcactagttgggcatttcttgtactcttagtatactttgatttcaatgtcttcactttgtttcccggacctgtcaaaatgtactggcatcgtttgtaatctgctgctgctctggaccattcatgagctgtatataacataatattgtggagagatctggtttcccaagaatccctgttcattgtttacagtactcttttcaccaatctatctctatgctctactagcagatttgggccgtgtttagatccaaagtttttcttcaaactaccaactttttcatcacatcaaaactttcctacatacataaacttccaacttttccgtcacattgttccaatttgaacaaaactttcaattttagcgtgaactaaacacagttcgggtatgacacctgttttaatcacatcaaaactttcctacacacataaacttccaacttttccgtcacattgttccaatttgaaccaaactttcaattttagcgtgaactaaacacagttcgggtatgacacctgttttaatcagtctttgggtgtgtttagttgacgccaaaattggaagtttagttgaaattggaagatgtgatggaaaagttaaaagtttatgtgggtagaaaagttttgatgtgatggaaaagttttgaagtttgaagaaaaaatttggaactaaacaatgcctttgttccgttggagaatgctgaaagtgatcaaccatgaatatttcagttctcttttcacattggcgatgctgcctcatcatgcaacgaagagcaccagttccacgtttgaggttcatagaaccgacgaaaaccacttggttttcacgacatttcgtggttttgagctggcttgagttgacaaaccactctgttgactgttggagtatcaatttgaatcttaaaattttgacaatttatctgaattccatctcttttcaaacaattttcgccaaaactgacaaaaccaacactgagcgattttcggtcagcaaacggttttgtgaaccttatgcatctgagaactgagggagtggtagaatttgctgcgttttcgattattttttttaaagaaaaaattgctgctgctgttgctgctctctctatctcttatctctctctcaaataagagcagtgtgcagcgtacgtcttgcaaaaaatgagagcagtgtgcagtgtacgtcttgcgaaaagatgcctttagcccctacataaataaatacgcatacagggccagccatcagatgctttggagggctccatgccatttctgctctttcttaagacgacgcagctgccttgctgccggtgcctggacaccatcgcccacagctccctccctctatctctctctctctctctctctctctaacaccaccacacatctcctcctttcttcttctccatgcaaaccgacgcttcatcgaggagctcctcgccttcgccatggccgccttcctactccgatccatctcgcagaacggagatgatgagcagcagctgctggtggtggtggtgacacctgacacggcaatgcggcggcggtcgagggattaaaccggcctaaaacgtatccattccgcggcatacaagggcaggccaggcatctgatttcctacctacattactactactagtctactactgctactactacatattatcatttcctagctagctattagttcacttctcgatcgttttggtgttagcttaagctttcttgatttcttttgctgccttagctttttcttttttttcctttgcggcgacattgttgcagagggcgctgtgaaatgtgaataacctctcgcgttttggatgatgagtcgtcgctcgcgttggtcgattgatctctgtatcgtttttcctgtggtgagaattgaggttggtgatctgcaaaagctagaacagcgtgatgatttctatgtttcttttttcgtgcgccaattactcgatcttcttgcttagttatagctgtaaatattccatgacaggagtgtggtcagtggtgcacagtagctaactgaaatcctaatgcccgtctcgttcgcatgctgctgaaacagtacgcagcatcgcgtgcaggcgactctcaagtatcccgagtcaaggcgggtacagtttgccctttggcatttgggtagcatagcaggacaacatatttacacaagagcttttcgagctcctttcgaaagaacaaaaagttttaaactgtgtggtgacatagtaagaacaaagaacacagcatctctgactctgcatgataccaaaatctacgatcaaattcttgtagcatgggttgggaatatcttgtctctgctgcggcatatatatctgctactctaaccatgcattccggatgctgtcctttgcccaaggggcaagaaatgcctctttcattcctaactagttgtgccatatccctgcatcttcaacactttcatattccttcactggaattgcatattcatcctacatgcatgccacaatgctaccacaccaggaggaatcacactgccacttgcgatcatcatctgttcatttaattcttcccctgttcgtccttgaagccccgcgcgctagctagctcatcacacagcagcatgcatttagccatttactgccatcgcctggagaactctcaaaggcgttaatggcctgcctagctgcgtgtcagcgtctgtgtgtgcgtgccactgtggcactgtcactgtgcgagagcgatcactcccccagcctcgctgctgcctgcaagagcatttttctcaccggtactacgcgtcctacacatacatgcacaatatattctactagtacttgggctgtttgatagtttgatactacggtggatgggagtcctaccaaaaccaaaaaaacttagcgcacgatccgcacatgcagtcgtcgctgtctgattttcccataaattgtggtcggattattagtacttgcgcagacagggcagggaccagcctcatttgcctcgctctctctgcaatctgcattgccattgccattgccttgcactgcggctgcgctgctgcccagtcctcctcgagtccagccagcccaccaccgcatgcagacgctgcagcagcattaggagatgaccacacgggcttactagacgagcacaacctacgagctgcagtctgccggctgacgcgtggggcccggcccatttgtctggcgtgccacgccacagtgctgcctcccttctgactagtactgtggtgactactgatggatgatgtggtgagtaggagagtaatatactgtacctaaggagtgctcctccgtaaaaagttctagttataaatttggatatgtggctgtgtgttcaaatttatagctacagttcatcttttttagggtagagtagtactccgtaagagtagaggtggcaatgggtcggatcagacaatagacggaacattaacacgtccggcctaagacttgatatcccttgtctaggggtgaaaacggtttgagtatttttttatatccagacacatttgttttaaagtggttcggaaaattttctatatataagacgcatttgtgtttagattagttctatatatgttgagtatatataagtacatgttgagattagagaccaaatgaaataggaatgcgtcaaaatcagcaatagacacatatatcaggtctgacatgggttactcactggcataatataaaacccatatgcgctcaaaagaattttggatatcggatcaaacatgtccacgggtaacaaaataaacctacgctcatcgggtgggatacccgtgggtatcggactagaattgccatccctacccagtaaattgctaccactagttccttaattttggatgcgcggacacatgctggcctaaaacaatgcaactatgcaaggctagagcttagagtttagcaccctgcccatgttctttagcttttcaaaagctccccattggtgctcgagtttgtgctctccttgttttttccccttcaaaacggattcacgaacgctcatggttcagagttcagactagcagtaggcacaggactgtacattggatgatgccttttgagtagttgaggctgagagcggagatggtacccaatggcggccgatacgagtgatcgcggtaggggttgtcgtcgtcgtcgtcgtcgctggcgctccgctcgctcgcacgcccgcctgtcgttttgctcgcgtgcgtgcgtgcgtgcttgcctcgatcgatcggtcggtcggtcggtctgtcgcctcggcacgcaggcgcagccgcgcgcagcgaccgcgtcgtgcgttcccttgtttgggatctcgccaaccacccgcatcacaacgcggctcgcatcacgcccgagacacgcacacacgggcgagagacgccgcgcttgccgggttggttgcctggtttgactccgtttttttttcttttttttggtttgatcggcagcacagcgcctcccggcctcaaaattactgtagtaccacgagatcgatctcgacccgtctcgtcgtcgtcggctagaagtaaaaattctggatccatccatgccaaacaagtaaaaatctggatccatgcgaaacaagtagtcgaggttgaatcggatggatgtgctcagacagaggcattgccagattggctgcttgcctgctgcaaggtactcaacagtggcaggatggcagggagctacgctacgcatggtccaggtggtctggtcgcgaataggaatggtggaatgcgattatggctgtgtttagttcactgtgaagttggaagtttggttgaaaattgaaacgatgtgattgaaagtttgtgtgtttatgataggttgatgtgatgaaaaaagttggaagtttggatacaaactttggatctaaacacagcctagatcaaacgcggaccgccggtttgtttttctggttttgaaataggtgagccggagttctcatgagtcatgatccagccgaaccagggccgtgctgtcaaatttgtagaccctgtacaaggctctaagtgaggcctaaatcaagtaccaaatatagctaaaataatatatatactgcaaaacaaatgtgatatatcaagaatagtatattttttaactcttgttttgtataattagaaactgtcaaactgaaaacggagaatgtttgttgatgttgctggcttgctgcctagtgccttgcttgttggttgcttgctaagttgctattcgctagttgaatgaaaatgtgaaattggatgagccggctggcggcctggtgctcggaggagacgagacgtcgagactcgagacaaattgaataagtcacagatacgaaaacgaaagagaatacaaaacgttgtggggcctcggggctcgaagttgagaatacgaagcgccacgcacgcgaagtcgccacgcggagatacgcgcggactcgaacggggttctggcgctctagcctcatacaaatacatgtgccttctttggttgggctgattttttgaggccctagaaatttgcaggccctgtacggtcgcacgggccgcacacccctgtgcacggccctgagccaaacgttgagtgctccactccgttactacgatacgatgctcgtaaaaatatctagatgagatttcagtagcgcgaagtaaacataacttaactaaatatatttctttgtgatgaaaatataagtactcgcatttacgactaattattattttagtggtaagtgacataccatcgatagtgagatgttcgtgctgatttcgttaatctcaagctatgcctgagatgcgggtgtacgtatgtgtcatcatgaggtgagtgtgaacgtgttataacttataagcgtctgtatttgtagttttttttataagaaaaaaagatttcaatagtaaccagagtccacttagatgaactttctgctgctgggctgcgccgacgtgttcatgacttcaggggctatcccaccgaggaacggtgagcacgcgaaaagagagaaggaattatgttgctactaccgcgataacaccacacttatcacgataacggattggttatcaacaaatttcacagaaatttcatcaaaatctatcgaattatggcttgacttttacgctattcgtcgtcgtcgataaccggccaaccgggcaataactgggccggctaccattgacaacgcaaaccaaaggaaacaagccggccttatgcgatggtaagcccacacgagagaacagccaggtagggattatagcccaacgctcccatcacgacccactacctttggcccatgggagattgcgaatcgcggacgaaaaaagtgcaccgaagttccctcaatttgtcatcgagttacaaaatcgtcctccaaccgtaaaatcggatacaacgcatccctcaacttataaaaccagtgcaaactagaaccctcgatagttttgactctagttttgtctgacgtgacagctgacttagtatagtacccatgtgggccccatacgtcagggtgaccacgtcatcatcatctctttcctctcttctctcccttccttctctctctctctttcccagttttctcctcatacgggccaggcggtggggtgatgtgggaaagggcagctggcgacgggcggtgcggtggcgcgacatcggcaacactagagaaggggcaacgcggcggcgacggcgggtcgggagcaggcaggcgccgcggcggtgggcatgaaggtggagtggttgcggcaccgggtggaagaagaggaggtcatcgaggatctagcacacgcgcaggcggcgcacaccggggatgggagtgcgatggcgttgcggtagagcgagcatgaggcgtgcg

SEQ ID NO: 30580 - DNA, 3146 bp, Oryza sativa
ccgacatgtggggtccacgtgggttccatgctggctcagcacccatatcggataaatccggggatcaaaccccatataaggttctaaagttgcgggttttgtaagttaagggatgtcgtatatctagttttgtggttaggacacaattttataactcgttgacaagttgagggacctttggtgcgtactttttccaatcgcggacgggaagtgatgcgtgcgcagccagtgtacggccggccaaggtcgcgtgggtgatggaacccaaggtcagcggtttcacgcgcatgaacgctaccatccggcgaagcgcacacgcacggcgggttccgcggccgcggccgcgcgcgctagctcgccgtggcttcgcgcggctgctacgcgggcgatttctacccccattcacaacagtcaacaaccgcatggcgcgcggtgagtccgaaactgacttgcactgttgcacaagcggcgcacgcgtccaggttggtcaacaacgcgtgcaaggcattgttgatttcaggctttcagctacagcatgttgacacacattggcctcgtggggatcaggcccgaacattctggcctctgttagagcagatacaatagcaggctataagctagctacaaatatattttaagaagataaatgaggagagagaagtgtagcgggctacagatttatagccagctgtaatacggactccaatacataatgtgtgtatgacaggtgggaccagttattgatagtgtagtatgtaactattgtatgaatatgtattagattggctatagatgaattggagccagtagttggctatactattgaacttgctcttatcatcaaggacgtgtgttttttttccacgaatgtgcagaaattttgcacgtcaatatattagaaaagagtagcatacaacggtaatacgcggagacggttgttggggataggaggtcatgtacagtatgacactaataagcaagtactccctccgttcccttttgatcatcgtattgcaaaaaaaataataattccattttgattgtcgcattacggtggggaggagatgaaaatcccgggaaggacgttaatgacacttcctaacgaacactacatgcatctgattggttaggctatacggcatgtagaactgattaggagccgctgcatgcatcgatttaatacgctcacaactgattggccagccacacggcatgtaaaattgatggcgttacattcacggatacgaaacgctaatgtatgtttttgatgctgattaagtgctccacatgattgtcttggtattgatgcacaaatcatatatgaagatcgattaggaatggagcgagtatgacactaataagcagactgcgacaagcgaaactaagcaaagttacgtgcctgcctcctgacaagataggcgtaagcatagtgagagaatttttcaccacgcatacaactcaagcgcaatttcaattcaacaagcaagcatatttcatttgccaggccgactggccgagtatttgggctgtacgggcggcggccgagcaagtcagcctaggacgatatgccaggaggctaggacgaaaggaaatggctgaaagatgcggggagccaaggacatgaaaggactgaaagatgggggcgtgtgatgtgactcgtgtgctcacgtttttctttcacaagctcaaagaaagctgaaccaaatagaccaaaagaccaaaagacgaacaaatctgtgactctcgcacagtatagagacaaggaactaagtaatatcttactaggtgacctatctgcttacgtctatttttctcccacatctatacccatgcaattgagatcctctgtggtactgcatgtgcagtactgcttactgacatctgggcccgaggggctgtggggcccacatgtcagtgagcagtactgcatgtactgcacatgcagtactgcagaggacctgcatccataccaatgctactaaattggagtagcactttgcgggagcttgcaccagtgttcacaatctttattaattccaaacgatttttgtgaattttgaacatctcgagcatgcttagatatcgaatgggggttttgttttgactttttaaaattcatttggaaactgtgaaaatcaacgtatcgatacagctcgaaattcgctaaccaatcaagattataaatcatagcttccatattaaccagaaagatcattgttgattggattgatcgagcttatattctacgaagtatgtcatattaaataaaacatgtaattggaaatgtcatatactctttcttttttggttttttccaacatttgaaaattataaaatttaaaattagtaatgaagcaatacatgttatgtaatcagcaacccgataaacaaatattcctatgtctctggttagattcttgcaaacaaagtagacaacaacatagaaatagaaaataaaacaaaagactatgacaaaaaagagtcgcatagatagaactgaagccttcgcatcactcttgtgcgagtggctcgggagcgaaaccctagccgcccgtgccgtcacctcccacccaaccttgacacctcgcctccgtcggagttcgccgtcggaaagtcgagcgaccagctgggaaggcggagcagccagctgagaaggcggctgcagagacaagaagacctgacgaggcccgtcctcggcgtgggaggatgaagtggtgcacggcggtagccggaccctggcggccagacacggaaagggcaagtcggatctgatgcccctcaaggcagatgcatggacgactgtggagggcggccgcggaagcgaaggtggtggtaatggtgccagatctggtgctcccatatccaatttcggcagcgatgcaatgtctcagcgcggtaacgctgcatcgacgaagggcaattgccaatgtttggaggaaggtggagacgacaacggggatggggagaagcaggcagcgactgctgggtgtggggctcccaaaggaagactggcttagtacgaggcgcatggccggcggtgggtggccaacgaggcgcatgcagagcatggcacagaggcttgtggtggagctcccgaggggaagttgtcgtggcacggaggagcacgaccggcagcgagaggccag

SEQ ID NO: 30581 - DNA, 19926 bp, Oryza sativa
  unsure (1)..(19926): unsure at all n locations
agctcctttccaagcgttagtacccttgcagtggcggcttgccgtcgcaagatggccacgttggacgggctagtacaggggagaggggatccattcttctctctcaccatcttcttctccaacccacccatgtggatggatctggagcgcaccggaggtcgagatcctactttgatagccggccggcgacaaggcgtcggcgtggtggctgtgcgttgaagaggattagctagtggtgattgtcaaaactaacaggcactcaataacctgggagagtagggaaaatatgggcgaagatctagccttcaggatggctatggcgacgcctgcgggcgccgcgttctccttgggtccttgttgcgttttttttcctctcccagtggtttttttaggtgaaaaccatatcctgattctctaggatgggcagcggcggcattcttggcgccgtttccttcttggaggcgtcgttagaagatccattccttaggggtgttgtgtgcgtgttttatttttttagcagcaagatcgatcagacgtagacgcgtggtttggttgtatttttctttttcttgactatagtcttctaggactatagacttgtattttatttctactatatcaatacaaacgttgcactatcttgtgcgggttgttttaacaaaaaaaaaagactatgaccaaccctaactccatgaaaaatcatggtagacaaacccttaaatgacttaatagatctaattgctaaagactttattcaacacaaaccttaagagcttattaaaattagacgagagacggatcccctccctcatcgcatctggtgaggatgatggaggcaaagaaggagggtgattggagtgatggagagaacccatgtagatcttaatgtgagacgttgaagtatggactcaggaagcactttctgcaacaactcatcttaatttctatgtaattccctatagtttataaacaagttcggaataaataagtagagtttaatctcatttaccttcgcaattattgtaaaagtacgttgtaatatccaacaactacgaaaattaggtaaattacacacctcaccttccattcaatccgtacatttatacccccccgctccccaattcatgtggttctttttttttttgaaactccaattcatgtggttctggtttggctatccaacatcgcacttccccgtggcgaatgacgtggtaacttaataaaatactcatctctttcttcctctctagctccatactctacacattcaaattatgaataaatgtgacagtgtagagtatatatttttcaggttttttacacattgagggggaaaagagataaatgtgagcgttaatatagtattagtgctgttcataagttggatttatcttttttcttttgttcatagtgagcgttagtgcgttacacattgatgagcagtgatgactgtcgactgatgaagcacatgttatgcatgagctagcgtgaaacaagacgacgcgcgtcgacgagaccacccggccccgaccaaggctgagagaaacaagtcacagaaattgtacgtacttgtaatggacttattaaccgccaacacaacctgctggccctataaattgacaagtactcgtgctcttcagctgcaaagagccacagcgaacaaaagccatatattgtaacgaattactacctagctagttaacctggtctctccagagcaagctacccgttagtcttgatcagctagctctagctagtagttagccatgaaggtagagcaggacctccacatgagccggggcgacggcgagaccagctacgccgccaactcaaggcttcaagtatgcagtccctttctactgtgaaatccgtgtgatcaaacaaatcacatgcatgcaattacttcctccgtttcacagtgtaagactttatagcattgctcacattcatatagattttaatgaatctagatatatatgtatgtctagatttattaacatttatatgaatgtaaataatactagaaagtcttacattatgaaataaaggaagtaaccaacacaactaatgttgcacacgtctggtataccgaatgaagctaatgcatgcttgattttgcttgacatgttgttcaggagaaggccatcctgaagacgaggccgctgcttcacaaggccgtcgaggaagctcacgcgtcgctctccggcctctcccgcgcgcctgcaggcggcaagatggtggtggccgacctcggctgctcgtcggggcccaacactctcctcgtcgtctccgaggtgctcagcgcggtggccaaccgctcatcatgcgaccacaagtcctcgctggtggcggacgtccagttcttcctcaacgacctccccggcaacgacttcaacctcgtgttccagtccctcgagctgttcaagaagctcgccgagatggagtttgggaaggctctgcctccctactacattgccggcttgccgggctctttctacaccaggctcttccccgaccgctccgtccacctcttccactcctcctactgcctcatgtggcgctccaaggtaattaaacacagtgcaaaaattaggaaaagaaaatgatgatcgagctagctatacgtaactcatttcccgtaacgagttgagagaaactcctgcgttcgattcttactgacatgagaacatacatccaggtgcctgacaagctagcgagcggtgaggtgctgaacgcgggcaacatgtacatctgggagaccacgccgccgtcggtggtcaagctgtaccagaggcagttccaggaggacttctcgcagttcctggcgctacgccacgacgagctcgtctccggcggccagatggtgctgacgttcctgggcaggaagaacagggacgtgctccgcggcgaagtgagctacatgtatgggcttcttgcccaagctctccagtccctagtccaagaggtatatatacaaacacattgaaccagtcactctatgtagtactgagacgaacacatttgattgatcttgttgctaatatgcagggacgtgtggaggaggagaagctggacagcttcaacctgccgttctactcgccatcggtggacgaagtgaaggcagtgatcaggcagagcgggctgttcgacataagccacatccagctcttcgaatccaactgggatccacaggacgacagtgacgacgacgacgtggcgacgctggacagcgttcggagcggcgtcaacgtcgccaggtgcatcagggccgtgctcgagcccctcatcgctcgtcatttcgggaggtgcatagtggacgacctgttcgacatgtacgcgcggaacgtagcacagcacctcgagcaggtgaagaccaagtaccctgtcattgtgctctccttgaaggcaagacgctgaacctatccgttcgtcggctcgtggtacacgatgttgcattttataagtagcgtgccagtgtgtgttgttggggaccgattgatcacccagctgctctgcaaattgggtctgccatagcctttgtctagctttgagtcgtttgtcgttgtaagttaaatgcgacgtgtgcgtgagtcagtaaaagtaaaatgaactagcccacgcgaatacgcgggcatgtatcttaagttgtgtttatatgggtagaaaattaatctaattatttctatcttgattgaaaagtatgatttctctaaaattttacttatcaatcacttggattttttttccaagctatatgttaactttatactttgtactctctccgtcttatattataaatcgtttgtttttttttctagtcaaacttctttaagtttgaccgctgacatgtagggagaggagaatgaagagttcgctgctaacatgtaggctccactcgtcatgttagcaaaaaccggccactataccatcgaaggactaaagttgacacggtattatgagttgagggatgagttatacttggtatttcggtttagagacaaattataacctggatgataaattgagggatctaaagtgaacttattcgaaagtaaaaaccagtgaagaaatttgagggctgccagatccttagatggaagcctgcgccggtgagccctggagccgtgggcttgaatgttgatggtgcattactttcccaaaaattgatgctgtgttttaacgttatttattagatatattaatggtttattagtgagagttcgaaaacaaatgcatggagaaaacgttagaaaccatgtgttagtcagtcactcaccgttgttgcagcaaacaaaaactaccagtggtggctcgagtcaacaacaacgcggcgaggacaaaacatttatcggctcctgaaacttcggccatggtggtgcgcagatcagcaggtatccagatgcaatgatctaaatgatgcatcgcgcgtgcgcccgcgcgcggttgattccgtcgcattcggtgggggctcgtctagatcacgtttctggagagctccagggtctctttcggtggattcgactgttggtgaattgtgtcggcgactcggcgtcacggccgcactgctttggctaataagcgcactcctccaactcaggccgaattcagttctaaacttttttttttaactttcaactttaacttttctatcacgttaaaacttttctatacatataaatttttaacttttccatcacattgttttaattccaatcaaacttttaattttaacgttaactaaacacgcccaacacgccctgatctacgaaaccatccatccgttccaaatcgcacaaaaaaagcaaagtcatgtggtgaagccgctgtacctgtacgcgaagcaatgaaagcacacgcccccgtcttttcccaaagacgcgagctcgccgctgcgcagcatccagattccagatagtactattggcaaagcacaggtttggggcgccatgggctcctaccactacacctccacctgccactttttcttcgccggcggcggcgagggggagtactccagctacaagggtactggtagcaccgacacccacaggcccaccaccgtgcggatcccggttaccaccccgggcccggagcggccgccggacgacgcggcggcggccaggatccaggccgcgttccgggggcacctggtgaggaggcacgccgcggccgtccgcggcgccgacgacgaggcgacgcggctggagcggctgctccggaggcaggagacagtggacgccgtccgcggcgacgagcgcgagcgggcgcggttctcggaggcgctcatggccgtgctgctccgcctcgacgccgtcccggggtactacccggccgtgcgggaggcgcgccgcgccgtgacccgccgcgtggtggggctgcaggaagtgttcgacgccgtgctcgccgcggcccgacgccgccgacacgtgcggggtccccgccagcctggatcaggtcctcgaggggatctggggagagtcgccggttgcgccgccaccgccgccgccgccgccgccgccaacgncggtgaaggtggaggagaaggtggtgaggagtccgtgctgaaggagatttttcgggggagtgtagcaagtggtgtaaactgtcaaaagtgtatgcaaccgaatttgttgggaaatatgccggaaatatgttggtgtgtacctataaagtattaaagtggtgtagtataatgctatgaacaatcacgtaacatagtaaataacggattaacaacatgcttgttttgaatcttacatatctgaacatttgcaatctacttctatccagaagaactggctaattgggtaggtttatttgtccagtctgtagttctgacacatttgcaatctgaactcttctcttcagctctggaagaaaaagggaatcagctagggccgagtttagtttcaaactttttattcaaactttcaaattttccatcacatcaaaactttcccacacacaaatttccaacttcgtgtcacatcgttataattttatccaaatttccaactttgatgtgaactaaacacacccttatcctccctgctgagtgctggttctgtatttctgacaaaaattgttggatattattccactctcatcgtacatttcgttgatgttctggcgaagttcaaagttctcaaaaaaattgtccagtcagtagtgtaccgtatttgaatggtagtcaggaggtagggacgagtccattttcgaggatgggccttaatctcggcccacacctcacaactaccgtcagagaggagcgagccctagtatggtccctgaactccttatccagttctctctctaagtctaacccaagtacccaactcatctttatgtgcctcaatgaaatgtacgattagagtggattgatgtccaacagattttgtcagaactacaaaccagcgagaaataaaccgagctgattccctttgttctatagctagctggaagagacaactacccaattggccagttcaacgggtaatttctccgttcttcagttaatccatatatcctggaattgtctcacgttcatcaacaaccacccagtacattcctttttccctgtcactatacccatccaggcaaccagctaccaccaaagtaatcttgggtatgttttctctcgttccctgaagttgttttgatccgcatcatttccagtgttccaccagtccacttgtgttgtgccatctctgtttctacggactttctccgttttacaatgtaagtcattctagcattttccatattcatattgatgtaaataaatttagatagatatatatgtctagattcattaacatcaatataaatatgagaaatggtagaatgatttacattgtgcaacggatggagtagttgttaatgtacttcccaaaaggaaaattcatcatcattgagaaagtatattcggaaaaaaattcatcatcattgagaaagcatattcagtgcaattgctttcctttctttttctatcgaatcaagaactgttgatccagcgtaggtaaatggagtaccaattatacatcatcttgcactgagcatcagtgctgtacagtactatataacaagagagaaaattgaagagtagtactagtgtttgtggtccgatgtgttcttacgtttcagatcgtgtggtcctttgccttttgagacgatgacactagcgtaaagatgtaccggaagctagagggagaatcaagcctgtggcgcagcaatggagccgcgaggcatcggtgacgcaacggagcgcgacttatcgccttttcgaagaaagcacaggaggaatgcgacgttcaactgcatatgtatggatggatagattgcagcttctttgataagcaaacgcttggaagcttgtcctggattcacatacaaatgcaggggcctgctgccgatgctgccgggtgaggacgtgaggtagagcagctgcacactgtaggcagattcagattcagattcagatgcgatagcagaagcgcagaactgaacatacgcacaagagtggtccagtccatgcagcttcagaccgtgcatcagtgcatcatgattgtgttcgttgttggggagattatctgccctgctaattggcgattagtggaggcattcgagacaagttggcctataaaattttcatccatgtcagtcagtaactcatcagggtaatcatcatggaatgaaatcagtagagtagatagatgaagggaatcaaacatctctggttaggctaggcatcagtttaatgcctagggtcaaacaaaccaaacagcacggcagagcaagctaaataaaagaaaatttttaaggagtgcttagagaagtaaccggagttgacacggtacagttggccctccaagtcgtagtagtttcgtatcatcaactgataagcacaggattagtcagtcagcgaagcaaccttgcatctatgcatggcttaattatgctagctcctctgccaactgatccaggactccctctactaggacatcaatcatcacatagatgtactgtacgtagttaaatataattagcaggagattgatgatgcatgtgtaacgtgttgattggataagggaggtcatcagccaatataatgcatgaaatcgatgatcaacatggcccggccggtcagaatgatgagctcatgcgcatacaagtaaatacgttatcctgctaaatttgttgctggtatccggctatccgcatctttgagaaattgtctacgttcgagattgataaacaattaagattaagggcctgtttagatctcttggcaaaattttacgctctgccacatcgaatgttgggacgcatgaatagagtattaaatataaacgaaaaaataataattacacagattgtgcataaattgcgagacggatcttttaagcctaaccgcgccatgatttgacaatgtagcgctacagtaaccatttcctaatgacggattaattaggcttaataaattcatctcgtggttttacaggcgaattctgtaatttattttgttattagactacgtttaatacttcaaatgtgtatatccgatgtgacacgctaaaactttacacccctccatctaaacacaacctaagtaacgatacggaaatagactatgattaattgagttttaattattatgaatttgaatataaatttatttgctattttagaacaacttctatatagaggtccttattgattgactatatttttctaacaaactaaaactgtttattaaggaataaaattaatttatggttaaaatttatatatgtgttcttagtgacttaaaagtcaatataaaaaaagaactacgttaaatgtatttaaaatcaacttcaatttttttttaaaaaaattaaatttaaatttaaattttggctctgagcaactaatgggacttagaaagtttgtagtttgaaaaacatgctaacaaaaaatcaatgtagaattacaacttaattaggcgtgtgttttgttacttgtatatgggtagtaacatacacgtccctcgtgtaattgataaagtattacatacgcagtattttacattgtactgtatatataatcgcattttaggggagacaatggaacacacaatgacacaacgtgacaaccagagggagcaaggaaagcaggatagctttacaaggaaaggaaaaggaaagcggccgcggacgccagccgccattccaatccaccctatagaagtgcctccaactgcagtgccaggtgggccccgagaaccgggcccacatgtcatcgaggttctgaggataaaaggcaggtagcaaaacgatggagccaatcatcatagctgtcgctttctttctaccactactgcaaaatcctaaaaaatcgtcccatatcggggaaagcctagcgggtgcagccttcgcccgtttgtccttttatagatatcgggtgaaaaactgaaaacccaactcatttagcactccagttatttttatccttatccactagattgatcccatcaactgtcatcgttttctcggccgtagaccatgttgagctctctgcccgtcctttttctacggtgctaattaagtttagactacaaaacatgattctaacaatttaatattatttaggagtaatatgaagtactctatcaatttcataatgtaagtcattctatcatttcccacattcacattgattgttaataaatctagacatataggatcccacattcatattaatatgaacgtagaaaatattagaatgacttacattgtgaaacggaggaagtagttttgaagtactaaagaaatttatttgcttttcttaacaacttaggagtataaaacaatttgtccattcgtactttttctaaaacactataattcatattgagttttagaatatgattttaaaattaattttaggggagggttttacttagcaactttcatcttattcatgataagaaaaaaaaaactcaagattccaggcttctattggatatgttgcatcacattggttgcaaacgaaaaattgtttgcgttactaatgaagcctacttaaacacggaaaataaaacacgtgattatagtaagattaattaagtaacgcaaacaattaatatgatttttaaattgaaaaatagattaatataatttttaaagcaactttcagatataaaacttttaaaaaagtacaccgtttaataggttaaacaactgaaagggttgagaaagagaagaaaagaacacagcctaaatatagcaggttaaggctaccggaagatttcaatctaaaaaaacattatcaatgcagtttagttttctcatgttcatcaatttaaatacctaacaatacataatttgcagtattatattgacaaatgggcccacttgtgcaacatatatgcttttttcccccgaaaccgcggttttcgcttggttaaggtctaacgggtcaatcaacaaccgtgtcttcttaacgggttggacaccctatccaattaacactcctccccacccatttctatccccattcaccaccgatccccaccaccaccaccaccccgacggctcgaccctacgaccgtggccgcagtctgcagcgagctccggcgccctccctcccctaggtattcccgtcgatcggcggccgcctcccccggctacgatcgccgccgctccgacgaccaccggcgtggtccggcgaccaactccggtgagctccctgctcctcctcagtctcatctaatctcatattcatatggtttccccaacctccgtggccgtcggggccaccattcggcgcgggaccgccgacccgagtccaccaccgaaagccgccgccgccgccgccgcgctctttctcgtagccgctcccctcaccgtaacttttcttcccgttgcacccggtcgccggccgtcttccgacccgtggccggcggcaccagcaccgcctcgccgccacggcgatcctctaaaccccgatctcccccgaccccaccccgaaaccctaatcctaacctcgccggaggcagggcaggagacatgtgtggtttccatttttggcacttcccaattctttgctagtcttcgctagacgctagtgatgcttcactgcatagcgagaattctgaatggaataatgaagctttaggttagaaatctagttgggacttcaaaagattgtgcgaataccaaacagggaaaaggtcaaatccttgtcctcgttctctgcctccaaacgcggttatgggcttggcgcttactagggattgccggggaagtgggctgttgaaacgatgctacgcgttagagaactgtgggcaagactggctgttggggagaaggggtggaggtgaggcgatgcaacgatatggcaacagatttaaatgaatgggggaattgaatcttttattggtggtactgatagcgtgtgattagatttgaatagttgcaagaactatgggcaagacttggctgttggggaaaaggggtggaggtgaggcgatgcaacgatgtggcaacggatttaaatgaattggggaattgaatcttttattggcggtactgatagcgtgtgattagatttgaatagttgcaatacaaactatggttgccatggtatggtcaatgtggctgggagtggaacagttttgatatcaacttgggggaagaaaagaaaaaaagaaggcatatatttctcttggggtgatgagaattgctataacaactgacaagtgaaagcaacaaacattaccccccatggaaggtatccgtgacacgattgatcaatctacaagtctgcaaatgtaagcatgttaacaaacctggtaatatcccaagacgacgacgaagatgacgactaaccaagtggagaagttaaagtgcttggatgaattagttgaggaaaaataggcaatcaatcaatcaactgcatattgaaccttaataaatggtcacaaaagccccagaagaggaaaacaaccgcaggggtagagaaggaatgagcagtcaaccagcaatagtggaagcgctaagtattgatttctattcactttctcctctagactattggtggttgagagtgatatgtgagggagggaagccaacaaggtgaacaaagaggaggaaggggaaagaaactagaggagaggcaattgaaatctttctttctcttttgcttgccctcttttgaatcaaagttcacagctttcacttgtcaactgcagcgcttctcgcttcatgatgaaatctattcccttcttcgtttctttttttgcccctcaagttaagataaaattttgcttcctttttgctctcaggcacattaaccatatgtgccatgtgttgtttgtacttcaactcttcaaatgtaaaaatgctctatcagttctgccaatcttgtttaattcgtgcattgcaaacgtaacaaagtaaaaagattcagttttccccatttgtttatttcaatctgttataggtagggataatcctaatgctaaaattagctcatgataccctctgatatgcaggcatcccttcggcaaatgtggtgatggaccgaccacaagatcctttcaactcacgaggtatcatgacatgtactccaccttccaggtaaacggtgttttgctctggtaaactggatcttaatcgctgtccctatatgcatttgtcttgttccagggattgcagttccccctgcagtcaagatgaggaacatggctggaaacaacagtccatggatagaccctctgccaccaccgatgaatgcgcgcaatgggctggcaaatgccagcctcttctccacctctttgccagtccttcctcatgaaaaaagtatgccactttcactcataagacatgtcatgctctagtctgtgcatgtcatgctggaaatagcttgctgtccaaacaactgatgtgctcattggtgcagtagggtgtttattttttattttttggctatagtactgtagttacataggtatgactgagggattttaattgtgatgtgtgcaaagcaaagttggaagagggaatgacactagggaccgagatacgagggaaggctgcaaatggaattagttgtgtccaaatgccaaatatgtggtttcacaccaccatttattgtaaaaaattcccatctttaacatgccaaaaatcacatgaatccaaccttttcttctgtaatgtaatgtagcactggctcatatccatatattattatgaatatagcttgaaaagggggcaccacctttgctttggaggcctagaaattactacattaatatgagaaaaaaatctaagccgttagatcattgtgggaccaaattataaccatgtagattgatagcaatagtcgtataaaaagtaccattgtgtatatatagaatccgaagaaaagagttgtatattgaatccagacctacttttaatatctgctgtatataaagtataattacatacatgaaaataggagctaagagctctatagcaaatccaatttaactaccccgtgcaaaattgtgtagggaatttccctagtttgtattgatattcctgataatgtgtgtttccctctttcagtcaactttcttgattctgcacgtggcaccccattgatggatgatgcttctgcaaaactaaaagagctcgatgatgaccctgaagggaaggactacaagtttgactttgatctccgccaaatcgatgatttattgcctaatgaggatgatcttttcgacctgcaggcatgcaaatgagattgagcctgctgggcagacaaattctatggaagaactggaggaatttgatgtatttggcagtggagggggcatggagctggacacagaccctgtggagagcatcacagctggtttggggaatacaagtatagctgatgggcttagaggcaatggggtcaaccattttggtccgtcaaatagtgccagcactgtggccggggagcatccatacggggagcacccttctagaacattgtttgtgaggaacatcaatagcaatgttgacgacacagaattgcgctcactttttgaggtaataactgcaatgtttgttagctttatataattattgccatctgagattgatttgttagtgttacttatcagtaggtataccttgcaactgaacaactttatgtgctgtctaatcaactcatagtcagtgttatgtctgcacttctcttataatgtatctcagttgatctttacaatatccattattgtatttcagcaatatggggatatccgaacactttatactgcaacgaaacatagaggttttgtgatgatatcttattttgatatccgagctgcacgtggtgcgatgcgtggattgcagaacaagcctctgaggaggagaaagttggacattcatttctccatcccgaaggtttattatgttatggttcactttcaaatgcttagtccctttaccataaagtacttagcagtttgccatgttgattttgtaggagaatccatcagataaagatttaaaccagggaactctggttatttttaacttggatccctcagtttccaatgaagaagttcgccagatttttggaacatatggggaagtaaaggaggttaggatgttacttccaatttttccctttgaaatatgtttttgcttgaaaattgcatgttcttacgttcttcgtatactttgtttctgttttttggaattcaatctgatggtgttagtttctatccacagataagagagacaccaaataaaaagcatcataagtttattgagttctatgatgtaagagcagcagaagctgctcttcggtcactgaataaaagcgagatagctggaaaacgcataaagttggaaccaagtcgtcctggtggaacgcgcagaaagtatgattatgcgttttctttccctatccatttatctgtcatagtcttgagttgttgtttgcactttgcagtagaaccctactgaatttatacaccaattttgggatgatctattgatgctgcagttatgttgatttatctgctgtatgcaaatattttaatgtatcaaattgcactatttaactgaccaaggcatgcctgttaaggcttttcgttacatcctcgtgatgctattagcaatctgattgttttaatccagttttatcatttcatcagcagtagaatacctcagattcatcctcagttgattggctttcatttatttcaacgaaatacttgcagttttgaaagtaattagcttgttgtacaccctgtctccctgatttatttaatgggcagtgcactatttcctgaaggtatattttcaagcttgtggatatgctcatttagtcctaggattaatttaagaaaaatgcttaatgacattgaaagttcacacgtaataccattgagagtttgcaccgtttctttttaataccatttccgtctacttaactaatgtttccattaactcagactaaaaataacccttgtgaaccacactcacctcaaccatggagaaagctccaactgcaccactgattgttgtcattggacaccgtttcccatcatctgattcccacagtgggccaccaattcagagattcactcagacacatgcatagtagtagtgatcacgatttcatgagagagggagagggagaggcagggcacatggtggtggccattggcgatgaaatgattgtagatagtggtgcggcaggcaagtgtgggttcagtggttaggaggtcacccagggtgctgtatatgccgcgcaaaacaaatcacgctcatcgccaagggagtggatggacaaacagacaggttgagcggacaggtcttgtctctttcgtggctagagctgctctgctttccgtctcttgcatttgatctagcatcgtcattttcaattgcctctcctgctaggaaaataaacaaaaacggaaaaaaacagaaaaaaggcaaatggaggacaaaaatggtataataaatgatcaaatggtacattgcaaattttcagcgctattaaagtttattatgagctttagtggtacaaatttgaacttgagaattgtttatgccatggaaccaatctttcctactgtttgagttttggaaggcatgttttttcagttatcgtgcaaaccaattatcattgacagaatgtttcactttgttaacactgatctgatttattctcattttcttctggtttagcttgatgcagcagcttggtcatgatatagaccaggatgaacccagaagctacaggattcctcatgttggttcacctattgccagctctcctccaggtactcggactggatctactttagggacatttaatatgcttctgtctatttgtttacaacttatgaatgttaaatcatctcctgtcaggggcatgggctcaatacagtagtccaactgataacaatttgttgcaagcattcaatgcgtcaccaactggaaatggcatgagtcctattgggatgcctccttccttgatatcgaatgctgtgaagattgctccaatcgggaaggatagcaactggtctaaatatgacaaagtattctcaaacaacaaccagccccacggtgctgcatttcagcattcccattcataccaagatcacaaaagtgaacatatgagttcaagtcctgggactttaacagggcctgagtttctatggggtagtccaaagccttattctgaacatgctcaatcccctatttggcgtccaccagcaattggtcatgcaataccatctaatacccgttctcaggggcagggattattgtatggtggccgtcaggcttcactttttgggtctcaagatcagcttcatcatcatcatgttggctctgccccttcaggtgctccatttgagagccactttggatttttacctgaatcaccagagacgtcttatatgaatcaagtcaggtttgggaacattgggaatattggtagtggccgaaacggaactggcctcatgctgaacatggctgctcgtgcttctgtaaaccctgtttctgctttgagtggaaacatgtcagacaataactctagtagctttagaccaatactatcacctagattgggacaatcattttacgggaatcccacatatcaagggcctggttcttttggacttgacaattccatcgaacgtggtcgtaaccgccgagttgacagcagtgtgtttcaagctgatagcaagaagcaataccagcttgatttggagaagatccgtaaaggcgatgatactcgaactacattgatgattaaaaatattccgaacaagtatgtatgtggcttgatattgcattttcttttctgatcttatattactacatagttgctcagctcctaaattgttaggtacacttctaagatgctgctggctgcaattgatgagtttcataaaggaacctatgactttttctacctgccaattgatttcaaggtactagatttgtattgtattgtactgctgtttgcagtgacttgttttgatgcccagcagaatttaattatattttccccacgcagaacaaatgcaatgttggctacgcgttcattaacatgatatcacctgtgcacattgtatcgttctaccaggtatgtccatttcttttattgactcttgcatgctacacagttctttaattgatatccatcaacatgaagttcgtggtttatgtttatgtaagtttctcctaaatatgtctagctgagttgcacaacaacctaagattactggtagacttattcggaacaatttgtaatgatctgtttctgaatatgtgctgtaatttgcaggcgttcaatggcaagaaatgggaaaaattcaacagtgagaaagtagcctccttggcctacgctaggatccagggaaggactgcactcatttcacatttccagaattcaagtttaatgaacgaggataagagatgccgccccattctttttcattctaatgggccagatgctggaaatcaggtaagcttgtttaaaatgtcgacacacatttgtccgcttgttcttatgttcaaacagtatatcgaacaaggtaatggtgatttaactagcaaactgcatcttaggttataagcgtgtttctaacaccatgcatgaataccaggaaccatttcccatcaacggcatatgtatccatatgccactggaagatggagcaattgcaacaggggatccctttggaaatgaagaggacaacaatcagaacgagaggacagcaggagaagagttatgaccattgctttggagtcgccgataaatcttaactgcctagagaagagttttccttcccaaagtgtatagaagtgagaaagattggttagctgcgaaagtttgtggtgtggcatggcgcatctactagttttttttgtggcaaacgatgtcgccccctgaagaacaaaaaagtgacttggagttgagagttgggagtctgctaggtctctctctccatgtcttcctttcaagtttcaaccccctctgtacagatagatgtcgggagttgataattggtcgcatttgatttggtgtaaaaagagagtggtaccggtcaaactgtacagttttaaacattttaatcctctatgttttaggagacttgttaactctatgttttatcctgtgtgaactgagactccaaacagggttccaccttcctgtctacaaaccaaaaatcttgttatgtgcctgctttctgatccttcttccctgtcttgtgaattgtgatactgtgcaagcagagaagcacaacccaggcaagaaaggaaagtgatggctcctttgaaactggaacgtagatattttaaagaattcatgccgaaaacgatttaaatctaagtacaattctttcacaaatcatggcgaaatgagtacacaaggcgatttgaagcgaaaaggaaattcagcccagcctccaaaagcccactagcccatcctgcactcctatctcccaatggcccacacagaagcccatccaaccatccaacggtacccataccgcctcctaacccgcagcccgcatccacgccgtccatccggtctccactactccacccccggacccaccaacccaactccgccacccaccaaccgaaaatccccccacccccgaaaaaaaaagaaaagaaaagaaaaggagaaaaaaaaaaactcccgtgctcggctgcgttctactactagcctacccctatctctctctctctctctctctctctctcttctcgctagtcttcccccaaaaactccacccttccgcggcctcgcccatctcaccgccaccatctatcggctccctcctttctcgtctccaaactcaactctaattgagcgcgaaaacgtggacgcgtttgaattgggcgtctccctcggcttccaggaccttctagaaccttctcgaggctcccccggcctcgcgcggtcgcggctctgcctcccgctctctctcctagggttttccccctcctggtcgcgcggcgggggcggcggccatgggggacgccgcggcggcgtcgcccccggcttccctggggaagcggcggcgcaggggaggagcgggcggaggggacggcgaggggctgcggcgggtggcggagatcgtgatggtgctggccgccgctggggaggtgaggggtgggagggagccgacggccgcggagcgggcgctcgccgcggaggcgagggagaggctggctgcggtcgtcacggagggggcggtgcggcccaaggatctgttccccggggaggccgtgcgcgccctcgtcgaggatctcggcctcaacagggccagggatcccgccgccatggggttccgcccgcccaaggcttccatcgccgacaggctgatgctcactaagcgcaaggtttggtaactctcattcttttttc

SEQ ID NO: 30582 - DNA, 851 bp, Oryza sativa
ggcctggcatccaccgtacttgcgttcgcctctgcagcatgctggaggggtggtagcaggggcagaccgactgcaacactgtgtgcccgtgccaggggagagcatgcgcgtgcttctacagccacattccagtattcctggtggccggtgttgtcccttctactgctagccatcggggctgctgtccagcacaccaatatgcagaagaatcctcctaggggtggccgccgcgggtatttcttgacccactttagttcaactaaaatgaactaagtttcacttttagagagtctaaagtgaaatttagttcatttagtaggactagaatgggccaaagaatacccatgggtcaacccacacccatccctaaatccttatgcgaagcttagtgagaagtgaaggggagagagagcgagggtagttttgccacagattacggtaaagtgcctccaactcaagaaatggtaaaaaaactaaacaacacaaactttggatggtattaaagtgcaccactaattttcagcgatatactatttctgaagtcaggttcttctgatgccgcgaaaccaattctttccttatatgccactgtaaatttgctatgaaattacccatgttccccctcctttccttcttcaacctcatgggagttgattgcatggtggggtcatccatcagcgagatgttgcgaaggatagcgtcaatttcctgtggctgctacagctgtccagcgagatgtagtcatgtcagagcttgctgatattacaagtgactgcgtggttggatcttaatcaatctactccctccgttttacaatgtaagactttctagcattgcccacattcatatag

SEQ ID NO: 30583 - DNA, 3635 bp, Oryza sativa
tgcaggcatgcaagcttaagctaatgaggaaaggcgggcaattcactttatattccaacagtatcttctggttggggtaaattcatcaatttcttctgtttctggggttggagtggactcactggactggacttggtagaatgattttaaagtgctgctcctcttcatctagcaaatcaaaccaatttctaattgactaactgctaccaaatgcaaaataaacttgcaaaatcgatgagtagagaggacactgatcttgatttggggaaacgggaatcaaactttgtggagaagtggctgagaaagggggcgctcttgcctcaaaggctctgacccgccgtcaccaccttgccgccgatgcgtatgcgactgcgccggagccatggccgatcccctccctggctcgctgctgctgctgcccccctgcgcactgcctgctgctgatatgcgcctcccgtccgcggatgcgcgccgctgccccgccgacactagtgcttgtcgccgcccgccgccgtgccgccgtgcgcagtcgccagtcgccgtcggtgatgtggcagacaaggagaggcggagagctgagagcgtgagaagagaaagaacgcgaacagaaacagatgcggcgctcggtgatgcggtgtgatgcgcgagaaagaggaggtgggattagggttggcttctattgggctgtgatgggctggttgttgggctgatagatgtgggggctgaaacaggccatgtgtggggctgggctatagaatttgggaaaatctgaaaaatatgtaggtactagtccactaaattttttttcacaagtagggcttgggtccaagctgccctaggcccagttccgctcctgtatccactgattttgcgactcggatactattttatgcagattttactggaaaataaccaaacaattcatgatgtgcatcttattacattcttaggttgtgttcggcagtgcaggatgggaacctatccctcttgcacgcaaaacagagcggtctattatcacgtaattaattaaatattagctatttttttttgaaaaatggatcaatatgatttttaaagcaactttcgtatacaaaaattttgcgaaaaacacactgttaagtagtttgaaaagcgtgcgcgtggaaaacgagagaggtgggttgggaagatgaagtgccgaactcagccttaatctgcatatgaactgtctgggtttatcctttttaaaattttcttaattctttgttgatgggaaatgcagcaccttgatcgagaaggaattagcttttgctgtcgaactacatatgatgaaaacgctattactaatgctgttgagatattcaatactaccaggtaattgccttgttctgttataaagttcattagatgtgacctttttgaacttgcatctgtattaatactgttttatccccagtggtgctgttcacttcatggcatcgaataatgactctggtgtaagagactatgatatggagaggtttcagctctacaagcattttcagtttgaatggccagtgaatgtaagtcttttttgtttatttgtgacaccttgcttttggtaaacctactataattagggtatgcatgtatgattgtgtagacattcataatttcacattgccatagtttcgctttatgtggttctgtacttctttcttcatggtgtcgaataatgactcttcaagataaaaccttttgatttcctttttctcatgaaaacataattgtgcactgccttttaaatgtgttgttaacaaatagatccaacatcagtataacggagatcaaaaccaatggaatgctttggatgttttagtttctgtacctctggtctcacaattcattggtattttggtgatgcagcatacagcattgagtcctgacagaaagcttgctgttattgtgggggatgatcctaatggtttactaattgacgccaattcaggaaaggtatgccagcacacacgcaaacctgggcataaaacgtcacatatatatgataaccaagctgtgatagaaaattatgtgacattgaagtatggcatgcatgataactggttactttgtttccctgtgcagactcttcattccttgaaaggtcactttgattactcgtttgcatcagcttggagcccagatggcagaacatttgctactggcaaccaagataagacatgccggatttgggatgcgcggaatctctctaaatccctccatgttttgaggggtaaccttggagccataagatcaatccgcttcacgtcagatgggcagttcatgtcgatggcagaaccagcggactttgtccacgtcttcgatgtcgggagtgattacaccagaaggcaagagctggacttctttggtgagatatctggcatgtctttcagcccggacaccgacatgctttttgtcggtgtgtgggatagaacatacggcagcctcctccagtttggccgtctgtataatcactcgtatcttgactcgctgtgttgaggtgaggaacacaaagcagacgttgggcgcgctgtgcctcagctgtgcaccctgtgctgaatcttgtcatcatacattaggtatcccaaatcagaatttgaagtcgtttacccgataattcaattaataaaacttgtacccttctgtatgtgtatataaagaatgtacagagatgcctatagcctgtaccagggtagtgcgccaaatcatgtgttaggttgcagtgagaaatgtgatgtgaaccttaagatcgatgatgctgtaaccggaactgcatcatctgtctatctatcaaccgaagccaagtttcttggtgttttctgggtggaagctgtgcgcctgtgcctgtgctttgtgcttgccttcgcttcggatgtgatcgtgcaaaggttcattccttttagctggtttggctagagtggcggtatcttgtttatgttttgactatctgcgtgctattcgtattgcagtcttgtagtccatcagggagatctctccggatgagtaggccggaatgaattttattttttttaaagaaaatgtcgatacaatatgacaattagtcgtaaaatcggtatgcgccttatcttcgaatactccattaccattttaaaagatgacaatccaatatgacgccttctgttctccgaatacgtaattttccgttggaaaagaggtaaacccaaaccaaaaacagattatccgattcgaagtttcgaactcgccactacgtatccgaatccgaatacgattagaacgatcgtcatctctactatataacgatgtctccccgtggatctcatgaacccccgatctctctctctcaagccacaccgagtagcacgtacgactgcacgaagcggcagagaggctagggccgacgtgcattacgcaagtgctcgcgaggtggcaacaatgaccagcgaatcgccggccatggcgacggcgccggtgccggagccggagccgcagccggagctgtccacggcggcggccagacggcaggatgaggagcggaagacagcgctcaggatcatccgcaacgagctgaggctgctctggcgtgacccgccggcgtacttgcggcccgggccggagcccgtgacggaccccttccactg

SEQ ID NO: 30584 - DNA, 6352 bp, Oryza sativa
  unsure (1)..(6352): unsure at all n locations
agggcgaattcgagctcggtacccaccccttccactgggaggtggtcatcgacggccccgccggcaccccctacgccggcggcacgttccccgtcgacatccagctccccgccgccggctaccccttcgtccaccccaaggtcaccttcaagactctggtaagcgcacgctcgtctgcatctctgcttgttcctccgatccgttttgcgtgatgcaaatgtcttaaaacctcatctgttatatggtttaaattgcataaaattataaaggttttgacgtaaggcacgtaaccccgtatattattattctgaagtttcacgaaaccacggtattgatcattttaactttgatctaccacactttttaattctacaattacatctcaaatttataaggattttatccattgtataattgttacacctggctttttaaaattttaatatagaagtatgtcaaaatggttaactatgtgattttataaaactttaaaaacatagtattttgggtttatgtgtcatgtgtcaaaatgtttatggttttgtgtaacttggacgatgataattgggttttagttttacgaaacttgctctttcaaaaaaaattgcatggatcgaatttgagtgcttgtctctgcaaccgcaggtataccatcccaacatcgacgaggaagggaacatggtgctggacgccgagagctggagctgcgccaccaagctccgcggcctcctcatcggcttcgtctccgtgctctacgacccgctgctcgactacccgatcaactacgacatcgccgagcagtacgcgtacgactacgagcggtacgaggcggaggccagggcgtggacgcgggagttttcctcggcgcccgtcgtctcgcactacccgcccaacgccgtcgtcggcaggacgccgccggccgttcctcacttcccggcgacggcagccaggagaagagcggaagcggaagctaggaaaagagctgctgccgctgctgcatcttcaggttcaggtgagagcctgtggaggagggtaattgggtatattcagagctggtctccttaccggctacttcatacagactagctgaacaaactcgaggaaaattctgtgtagaatggtttatatgtttactgtattgagacttgagaggtatatatatatacctctaatgtggctgtaaagaatttgtacgtgattagtacaggaaggctgtgctgacgagagtttgtctgagcgactggtattgttcgatgagttggcatctttaagactttaggtctatattgagacttctagaattcacaagtcagaacattatagtgataaggaaatgttgattgtttggctccaaattagtccgtggggaaataagcaaacccttctctcgagaaaagaaaactggtgtaacccgtctccacattttttttccttctctctttggcacacggaaggccatgctcctcatgttttacaaattacgtccaagactttggctatgttttaaagtgattctcggattggctactccctcatttcttgttagttgcgagcatgtttcctgaatgttaaatggtgtaatttttttacacttgaggtatagaaccatgcacaaatagtttgtcttggggagtacgcattttccattgaagaggcctatgtgttggtctgttggagccgacgatgttttcaatcacaactaaaccgagaatatagaggatatggtaagcccaaaaagaggtcagttcttgaatggaggaggtaccatatgctagccatccattccacttaatctaatggcctgggaaggcttggtacttggcgctggcggtactgcatctctcgaaaaagcaggtttcgaatgctgttgatggtgggatgacaaatttgtactttcgcattcaggtaccaagtcggagcagaacaccgtcaccatttcttcgctgcagtcatctactcatcgcatcctcaaatcgaacaaaaattgtagaggcgaacatggtgacgagcctgacgcaactgatgtggcggtctcccgggcagcattgaccttgggggatgtgggccgatggggaacgctggcgatttcggggtacccccgttgacgctctcgtttcctccctcctcctggttcgatcatgacgacagtttttttcattaatatctaattagacttataaatgactaattagggatagggattcgaggtggggctaacacccaacgagccccaacagtggatccgccaatgatagtacgtggagaagggtagtcaagtatactcaaagctggtctcctaccgtttgctgcgtagagactagcataacaacacatggaaaaattgtctttatattttcttttggtatatatagtgccaattatggcataaatacacctccaatgtactggtttagtgttttttcttatattttaatatagggccatgtttggtgcggctctatatatatcccaaacctattgatagatttgaattttgtatgttaaattatagtggattaaaaaaagtttgggatgatatgtaagcacctctaagttagaagaagaggacggcgggatctggcagctcgaggcatatctttctgccctcttgcaccccgccgtatgtacgttcactgcaatcatcggtctttggtagaactctaccgcaatcatcggtctttggtagaactcaagcccatcggatctgggacgtcagcatgaaggaaggcaaagggtggcgaggaggaccaccagcaatggtgagaagaggaagacggtagcaacgacgacacccctcaacctcgagagcacactgcacacacaccttgcctcgacacctctaactgggtgtcgctgcacccgctcggcccgcacccgcacatgggccgggcctggtggagtagctccgacctggctcggaggtgcaatttgcacgcgccgatcctggctcgctcgtccactgtcacgaaccaacacaatcacaccaaatctctcacacaaatgccaccgatatattgcaatccactaagaatacaagtgtttagggatacaaaattgaggagaaagagaggtatagtttgggaagagagatcagacaagaggaagcaggagattgggactagagaataggaattgagaggggaagcagcaccaaggaggaagaagctgtcgcctgaggcgttctggtaattgattcatcgatgaccctagctgctggctgctttgcctcttttctagtctccttctccctagctgaatgggcccaaagccagcccacttgtctagcctcctggaaggacatcacaacagcccatgtacatgacattcttcccccgttaagaatcggcttgtccccaagccgatgcaactgactcgccagattaatgcccccaagatcctagggtacctgcagggaaatgtcttgttgggcagaatcccagaacaattgtttgatgaccttcgaaccatctgatgtagaccctgcccactgttgaatccacttatccagcatacataaaacctgagcattacaaccacactctctaccatgcttttgctgcctcaaccaccaagccttcacgccttcttcaccactactatcagcatatactccatgagagcctagatgtaacatgcaaatattgagatcagtggactgagaaacatgcatatgcttctttgtctgaatgagagctacttctttgtttgcaaactcccagattgctaaaaattgtatggttttaccttgatcaccaaccaatcttgcagcaactaatttaaccactcgataggcccatgtgtgcaagactatgttgtcctcacaaactaaacaaatgaggcatctctctgaacatttaaccagttctattccacgagaattcttactgaaagtgctagcttccaaactgagatggactgcaccaagttttagctgctccctttgtaacaatagctcatgtgtctgcccatgttgattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttacaagttgaccaactttcttgttgaaaccctaaatgcctcaccattgtttgatccgaattgagtccaagaagtatcatctagtacatcattgttgttactctgaacctgaaatgaaattggaatagtgtagcactgagcatggcgatgggtacgtctctcatgtgacttgcaagtgcaattaccatcaacattagctccactgaacaaacaatcacaccatgcatcgggtgatggatgggaaatcagcatgagcagcaagaacaattcatgatccccatatgcccaaccataggttgaatgatgtgtgtgttgataggccttcctaaaggcaccagagagacatatctcataccaaatacactatccaacaatcagattttgcagcaagccctcagtggaattaattgttctactcatgaattgggcaacgctgtagttcaaggagacttgatgagactcaccatataaattcagtgtttcaatttcagtttgaacacttgtttgaataagtggcggccagggttgtaagagctttaccaccatgcctccgctgccttgacaaagctgtggatcaggccatggtaaaggccgagaacctgaggtcatctcagctttgttccatggaattgctgctctccaaggtggtactggtggagggctagctgtgtattctgagctccggtcaaagcaaccatagagtacttgcaatttcaatgaaacgaaagagaggcagacaactccaaagtagtcacggctcaagcaccaactccagttcctgggaggaattgcattgatgattaacaatggatctctgaagcataaatacatagtggtgaacttggtatccacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcactcaacgctgccacatctctagtggaatccttgctcaaggataaatccaccttggtgtggcgaaatgcctccagcatccgatcgatcttggtgcacaggtcttgtctaagttctccaccgccttgtccatgtcagtctcagccttcttggtctcgttgaaaggaaccgatgtcaccatggctgctgatgtaattgagggtacagatgaagctgttgtagcagggaacacgcgttctagtgcagcagcaatactcttggccgctggcctggcggtggcgctacttggtaccattgtcaaacaggtggtgtgcgtggcggtggcgccatctccagggaacatctagacgtgctgcacatccagtaagcagcccccatcgtagatgtcgcgaccgtgggtggcggaccgagccctctccgcgtcatggctggacataaatgacacaagagccttgacttgccatgtgctcactgcaagaacctgcaccgccactgctccataggtatcgtacacttgatgcaacacctcatatgtcactggatatatgatctggctcacggtgacgtgaaggacagcagctgagtcgcctcttggacaggacgatatttcatcgaacaggtggtgggcatctcctccaaagacaccaccaccaagttgctggcagttcctctgaccaccagcgctctcccacttcatctccacaccagaaaccccacgaatcgactactctgataccatattgtcacgaaccaacacaatcacaccaaatctctcacacaaatgccaccgatatattgcaatccactcaagaatataagtgtttagggatacaaaattgaggagaaagagaggtatagtctgggaagagagattagacaagaggaagcaggagattgggactagagaataggaattgagaggggaagcagcagcaaggaggaagaagctatcgcctgaggcgttctggtaattgattcatggggaaaatccaaatacccccctacaagtcactgctctttctactctccccccacaactcaatattgttcaaaacactacannnnnnnnnnnnnnnnnnnnnnnnnnnnnnnnnnnn

SEQ ID NO: 30585 - DNA, 2014 bp, Oryza sativa
acaaaattgaggagaaagagaggtatagtctgggaagagagattagacaagaggaagcaggagattgggactagagaatagcaattgagaggggaagcagcagcaaggaggaagaagctatcgcctgaggcgttctggtaattgattcatggggaaaatccaaatccccccttacaagtcactgctctttatactctccccccacaactcaatattgttcaaaacactacacataaattaatttctcttccaattttccacccctattcggttttcacgctttctcgtgatgcgctcaatttctcgttatcgtgggcctacagcgcagcccgcgggtagagttgcctcgtgccacattggcggcaaaagcgcgcgcaccttcttccactttccatctttccctgctttaatttcgcgatcgctactgcaacactaaggcagcgaaagaacagcggtacaacggcgaagtacgacgatgatcgcatagtacagagagaagggatatcaaatctcctgcccggcaagagaagtcgtagaaggaagcactgaagcatcctgtacttcgatcacctcgtcaattcattctacaggttccttttttctccctggttttggtcggatcatgttttatgcatgtaattgttgtattactagattcagataatcgaatatttgctctttgatttaggttgcaaaccaataaattggtataatctctgcagatgggtcgaactagtatttccttcattgttcaaactggttgtacaactggtggaagccctaggaaatctggtgggaaaaggaattgttcatcgatctatcttttagacagggattctctgaaattcatcgatttgaaggagtcattgcttatacatggatatcaaaaaggagatggtgtatactacttgaagccttcttatgtccctccacaaggtcttgtactgattttaaatgatgaacaaatcaagatgatgttggatgatcataagacggaaacagagtgctcactgtacatttttgcgaggccgcaggaattagtgactgataatggaagcacatcaaggtttttaagcccaagtagtatcccattaatcggacatcataatagtgtcccaggtgattttgataaagatgatttgacattgcatgaagagtatgtacagcaacagttgagggaaaagaaaaaaggcaaggaacctgctattggcaaggagccagtaatgttcttccaaggagactctgatactgaggacctatatggtactagccagatagatgcagaggttaaccaagcagaaccacatccgggaaaaactacacaggaaaaagaactagtagggaaaaaaactaacaagagaaaagtgaaggatataggccaatcagctgaggtggattatttgtcagatgagcccaatgatgacacaatagatttcaatgacgaagcacctatctatgtgcacagatcaagaggaattgaagatatcattttttatgagtccaccctacggcgtccacacatgcaagttggcatgttgttcagtaatgttgatcttttcagagctgctttgaagaatatgatcatcaacgaggggagggaggtgttcaagggcaagaatgataggaatcaagtttctgtcaagtgtaaggcagataattgtccttggtacatatatgcttcaaaattgcctggtgaagacacctttaaaataaaaaagtatgtttcaaaacataactgtgggaaatcacacaatatagcacagctttactggagatggcttactaatgaatacatggaattctttagatctgacaagaaatgggatgcacatgcctttcaagattgtgtcaggcgagataccaatgtagaagtcagcataagtaaggcatatagggcaaggagggaggcctacaagaaagttatgggcgatcatgatttgcagtttaaaagaattcaagattatgctcatgctgtgctatctgctaatccgggaagtaaagtttttgttaagtg

SEQ ID NO: 30586 - DNA, 32472 bp, Oryza sativa
  unsure (1)..(32472): unsure at all n locations
nnnnnnnnnnnnnnnnnnnnnnnnnnnnnnnnnnnnnnnnnnnnnnnnnnnnnnnnnnataggaatcaagtttctgtcaagtgtaaggcagataattgtccttggtacatatatgcttcaaaattgcctggtgaagacacctttaaaataaaaaagtatgtttcaaaacataactgtgggaaatcacacaatatagcacagctttactggagatggcttactaatgaatacatggaattctttagatctgacaagaaatgggatgcacatgcctttcaagattgtgtcaggcgagataccaatgtagaagtcagcataagtaaggcatatagggcaaggagggaggcctacaagaaagttatgggcgatcatgatttgcagtttaaaagaattcaagattatgctcatgctgtgctatctgctaatccgggaagtaaagtttttgttaagtgcgaagtatcacctgagccagaaataaggcctaggtttcaaaggctgttcttgtcatttcatgcttaaattactggcttcttaggtggttgtagacccttcatcggtatagatggatgtcacatcaaacccaacaatggttctcaaatactaacagcacaaggcagggatgccaacaataatcttttccctattgcctttgcagtagtggagtctgagtgcacagaatcttggacatggttcttactatgtttggagaaggccattggaaaaggagaagagtttgggggctgggtattcatgtcagatagacaaaaggtaatggctatcatatatgtctactttgcattaatacatgtcaactgtttttttaacattttgctgccatatatagggactactcaaggcagtggctgaagttttcccaggagctgagcaccgttactgccttaggcacctacatgccaatttttcccaagcaggatttagaggggaatatctgaagggtttgatggaacgagcagcatatgcatatagacaatctgagttcaatgctgctatgcaagaactaaaggttaacaatttgagtgcatgggagtggctaagcaaggttccaaccaagcattggtgtagatatatgttcagttctagagcaaagacagatcttcttcttaacaacataagtgaaacatacaattcaaagatactgggagctagagatgaacccataattaccatggttgagcacataaggataaaaatgatgggtgatttcaataataagagggaaggtgcaaaaagggacaattggcaaatcccaccaaatatattaaagaagcttgaggcagagaagagcgaggcaagatattgcaaatctgtgtgtgctggtaggggcatttggcaagtgtccgcatttggtaatcaatatgtagtggatttgaacaagcacacttgtgggtgtagaaaatgggatttaactggaatcccatgtttgcatgctgtttcagctattcaaggtttcaagcaaaggccagagagctatgttgatgacatattgacaaaggatgcatatgcgaggacatattgtgggatgatttatcccgttcctgatgagacacaatgggaaaaaactccatttccagatgtagacccacctgtggctaggacacaaccagggaggccaaaaacaaagagaactagagcatctgatgaacctagggttcaaggaaggtcggttgcaaagacaacaattagatgtagcgtctgcaaagagtttggtcataacagcagaaagcatggaaaagacaaccatagttcttcatctcaaaatgtgagtacactactaatttatcatataaagacattgtactttgctacttctcacaatttgttgtctgtttctctcggtgtaaaacacaaataactaggaggaagaagaggagcaattcccagcctattagttctagttcaagagatgatattccaacaacatccacacagccaccagtatatatggacaatgcatttggtgttggtctctaccatcatgtgccagatggggcttatatcggtcctactggaagaaagctgcaaattagaagaaaatgatctcctatttttatgcagtggtattatttacatcaaaattcttagctacaattagtgggggatgttgatcccttcttaatctcagtactatcttttttacgacaaataattttctgtacttctaactatcagatttgaattgtgatttttaaggggattctacttcaataagcatgtcttaaatattctggaatgtgtttttgacttggtgtttccattcttcatattgatgtggaatcacgaatcatgaggcagacactgttgttttgcactggtggactagaaattgttttcctgttttatattagcgtcatgtcgtcctacccgtatggctcgcggaattaagagtggatggagatgcgcgcggttttgccgccaaggtggcacaaggaaacttcgctcatgggctgagctaaaggcccacgataacgagaaattgagcgcatcagagaaagcgtgaaaaccgaatagggtgggaaattggaagagaaattaacttatgtgtagtgttttgaacaatattgagttgtaggggggagagtagaaagagcagtgacttgtaggggggtatttggattttccccttgattcatcgatgaccctggctgctggctgctttgcctcttttctagtctccttctccctagccgaatgggcccaaagctagcccacttgtctagccttctggaaggacatcacagcagcccatgtacatgacatccacccaggaccaggtgcgtgcatgcccagcccaatatatgcctcgagccacacaagtctatcgtaccagccttcctatttatcttgcacgaggcggcagggaggttagggctttttctacttctatacatgacagtgatcatcgacgagccgccgccggccccggcgccgccgcacccgaagcaatccaccacggcgcgcaaatggtggatgaaggcggatccacggaaggccgcgcagcgccgtatctcccgcgagctggaggatctctggctcgacccgccggcgtactgccgccccggccctgaacccgtgacggacctcttgcactgggaggtgatcatagacggcccgcccggcaccccctacgccggcggcacgttccccgtcgacgtctggtaccccaacgagtaccccttccaacccccgaagctcaccttcaagaccaaggtaaaatcactcgcccaatctctgagtagatcactagcttgtgttcatcgccagatatcccaattgatgcttcaatctcgtacgtacgaatgcaattcgatcgctgcaggtgtaccatccgaacatagacgacgaggggcagatggtggtggacgtgcttcacggctcctgggcttcgtctccatcctctacgacccgctgctcgactacccgatcaacgacgacatcgcggagcagtacgagaacgagtacgagctgtacgagaaggaggcgagggaatggacgcgcaggtactcctccacgcccatcgcctcgcactggctacccaaggctatgaggacgccgccggccgttcctcacattccggcaaccgcagagagaagagaagaaagcaggtcgctgcatctaaggcttcttcttcttcgctaaatcaactgcggcggcggaagaagaaatccatcgaggatgagagtttgtggaagaggatggtagggaggatagtagggtttcttcagggctggtggtctcctaattaccgtctactgtgttggtgatagtacaagtattgggaggcatgtaaactagtagtgtcaattatgagttacttcatccgtttcataatttaagtttttctagcatttctcatattcatatatatgttaataaatctagatatatatgtgtctatagattcattaacatctatataaatataagcaatgatagaaagtcttacattgtgaaacggatgtatatatacctcgaatgtgctggtatatacgcaagttacctcacctagctagacggctcgtcgattagattcatggttatatatagctgattccattaattgttcgggtgtgtcacttacagataagtgttagtgtgtgtgacattatgttgaaatcattcagcatgacgccttcgatcatcatggcattgcagtcattttttttaaataattaatatacaatatttttagtagaaatttaaatagcaccccaaccagcaatctaaagactaccttcgtttttttattaaatgacgcatttcactttttcataatgttgggtcattcactctacttaaaaaaatagtgtaaatatgctaaaatatatatcatacttaaaatttatttaatagtaaaacatgtacaacaaaataaatgatatttgcataattttttaataggacaaatggttaaacgtcatgttaaaaatcaatgacatcatctactaaaaacatagttgtattgttgacaaaatattgcccacaggatgcaattgtcacaaccaattgaaatccgataatacatttttagtgttctattaaataacattatttcttccccaaaaaaataacattatttcaaataattttgttgcaatcaacatatcaaaaattcaaaactacatattcagccctaattaagctcccaacctatgaaaatgagttaacaataatataaatattacaatcatgcatagaatggtattattttattctgtaaataactatgagatgggcattggggttgatttttgcgggtaatgtttttttcgcgggtaatatttgactcgctctttttcttagataatagaaatgtattataccctcggtttctattatatagcacacagctagctaacaagctttttaactcatgaactgaataaaaaaaacaaatagatgataaaacaaatccctaattaccataaaaagataaccttgatagacttaaggtaaattttgctatatgacatcgcgacttcgtggttttaataccatatagattacaacaagtaagcctatatatatcatatcactcatagtggaataagatatactccctccgtcctaaaatataaatatttttagcatagtgacaagtcaaacattttcaattttgactatatattaatagcaaaaaaataaaaaagatcactcatgtaaaattgatgttactagatatatcattaaacaaactatcataatatataaccatttttatttaaaacatattacttttatagctattgttggtcaaagtagcatatcagagacggtaccataatctaaaaatgtttatattttagtactatgggagtttttggttatcaactttacaagtgtagcatcattacacaataatattaattgaactaacacgggtcaacgattacgagagaagtccactcatgttcatccctaaagaatagccaatataagtgacctggcgccgtgtggtctactgctttattgacgtgctgcattttccattttaacaagatcggcggccgttacacggagccaaaattgttcatggggagcatagaaacgaagtgatgcaaaacacaccgctaagcccaacaataaaccggaatatccgctccaaactctcctaaacctccccgcggtacttatcaaccccaagatcgcctctctctctctctctctctctctctctctctctctcaccacaccgagtttccatcctgcccgtcaggcgctaggccgctagggccggcgtgcaatacatacgtggtagtagtagtaacaatgggcagcgagctgccggccgcggcgccgccgcagccgaagcgatccaccgcggcggcggcggtcgcgcgcagacggatagggcgcgagctgtggcagttctggctcgatccgccgccgtactgccggcccgggccatcccccgtgaaggaccacttccactgggaggtggtcatcgatggccccgccgccaccccctacgccggcggcgtgttccccgtcgacgtctggttcccctacgattaccccttccgtccccccaagctcttcttcaagaccaaggtaatcgcttgcgtaatctacgcgttcctcgatctgtcgcgtgatccaagattgctcatgttcatcgccagttctcgctaatttgttttgctacctttcaatctcatgaacaggtgtaccatccgaacattgacgggaaggggaggatggcgctggacatcttccaggacaactggtcaccggccttgacgatcaacaaactcctcttgtgcttcgtctccgtcctcttcgaccccctgctcgaccgcccgaccaaccgctgcatcgccaagcagtacaagcacgagtacgaggcgtacgaggagaaggccagggcttggacgcagaagcactcctcgacgccgatcgtctcgcactacccaccgtacgctgtcatcggcagcacgccgccggctgttcctcacttcccagcgactgcagccaggagaaaggctgctgcatcttcagcttcaggttcagtaagcagcagccgcattccgttgcttatgaaggatgagagtatctggagaaggacaatgaagttttttcagggttagtcttcttaattatcgtctacgtactgcacagacactgaaaacagataagggaaattagagttctttcttcctcacagatgaaatatgttatatctagaattttattttactgtattgtgaattgttgagaggtatgcatacttgtatcaaatcttcaggttatgatctgtcaccacacggtaatgacatggagctgctgactatgaggagtgataaacaaagtccttatttatctttttagtctgatgtgcagcacttaactttccactctgtttctgatgtgcaatctttttgcttgttcgcgaaacttttcattctgttttgtaaataagtgttgatatatatgtgagcactggagccagtgtgatctgtgagactgtgacgcattatgtcgaaaccattcagtatgccgttgttttggtggtgcgcctcgagccatatatatcccacaaggaatgaatcaaaattttagaaaatatgttagttccaggaaaagctttgctttgcttttgagataaccaagtgaaatggctatccaaattacttcagtaatgtgtacattgtactgttggaggttacctcatcagccatttagatgctatcagctttccgactttagatgaccatgtgtacgagcacttcctaaactaagagagattgagccgacaataattaagttaattgtcagcatgagttggtggtgactaagttatgagaagaaagttataaaagggacgaggaaagatacaaaacgtcaagcgaactactagatatagtcatatcaatctacgagatatacagtcatataccagctcaattactaggaatctaatggcgcagcatcacaaacaaacaatcctgaaaagtatcgtgaaccactttgggatccactagcggaccgagagacaccgagtgtttttggcacgcttcttcatgctagcatacacttatcgagctgttgctaaacttttcttgctcggagtggtagcaatgtattgtagcataacactaacacgtgttgtagacatctgtttgtaccgtgttttcttatttaaaaaaagttgcagcgcgtagtgtatgttagtatgtactacatccgtcccaaaataagtgtagccgtgggaatccgtgtctaacgtttgactgtccgtcttatttaaaaaagttataaaaaaatttaaaaaaagttagtcgcgcataaagttctatttatgttttattatctaataataataaaaatattaattattaaaaattttcaaataagacgaacgatcaaatattgaacgtgaatagtgtaaaacttattttgggatggagagagcagtgctatgagttcatgcaaaggcgcagcacgggcgcacggccctgtactccaggcctccggggcatggcagccggggtaaccggcccacctgcggttgcaacgtcaaacggcccacgcgacgcgagcgatgcgccgcacccaccgccgcgacacaaacactcgtgggctacgcacgcgtggccgcgcgagcgaaagagctatatagcccacgggctttacgcccgcgcagccacccacccggccgaggccgtcgttggctcgttgccgcgtagcgagcggcagcgacgccgtgagacccgtagtccccaccacacagccccaatccggcgaggaaaggaaaaccacatgtgtgtcgtgccaccgcgccaagcaaaacggtaagcgcgcggtccgattcgggcgcgcgtatgtcgcccacgcgtgtgctcctgtgctactgcaagcaaaaccgccaaataaatgcatgcccatgtaaacgaaacgtacaaacagtcacgcgaaggaaattgacacacacatacgcacacctcacacgtccatgtcgaggaaacgtgtcacgccagaacacgtcgacgtcgatacgctatagcgcagagggcacagtgcgcacatcacccgaccgggcccccaaaatcacatcaaagcccaatcctccgaaagtctaacctccacacgcaacaatgaagcttcttgtcaacaagcgcgtccgcgtctgcgtctccctctttggcgcttcgataggacacgcagcacggcgcacccccaccctccttgtacgcgcgatcgaattcgattggcgcctctcggctttttttttcccagatagcccgcacacacacacacctggttggatggaggctggcacgacggccactcgcaccggaaaatgtatgcatatgcatgcgtgccatggcgtgccgcgtcgggtggatggcgacgtgttaccggtggacgacgacgacgactcgggtgatggatacgtagccggaaaaggatcagattatcaatcgatccaacatgctcggatcgatgcagagtaccagccggtgtacgtgctttaatgaagtccaagttattagccgtcgcccggccggcggtcgatcagcaccaggtttgtttcttttagccaacgttcaaaaactgttgctgagtaactgaccattagagcagatacaatagcagactataagccagttataaatatattttaaagagataaaagaaaagagagaatagcagcaggctatagatttgtagccagctgcagcatggacttcaagatataacgtgtgtatgataagtgggaccagatattaatagtgtagtaaacaactattatatgaattggctattacattggttatacataatttaaagttagtagttggctatactattaaagttgctcttacaactccgagtataccgatgaatgtcttgcagtacttgcctgctttcagaacgtgtcaaaatactccatttggcatccattcgtgttcgtcaaaaagtagaaattaatgtagagagaatcagaccagctagggaggagtagaaccatgcttcgacgtaagaacaaaatggtttgcattggcatgcatgcctcgccatcgtcgccgggcgtcttagcccatcccgtatcttttcgcccatcgtcataacgcgcggtatacgtacttgactatacttgtgccgttgtgcggttgcgctttctgtgttgccattattgaagactgaagagagtgcaacactccagcgactaaagcctctctcactctctttattctcgtcgtaacaaccagtgcaacttgttcggcttatggatgtccaatcatacatttgcaaaagtatctgaaaattcagatagcaggaatatatatatttctttggagtatataaaccaacttgatttcattgtccaaagtactcacacacgaatacaggcttacagttttggagctcttgtacttactaaagaagaagctacaaacgcagcacacacacacccattaatttacatttacagagtaaacatttcggccagtacttgccaaagaattactacatgacaagctatatatgtcacctctactggatttgtgtagtgtatcatatttggagttctgctgttccactttcaaatactctgtaccccctggcctcgacaacataaattaattaacattacgctaatattgtttttgagttgtgttttcttatctaagcgctagagcaaacacctttaccaattcgtttttatctaccttgtgatatgttcatccccatgcttatgtaacagcttgtgtggttgaattgatgaatggcgtgctagctagtatagccaatagcaaatggattgcccattaatttacccaagtatccatgcggaccatgcctgggtgcgcgttcggcggcgctctcggcgttctcagctgcagccgccggcggcgaacccgatcctgctgctcttgacgtcgtagacgacgctgaacgtctgctgctgcgtgttcccgatgatggcggcgctcctggccggcgcgaacgccaggcacgtggtggagtcgtcgacgtcgacgaggaggttctgcgccgacagcttgagcgccgcgccgccggcgaaggacatggtgaccgccggcgcgctcacccgcgaggcctggcccttgaagcacgtgtcgaggatggagtacgccgacgcgcgggacgtccccttcatggccgccgccaccgccttgctcagcgccgagtacacgctcgtcggcaggcgcgtgatcaccgtgccggagtcgatgatcgtcggcaggcttgagtacgccgacgacgacacggacagcgggatcccggcgaccgtcatcccggacagcttgatgaagtagagcgagtcgtcgagcgagcttgacaccatcggcgtgtacgagtattgccccgggttgtacgacccgagcgacaggtaccccgattattattacgacgggaggcagtatgtgaaggagtatccaaggcttggcgcgagctggtacaagaacgagagcttgttgcgggcgaggccgatgagcccggcggatctgccgaacaacccctcgttgtcctggccacaagcgtattaaaagtttggcagtgacgtctaaccgaacgagacggtgtccttgctgaggtagcccacggaaaaggaactgtcgccgtagctggcctggtaaatgcaaaacgtggaagaggagcaagcccaccggttgagcgtggcggaggggaggtctctgcactgctgcgcggagcaccccacggaggcgtaggtgctcgacgacttggggttgaacaccgggccggactgccggtggcacgacacgaggcacggcgagcactgcagccaggtgagcgaggagcccgtgtccacgaccatcacgtactgcgtcgccggcgtgccgaggcccatgcgcgtcacgtagttgcccacgcccacggacgcgccggggctgagcggcacggacgcgagggagccggcgaggccggcgtcggcgtcggcgtccagggaggtggcgcgcgccgacggcgtcttggcgaggcgcgccgccagcgacgagatgcgcgcatcgtcgtgggtgagcacccccgtgaacgggaggtcggccgggaccggcgccggcgagcaggggctccgcgggtggtgcagctcaaggtgcaggcccgtgctgttcaggtactggaaatctgcacaaaattcaccggcacgtccttaattcgcccgcgtcaattcatccaatttttaccgcaaccatgacaaaaaaaaactactttaaaattagagattctaaacaaattctgccgcggctataaggccatttgcaattaatgggaggtgtcatttttatgttttcaaataagccacataaacaacaatgcatttaattgatgattgaaaatacactatactccctccggtttcattttatttgacggtttggacaatgacacggtttacaaaatatatatttgaccttatattttctattataatatacacaataaataaatgcatgtttacttttattatagtgttttgaaagacaaatctacgtatgttctttaaactaaatatttttaaagttgttgatagtcaaagttataaaagtttgacatcaatcttatccaaaacattaattattatatagaaccggagggagtagctcgttaaacatggccatcagttccgttgcgccatcttgtcgtcaattttttacagtagtagccgtcttgtgactggacagtgacgtataacgagacgtacggacattatacaactagggagaagtactgggcatcagattgtataaatgtcccagctcatatgatttccgttcccaatcgagtgtggatatgtcatcacatgatccaattgtccaaacaatcatgcaacaataattcatttatttatgttacagataaggagtgtcgatcatatatatgacttgcagctgtgttgcgtgctactggggaatatataaatgtacgaacagcgtacaacccgggcacgtacccaagattgcggtcacgtatcgatcaagcattcaagctcttattgatggtaggatttgcagttggcattatctggtcataaccatattaaatcccaagacaacgctggatcgctgtaggtggtagataggctagctagttaaccagcatagtcattgtgaaattgagtgaaatattctcggtagaaggcccacgcatggaatagtagtctcagttaatttccagtgtttgtgaactagtgcaaaatggaagattctactttggcattgcttagacaatctaagagcttggacgtgctaacattagtccaacaagagaggaaacacgtcaaaaagggactgaagttgatgcatttggttggtagttaacatgatacacaagataatggagtgattgtctgatgtctataacgaggaccacaaattaacacaacacccagtcttggtgcctaagtacagaacacctacaaagcatatggtaccttgccttcccccctctattatgacgagcaaccaaagatattttttctcaagtgggaacaaccaggattgtactgctgctttggatgactggagaactaaccacttctgaagaagccagggggcgttggactggaccatcacgtacaacagtagtactacttccatatcaaaatatagcaatgtaacgtatcctagtgtctcatcatatattaagctgttatacttattttgatacggtgagagtacaatccagaggtggcccagctaactaggcaaactatttacagcagcaccgagtttctgttgagcgtgcctacatgcagccgtaatatcatcgatcggtgctggatgattcaagtcatggcaaaagaaaaagttgccaaaaaggaagccatttgcaatggcattgaaaaaccccacgtatcggtgacgttttctagccgatcgatccggtgcccatctcggcggccatcctgtccggcgcatttgtggtcgcgcgcggcgcatgataggctgatagatatggtggtttggcatcggtggtttcacgggggagaggcgaagtatggctaccgttagagcttcacatcatggccttccatgacagcagtcaatcgaaccactaaccggccatcaatttcgactgagaccatatataaattgcgatggctcagtgaacagtgtaccgtgtacggccttcgattgaaggctggctttggtcgtattggaaagagacaagtctctccaaagtattgttctctggtattggtcatcactgacatataaactcgctgaatgtgaagtccacatattatatctacttaaagtcagaacaggatgctatcgagaggactcaataggaagagttttttttttcttaggaaaatatgccatcttggacggagtttttgccgctaataatggatttgtacaaaaaaaattgtcggtcaggacaaagcattggaaaaacgcttgtgtggtgataagatcgatcgctgcacctgcgtgccgcccggcaacaattagccgtcgacaaaagtgtgtacctaacaaaactcttttcttctggtggcgacggatcattgactgtcctgtatattttaattcaaggcggcgaaaagagttggaaaagaagagaaatgatcgagccgaaaagattcgattttggttgtcatttggctcccaccctcgctgtcatttcttcatttttttcttaagttagttatagtatcgacaaagaaaattcagacttcccctgaaaatgttttcaggggaaggatactacatgaccaatacaaatttgtggttacactaccaccatatttacgtccattcaccatgttgattctagttgtactagtttaaccgaggtgctaaaacaagcaaagactccaggctagaaaaaaggaagtggtgcctcaagctgatgtgatgctattttgactgcaaactgaaattggttcttcaaatcctacttataggtgctttaattggtactcttgctctttcagtctttctactcaattggctagcgctatgtaaactcagtagtaagctgtactgttatggatatgtcaacaaagcacatatctttcatctacttgcagaaaccagacataattaacagcatgaatcaagagaaagctaactaattaagacaaggaggattattgatacccttgatctgtgacgagcacacatcggtgatgtccctgataggggtcgccactgcgaagagcagggagaaggcaagcaggtgaagaagatgcagcgccatcttatctctaaactctgaaaccacctccgtcttgcaggtggttcagtggtgcgtatgagtttatgactacaagctcagcctttttatagagattccgagtgagctatagcgcgcgctagctcttcgggcttcgtgggaatctcacgagtagctttcagttcagttgctgaagtaatctttttatccatggcgttccaagctagcttccaaccacctggttactgaaataactaacgtacgtttcagtactacgactagtacctccgtgatcaaaatcatcaaagatcttttttgacgtggatgatcaccgtagatatatatatatatatatatatatatatatatatatttcaattgaaagtcctcgttatcgacataattatgatggcataaatcaacagttcaagtagtatagtctttctcagtttatttcctgtttcatatttttgccttcttttggttctaattcggaagcttctgatgtcgcttgtgctgctactgtatcgttgccctcaataacaagaatctttagttaatcatgctgtaatgggacggtgatgcaaaagctgcttagctgcttttgttcctacggctcaaagtaagtaaggttaggtgcacacaattatggattcggctaatcaggctcaattaagctggcagttaagcgcacctatctagcaaaaatgcagtatgagccctctactgatgaacacatctgtccatcaagcaacatcgatcagtattagcgtcgacactaaggtagttttcagggcaccacattgactccggtattagacacaactacaaaagtgtgagaaagatgacgagcttttaaaggctgcatgccatattcttgagacaggttatccaactttttgtcaattttggacagaggttcacaaacagaattcaataattttgtactctttatcttaggttagcagtctttagtttgtttgtttttgatgattggtttcgtctttttaagtttctttgaacttcactcattttgagtgtgaggttataataattggctgtagctctttgagcaaaggctgggatgctctattccattatctaaaaaaaattagcatccacacctatagacatagtagctagtgcctggctttttcatctaagtccttttaaaaaacttatttattttataaataaatccaaaaaaatagacctttttcttggcgccagtaatcctacaccgaggtccaacatctctgttaacgaccaaatttggtaatatcagcatcggaaaaggagattagatcaaggtggagttgaaggcggagattgatccgagaacagagcaagaatcggctgaagtccagatcggctacgattaggatcagctgggtctgagtcggacaaggtgagccgatgcagccgattttaacattataatttggtgtgtgatatcgggttgaattgaggtgcttcaagattattgccgcacatggatagagtcctgagaagacaattgtatctattaattaggattttttatgtaactttattagagatatgtttgggcaaaagtctgccgcaaagacttatggtatcttagagtttgttagagatagtgatcgtgtccggtatggacatatcttgtaattctcgggtataaatagaccccgagccctatgtaatttttaacacacacgttcaatacaatttcggcgcatcgccacctttttgctttagttttgtttcgacgagttcttgctttcgggttgagctgcatcggtttcaatcttcaacaagaggtaaaacttgttatgacgacttgtgttctcgagattagtgcttccatctttatgacactctaatcttgtctatataattcgtcgagttatcatatatcttacataatctttggcaatatcgtcatctaacctacaatcggctaacatctgttaatagaaggcagccgattaggttaaatagcgacgttgtcctagattatgtaagatatctaccactttatgaaacacccagcggcttgattgtctagatattgttcttcttttcatacttaatgctacatcagttgagtttgatctattaagtcgtgcttagaatatcaatctctagcatgtcctctggttgccgattagggtagtatcggagtttcaaccgatcttatatgatttaaccatattcgatctatatgcttcaatgacatgttaaatccgccctttatgtcaggatcttattgcatttaagtatattaagcttttgtttggtatattatatttgttttgatatctttatataaagtagtatcagagtattagccgatacatgttagatctatctgatcggctatgctataaacatatataatcctgttattaatatatatttcgatctaagtgatttatactgtctcggcatggtgaccgatctatcccaatcacttgatttaagtatatattaatataagaactatatatcgttaatatctacagccgatcgaatagatttagttcctcactatctatttataaccgccaatcgattcatatatgacatcggctcaaagataaatgatatgtcatcggcacctagccgatcggctatcatttatagatttaaccacgaattctttgtctctatttcttgttgattacaggatcaaatcaattggcacgctcatacattcgaagacgagctttggacctgcattggagctttggacaaaggtgctaccgacggttctctaggaagtcaaggttacaactctcaaggggtccatggagttcaaggcgatggagcgcatggagttcaaggtgatggtgctcaggagttgcaagggggaaatcttaatcagaatagtgatgcggcacaagattttagccgattgtaggttagatgacgatattaccaaagattatgtaagatatatgataactcgacgaattatatagacaagattagagtgtcataaagatggaagcactaatctcgagaacacaagtcgtcataacaagttttacctcttgttgaagatcaaaaccgatgcagctcaacccgaaagcaagaactcgtcgaaacaaaattaaacaaaaaggtggcgatacgccgaaattgtattgaacgtgtgtgttcaaaattacatagggctcggggtctatttatacccgagaattacagatatgtccataccggacacgatcactatctctaacaaactctaagataccataagtctttgcggcagacttttgcccaaacatatctctaaggaagttacataagacatcctaattaatagatacaatggccttctcaggactctatccatgtgcggcaatcattttgaagcacctcaattcaacccgatgtcatacgacaaattatactgtcagaatcggctgcatcggctcacctagtccgactcagatccagccgatcctaatcgtagccgatctggacttcagccgattcttgctctgttctcggatcaatctccgccttcgactccaccttgatctaatctccttttccaatgctgatattaccaaatttggtcgttaacaatctcgacaccaatgatattagtgccaacacccttacacccctatggaagctaactcactaatatgaaggggaatgacgcaaatgacattggcattgaggacctatctacactacttaaaatgacatcaagacctatttataagaaaaaaaatatttacattgtatccctttccaataaaagaaaaaacaacaggtccttggtgttgtcattgtcgtcgtcccccttcgtattggtgacttagcttcgacggggtgaagcgtcaatgctaacgttggcaccaccgagatgttggacctcggtgccaacaaccatggcaccgagaaaaggatccgttttgaaaataagtttttttacgggtctatttataaaataagcttttaaaaatgactaaaagttgaaaaatagtagtaccgctttcacaatctgtagactgcagtggttagtgactgctaatagtaagctagcttgagcaaccatccaaaataatcaagttagaacaggcccgaccaaaataacagaatttttaatctgaactagtacgtactaactactactcatacatagtctcagtccaaatcatagagaaagaagaaagggaacctacccatcgatatagtactcatcaaggaaagcataatgctatcatgttcgttggtggaaattcagttatcagagagagtgattgatcagattgagagagagaaagagattcccatgcgtgatttagtcgatcgatcgatgaatataccatctttttctccgaagcttcagcactaagcctcctccggcgatgggggcaaattataaagacaatggccttatgcacatatcctagctgaaaaccatgagagactgtctaagaatataatctctcgtcgatcaggctcgtagtaccaaccggcgagacgaccgtcaccagcaaaggaaatgaccatcttaccaaccacgtgagatgtcccgaagctaaagcgcgctcgggcaccaagaaatcatgcccacattatcgaagtagttagttagttaccaccagaaagaatcatccatggcgtccattggcagcaggtacgtatactcgtacaagtagtatagtattaggtgtagctggtatagtgcgtgtatacgccgctaatatgatggcgcggctacttattgtgttagggtctgttcactttgatgccattttcaaccatactaaattttagtaaagttgtcagaaaaaaatggctatatttagtttactgtcaaaatttggtaactataaaagaaatttggtaaggtttttttttcatcaaagtgaacagtcctaattaaccccttgtcgcgagttgagagcttgacatagcttaggcttcgtcccgcaacgggcggcggcacgccaccacatgcagcgtctttgcgttggtttggtgccgcgaagaggaggaggaggaggaggagacgacggggcgacgtcagaaaattattagatgggctacaatgcatatccggctagcccacaggtttatagcccattagttgcacttaaagagacacaattgtttgttgggctgtttcccttgccagttgcctaaatgcaagcatatcagagcccaagtttatctggtccaaggcttgtatagtatttccctctacttctataactaatataaatattcgtatttttccggtcgtcacatctaattttcgtccgtttttcgtccatacacaatccgattcagttagcaatagccatgaaaaaaattgtaaaaaaaaaaaatcggcggctgccgacgccaccaccgccaccggagggagaagagaggcggcggagggagctaccaagctatatatcccaccaaagcaaggctgctcgttcaggagcttgatgatggatatccaatttaactctcctagatggataaggattttctagccaaagtagactagtttgataagcaaagctaattttaaaagtaatttaccaaatacctaacctagcttaacaaggaaagaatgttgctagtctaggatccaaacacacccatatctctttgattaactttaagcttagcaacgatgatttgtgtctaagagtaggcagaaaaagaccgaactaaaagaccgagaccgagaccgagaaattcgttcctaggcagtgaaagaccgaattttgttcggtcaattcggttagtttcctcggttaaccgaatagaccgaaaagactgaattaacaaaaaaaaagtctaaatataacctacaatttactaaattcaatagaattaaactatagttttcacatccctactttttctaggcatgcaacctaataagagacgtgcttacggaatttttttttgtgatttttgtgttgaaaatttctattatttctttgcatatataaaaatgttgttgaatttcggtcaggaccgagaccaagtccgaatttgtcagtcctgatatttttgcgttgaaattcggtcttcacttttcaaaaaccgaaatgaccgaaaaccgagaccgaaattttcggtcagaccgaatgcccacccctacttctgactgctctctttagttataggtcattaggttatgttgtactactccgtcccagagaaaaacgaatttctagctacgaaacagacatatatgtgtccaagttcgtatgtaggattggtctttttttttttttaggatggagggggtattgtctaatgcaatttttgttgtgttctctatggaggcgttttagtcaattttgctccaattaattatgcagttataaagttctagggatttttaataaacaagttaactcttttcttttataatgaaaagaaaaatccatctcttttcagaggttttctttggggaaaaatatctatgaggatttgaatttaaacactaaagggacctgcactcctggttcgattactgggtcgaacaaaagtttagtttgttagctgcaacatttgaaatcgatcatgagacccacttagaaaatgaatctctaatcagatgcatccatcgtcccttgcaccgtcagtcacaacggctgcataccacctttttcgtcgctgagttctattctttctttgtgatcgatttttatctgacgagtaacaatcggttgttacagtgtggttttctccatttttttttcatgtatactccctccgtctaaaaaaagacaaactctgagtttccgtgtccaactttgattgtccgtcttatatgaaatttttttataatttatattttcattattgttagatgataaaacatgattaatattttatgtgtgacttgtctttttaattttttttcataatttttttaaataagacggatggttagacgttggacacgaaaaccaatatttgtctttttttttgggatgaagggagtaattagttctattttactcctacacacaggagatgctctaatgggtgaagtcatggtcccttccgttttaagaacacaatagctggcttgttagcatgtggcaccggcacgtgcactactcgcccccaggccccagggcggaagatccgggtctcactgcacgaatctggcaccaccaccaccggcaccgccacgcaccgcacaagattcacccagccgtttgcactgctttgctcgccatcgatctcgcgcggccgcgacgactgtctcgcactgtcggctctctcgtctctcccccttcctcctcttcctctcggtcccgcgcgcgtcaacttctccgctttgccgcattcctccgcgcccctcagatctccgctgactccgccgccgcccgccgacatgtcgtcccgcggcggcgaggacgacgaccacgcctcgctcctcagatcccaccccgcggccggcgccggcgccgggtccggctcatcgtcgccgtgcccatctccgcgggctgtcggtggccaccaccacaaccagcacgcggacgtcgaggcggtgggggaggccaccgtcaccgcctccccgaggcggagcggcggcgtgcgtggcctcctgcggcacctcgaccgccgcctctccgcgcgcggatccggggggcgtcgaagccagcagccgccgcagcagctcgatcgccccgagccgtccccgacgtcgtcgccgcagcagagggagagggtcggggaggagctcggggatggggcgccgccggagtgggcgctgctgctcatcggctgcctcctcgggctcgccaccggcatttgcgtcgccgcgtttaaccgtggggtgagcatttcactggttctgctcacagactggaaacttgactatcctctgcaagtagaaagcaccggagtgaggctcatcatttataggatctaaacgtagttcatggatgctagcaaatgtgaacccaagggactttgcaaatgtgattttgatccgtttatttgtgcaaactaaactagtgcaaataaattcacccaaatgatgcaaaatcagtttcatttaagtgcgcaaattcaaagcaacttaacagagcactgaaagcagtaaatgaaaagccttatgtcacatcatatctgcggttgcccaaaacgcgataaattttgttaaaatttaaaaccttccaagtgattccaatgtaagttaaggttgagatttttcagttctgccttgcatgactgattctatagacagctcctgttatggtatttttaggttcatgtcatccatgaatgggcttgggcaggtaccccaaatgaaggtgcagcttggctccgccttcagaggctagctgatacttggcacagaatactgctgatccctgtgacaggaggcgttgttgtaggaatgatgcatgggttgcttgagatatttgatcagctcaaactcgtgaaaccgcctcagaaacaaggaatcaatttccttgcggcaatctttccaactgtaaatgctgtccaggctgctgtaactctaggtactggttgctcactggggcctgaaggtcctagtgtggatattggcaaatcatgtgcaaatgggtgctcggaaatgatggagaataacagggagaggcggattgctcttgtagctgctggtgctgctgctggaattgcttcaggtatgtcattgatgattacgtacctgtttccttagtagaatatcatgacttcgatagctagcaccttacaattattatttaaggatgtattacgtaatggcaattccatgtaaattggatagcatttatagttaacatgtattgtttcggatatctttgtaaaataacttgaaatattgtatttcacgactcccatgtaactctaaaatttaacattttgattttgttcctacccttttggcctttttgttgttagcgcttgctaatatactgtttcttgtgttgtgtgttttcaggcttcaatgcagcagttgctgggtgtttctttgccattgaaactgtactgaggccactgaaagcagaaaattcacctccttttacaactgcaatgataatattggcttctgttatatcatctactgtgtcaaatgttctgcttggagaaaggccagcttttatagtgccagcgtatgagctaaaatctgctgccggtatctcccctgattctttttacctttatctttaagattgaagattcatctattaactacagtaacaaacactaccaatttttatcatgttatgatacaccacttgcaccactaccaattcttggttcatcaagccctaatatgctatctccattttgttgaggcctatagtaatatgtttcagagatgatgttatcataaagtttagcagcacttgccctacttttataagttattcacacaaacccaacttttctattatcttgacatggcttcttggttgaataattctctccttttgtattgttgtatatgaacagcataggttctaaaggatattctgtcgtctcattttctgttctgcagagctacctttatatctcatcttaggaatgctttgtggagcggtcagtgtggtatttggccggttggttgtatggttttcgaatttttttggatacttaaaagaaagatacgattttcctattgtagtataccctgctttgggtggactgggagctggcctcatagctctcaaatatcctggcattctatactggggtttcacaaatgttgaagaaatactacatactgggaaaagcgcttctgctcctggtatatggttgataactcagcttgcagctgcaaatgtagttgcaactgccctttgcaagggatctggccttgtgggtgggctatatgcaccaagcctaatgattggggctgctgttggagctgtttttggagggtcagctggatatttgataaattctgctgtacctggtaatgctgctgttgcacagccacaagcttatgctctagtaaggtgctctgtttccctttttttttttcatattgcttgaagcaatactgttatttctacatccttgtatatacaaaaactaattgtcagaactccaggttggaatggctgctacactagcttcagtctgttcagtcccactgacctcagtgctgcttctctttgaactgacaaaggactacaggattttgcttcctctcatggtaagtatgactgtttatgtagtgtgcccattgttttgttttgatatagtctttctcttttgtcacatcatgatgtctagaagaggacataaatgttgtgattttatgtttcactattgcattatcaaaactaatgcacttattttttattgtccaacagggagcagttgggttagcaatctgggttccttctgtagtaaaccaatcaaaggatggtgaaccatctaggtttagaacacccaggcgtggttattcttcactttcttcagaagatagaaatagtaaaagctggaggcgaggtgacagtgtaaatgatcttgagctcactagcttacggactgataactatgacacctataatgaggaaatgcttctagatgatttgaaggtttgtaggcctctaattcttattgttaacggtctagctgatgcaatggtgcgttcaattttcaatagaagtacatgttattatgttaattctatcctaatttgtcatttgaactcttttaccaggtctcccaggccatgtcaaagagctatgttaaaattccaacatctgccatggtgacagaagctctcaagcttttgcatgataagcagcaaaattgcggccttgttgtggattgtgaagattttctcgaaggaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggagatgttgcaggaaaattcttcaaccatatcattgtgtcttactcgaggattccagtacgaggggaatgaacgtggattgctaacctgctttcctgatactgatttgaccactgcaaaaaaccttatggaggccagaggaataaagcagctgcctgtcgtgaagcgtggtgtcggccatagaactgaaggaaaacgcaagcttattgctcttctacattatgattctattggtcactgcttacggttagtcataagcttatatgtgttctttcaaactttatatttttttgggtttattcagctttaactcaagataattgaattttttttccgcttgtttaattcatttgaattatactgaaatgtcaattcatttggttatgaagggaggaaattgagaactggaaggccatatatcaaataaaagaggacttccatctcatagcaaatgggcattgaacagcattacattgaccaatattacaccacatcaatcgcatgcaatttgatatccttaaggcatttttgccaaatggggatacaggaggtatacacgaagttcaacttgtacagatttgaggctcctctacaaagaattaaattgccatctgaggaaattattcaggctagctagccaattttgcaatagaggttatggtccattcttgttgcgaagcaacttctacttcacacgggaggagatgggtatgtatgaattcagttattcagaattggaaagtggcattgtaatgtatatcttgtacctgtactatttgtaactgtgtaacatcctgttgctgggaagcatcatatgcgccagcttgtagaggtgcagtcacacgagaaactagtgtaataaagtgtgcagcagaaaattttgtcaagaagccgatgttgtaggttgtagcgtcacattgtatgtaacactttatatcagcacttgaactgaatttctccctttccgtgcagttacataaagcttgcagagcaaagttgctttatcaccatcgctgtcctgagtcggagtcatgtttacagcgaccgccgtcgtggcatgttttttttacggaggctgctttctcttcctgtaaacttttcaatagaatttttttttaaaaaaaatcacactggttagcaatttaaaaaatatgcgctcggaaaataagggtataagttaataaggatagaagttgggaaaaggaaagaacacatcatccttatatgttactcctgccgtcttaaatacagcttagcactaaattatacacaacttaattatacaatataggtagaagtccatttccacttaaatccgtaatagtttgctactaccttcgttttcaaagtactccgtataagttattttgatatgatgttatacatttcaatactatgaacagattttctgttcaaatttataatcctaaaatatattatatccgatcaaaattaagatagtatatgtatattttaagatgaagacagtagcgatgaacaacatgctcatgactcaggagtcaggagtcaggacaggagtcgcagcttcttccggggtgccccgaaacggagtaacctgggcactcttttcctcatcttctctacagcaaccgcaccgtgccacgtaaatctatcggtgaccgtctcgacctccatggaccgcactggtcggtcgggaatggcacggccccaagctagcctcaggcctcagccgtgctccggcaaggcggcacccggcaccggtctagcatactagtctgtcccaaaaaaagctaaaccctggctatgaacgtggacacgcatgtgtccagattcgtaggtagaattggactttttttttaggatggagggtacgtcttttgacgatgcgctgaaacactgcagttctctgagccaagccacacgtagcctattgcgcatgcatgctatgcagacgaccttacaaaatttctactcctctccgcccaaaaaaaaaataaaaagttttatcccttcaatactttttacctgcctatcactatcactatttttttaaatgattaaggttattatagtcactctctatttcctctatttttatcttgagatgttagaattgtttttttttttttttatggagggagtaaggtccaaggctagcatctcatctcacgcaacgtcacagtcttcgcagaaacgccgcaagcgacaacgcgatacgctgctgcgtagaagcatccggctttggcctttcacatcaggcaacagcatcgctattgtatggtactgtactgtgtcacataccggtggtccatctcactagctaccgttgtccccgcccagcccgggtgcaaaagaccaaactatcgaaccgaacacctcaagccaaggagccagacggagccgggcaaggtgaaagctcagtcagtgcacgtgtattttactactcccaacttttccacggattagcaacgcgttttctcgaaccgaacaggggacaggggatgcaaaaagagactacctgcgaatctacttatatgtcaaataagtaataatctatggatttctacgttgtggctcgatttaattaccgtaactaaaaaatgcaagtgggttgattaataaatctatttatatatcaaatttagtaagtaacccgcaagttaatctacgagttattagattatccattaattttgtatataaataagttcgcgggtttgtcggttacatcccccaggcaggaggaatcccgaacgaacccgtttcatgccactgtgcgtagcaacagaacggcgcggcgcgctgattcgttgacgagtgggagataattaagccggggttttgtatccgcgcctgctcccctttggcggcttctgcgacggggaaggtgtcgccgagcgcacaacagacggggctagtggcacaaaacggcaaaactagaaaaaagaattggatttttcttttccatttacgtgcgtatatattatgccttgtcattggctcgtcgctgtcaaatatttactatcttttttttttactgtcaaatgtatatagattagtgcgcatattaaaaattcaagccgaacaagacatgttcattattgcccaaaaattaaagcactttcgatgttttgcacatgcatgtactcatcattattacttcctctatcttcaaatatatggtcttttgtcggatgtgacacatcttaatagtatatttacgaatctagataagatgtgtcacatccaatcaaagtaccctatatttggaatagatgtagtaatatatattcaaaatgcattctcaactgtgtgtctatatatatatatatatatatatatataaattcataactagcattagataaatagctatagtacattttaggatggaggaggactgtattagaaagagataactatcgggatcatgtcatctagtctctctttttctaaaacaacctcgttctttttaagctaacgaaggtatgaactatccgtgtgacgcttaataaagtacaatttctttaaaaacatgttgtctagtagatatatattttcttttgtctaaactagtacagtatttattaactttagaatctacaatgattaatttaattaatttatcggctaatgacctggaaccgggctgtcagctacagctgtggtcttcggatgtggttgttgcgtcagcgtggaggttacttggggtcttcagagacttgcaatgggctatataatgtacgtacggcattctagctactatggcatattggcagttgatgtgatgtttggccaaacatctacagtacagcctgcatgccattccacgaagtgcgactagaagtaaacggcgccagtatgccatgccacaaattgggcagagagaaaaatgtgccatatggtccgtggtcttccatcaacaaaatattggtcgtagctacactaactgacgaacttgaattcacgatcgagccgtccatgcgcatgcacgcaaatgtgaacgtaccttgattattctcactgattagttatcagaaatttagtcctgcagagagatgatcataagctgccagccctgagactgtcgatcgtatcatgattcacaagtggcatactggcattttctgcggtgatcacggattaacggcagcaacaccacatctgaaaatgacgggataccatattaaaaaatatatatgcatggtcatagttttaagatgctgaatttcacttgagcagtacgttcaattctctcgtacgaacttgaaaattctctgtttcagttaagccctatgtttacgcggacaactacgaccgcacgttataccgtcatagagcggtataccgtcataggcctcgttactgggtgagctatggtccactggactggaaggcaaatcgaggaaggaaagtgctagctactccgtatatgatacctcggcaatattatgatcgagatcccccgagatattaggatttattaatcctaaggtgttatgaaactttgaaaagaatcaatattgtcataacaatactagcatattgtagtttcttgaaactccataaacatcattatcattgaatatcactatcatggaggatgggcaaaggatttttagaggattaaatttcctaaggaatttttattattgaagcctttttcgcgaacacattattgaagcctttcattcatatgaaaagataggaaatatccatatgaatacattcttacggtccagtccaatcaataccataggaaattaaagcaagaagttagagttatttaaattttttatttaactagaaaagatgtctgtacgttgcagtgggtgaatgctattttaatcttgttattgttatacggtttggctagggtgaaattcgctatgagaattcgcttggatattttttttctagaaaatcttgagctgcaattaagagtctgaaattcataagttagcatgcaagtgtttttaaagagatttcttatacgactccttttgtattttcaaaagcaaacgaacttaaaatctgacttaaacacggatctgtatttttaaaagtgaatgaacttaaaaaccgactcaaacgcggatgacgtaccaaaataccggtaaaaacatcttcaatttttataatagtaaagatttgttcaatttttcctgtgatgtaatgaaatggcttgtcttctagtttcttatgctttcaattcagatagaatttgtaaaaacataccacttcaaatttttgttctttttcttgtttctgtatttttcttatcatgcgttctaaagggggtcttattatgtatcaattagcatcggttagtatcaagtatcaaaaagtgtggtttcatcatgtaagggatatcccctcgtttcttgcagttttataataatgaaaatgatttatatttctggcttctgtgctaaggcacacaaataaaaaagagacgataggtgatgggacaaaccctcaagggcctcaactccacattattattaactagcgttatatcaaatagattccgccaacaattctaatagaaactatttagatgatatgtaaaaaagtgagaatatattctcaaggatgagaatccatcttctcaagcaattcagatctactgtagtagtattgcagatacattactactcactgacatttgggctgtatgtccagtgctacagaggacctcactccttctcaagtatcatcatgtatcaaagagtatttcaacgaatatcattgcgtatcaacgagtaccatcgaatatcaaactattcgtcgtggtgtatcaacaagtatcatctaagctttgtttactgagtcaactgcgagtctccgtcaattagtaggtagtaacatggtttgcgtgctatggcatttcgtgcgtttgcatgcacgcatgaaagtctatcctctctctatatataagttgataggaatttaaagctgcaattatctagctgatcagcttgcctaggaagcaaggaattagccatggcttctgtttcgccgctactgcttctcctcttgtgcagctaccactctgtagttgctcatgcaggagatggacagagttacaaggttcttgagctgaattctgaggccgtctgctccgagcgaaatggtgactgtccatgcaagcgcatagtttttctgcaattttcgtgtggtttttcagtgaaattgtaatcgttttggtgcgtcaaattttgcagcgatttcgtcgtcgttgagtggaaccacggtggcgttgaaccaccggcacgggccatgctcgccggtgccgtcgtccaagaagaggccgaccgaagaggagctgctaaacgcgaccagctccgagccgagcacatccagcggaagttcgccatgaacgccgccgtcgatggcgccggcgatctccagcagtcgaaggtgtcgtcgtccgtgccgaccaagctgggctcctccctggacacgctggagtacgtcatctccgtcgggctcggcacgccggccgtgacgcagacggtgaccatcgacaccggcagcgacgtgtcgtgggtgcagtgcaacccgtgccccaacccgccgtgctacgcgcagacgggcgcgctgttcgaccccgccaagtcgagcacctacagggcggtctcctgcgccgccgccgagtgcgc

SEQ ID NO: 30587 - DNA, 2667 bp, Oryza sativa
acggcgcgaggctgcaggacatcgccgtgggcgggaagcagctcgggctgtcgccgtcggtgttcgccgccgggtccgtggtggactccggcacgatcatcacgcggctgccgccgacggcgtactcggcgctgtcgtcggcgttcaaggccggcatgaagcagtaccggtcggcgccggccaggagcatcctcgacacgtgcttcgacttcgccggccagacccagatctccataccgaccgtcgcgctggtgttctccggcggcgccgccatcgacctcgacccgaacgggatcatgtacggcaactgcctcgcgttcgccgccaccggcgacgacgggaccaccggcatcatcgggaacgtgcagcagcggacgttcgaggtcctgtacgacgtcggcagcagcacgctcggcttccggtccggcgcgtgttgaccggggcgggcggcgcgacgccggcgcctggcgggccgggcaacacgacacacgtagaggccaagagggtagcagtaggttgctctcatgtggtcgtctacttgtttgtggttgcgaggtaagagtcgtgacgtgtgatgatgacaagatataatgatatatattgcaattgtaatccaacaaccaaaatattatattagtccctagctctaaaaaaatattatattaggagtgaacttttcatgattttttatgaataataaagactttatactgattaattcgatcgtttgattcccaatcgacggatgcatcattagtgatccaagtgtctggccaataattagtgtgtgagaatggtcttggtgattcccaatggactacagtttgccctactgatttaccaacagaatgttagattgcacgtaactgcgtatggtggcacttgtgcaatttttattttgtttttctgtactattctttgttttggtttgattctttcgaatggatttaagagaactgatccatatgctcctccgttttttttgagatgctaccattcatcatattcaaaaaattaatataaatattattttattttgttatggcatgttttattattaaaggaattttaagtatgacttatactttacatatttacactaattttttaaggagataaatgatcaaacattattaaaaaaaattaacggcattatctattaaaagggatgtactatattaattttgtggtggagatttcgatatcgtccactctgttcaccagaacatatgtaccccatctctctatttcttactcttgagggccaatagtcttggataataatgggattttggtatgaaacatcaattctattttcttttcctttggagcaccggaaagcagctgtcaaactgatacagaattgtgccaccaaagaatccctagtagagtacacatggcatttcaaagagaaaatcatgttattctcctagaaaacatctaatggattcttcttctgctatctcatagtctacttgttgccttataggttaatgttttgttcttatttttttatgtctacaaaacgaaaatgttaattcaaaagttaattttgaggttttaatttttttaagcattgactttaaaccgttacaacacatgcatgaaagtatttctttttttttgtaaaatttattttatcatggcttgtcagccgtatatcaaacagagtttataggctggtccacgtgtatccctactaatttttttttgtgtatttgctatgaccctagtattcttgtgctttatcatcatgtgagttcataatttgtgatgttttgttcttagttttttatgcctgcatatattaagagttatgcattccaaagaggaatatcttcggtataaacatatttgaaattgtatatgctctaaattgttcaaactataactctatggcccttgactttcacacaaatatcaggtgaatgttcggctaacaaccatcaacaatacagatccagcattatctacgagattaaaaaaaaagataacgttttctctctgggccttgggccacagcagccacaatgcacaacagaacgaggtggccccacagtcccacacgtccccctaactgtccactagttttagacttttagtcgtagcacatcagttgagcaccgtgccactgaccacgacgcaccaaatcaaaccaagcgtgtcaagcgcctaacacgtgcacatggttagcccgtttaactaatttattattattactctcaaaaatcgtatatccactaacgaaagtactatgccttacaacctttgtgtatttgtgtactatgtactctcctactactagtgttatgttatgtatatgcgcctatcatcctcgtgtacgtacgtacattgtacgcgtatatctatacacctatacgccatgtacgtactaaagaagaatactgtcgtgggtgagttgttaggatggatcgatcagcaggaggcgggcatgaagccgacggtgctgccgtcgaagcgcacctcgaacgagcgctgctgcacgttcccgaggatggacgcctggctgtcgccgccggtgggcgcgaacgccaggcacccgctggtgaggatccccgacgtgccgaggtccatggccgcgccgccgccgaacgcgatcgagatcgtcggcagcgtcacggtgccgtaccgggtgaagtcgtagca

SEQ ID NO: 30588 - DNA, 10353 bp, Oryza sativa
  unsure (1)..(10353): unsure at all n locations
tggaattcttcgttcgtgttgggttggggggggggggggggtcccgtctcccaccgaaccgaagcgaagcgaaacgcgacgcgacgcgatgcgactttgcgagtctcgttttggtgcggcgccaacgaaggtgggctttctgcgcgcgtcagatgcgaacgtattattgcgnnnnnnnnnnnnnnnnnnnnnnnnnnnnnnnnnnttttttgtagtcgtacggtttagcgtatcggcgccggcaagcttgaggctcaagcttagtatagttctggtactaggaactaatcccaatcctaaaacttttttttcctgatgatataattctcataacctgtcaaattggtgtctgaaatttgaaatctgaaaatgaactctactaaagtttgcatatggttctttcagtgcctttacagtttctcaatcgattccttttagaagtagtaccttttacatgaaatgaaaaggatgctcaaagtcccaaagttgtgtcacacaactgttacgctaactgttcgtctccctgacggagacctttatctaccgctattttcatcggtggcgtaagggatctatggccgtgagcgcgacacgactgatgtgccagcaaaatacccaagttttcttctcccgtccctgccactgtttgcaccctgcgtctccccaaaattctcttctccttcgccgacatgctgcgagcctgcacactgatgctggtgtatcgcaaggctgacgacttcgcgttgcttatcgcagcgtggctctcttgagattactggtctaaccgcccggattatccgccgggtcagtcctgtcctgcaattcgtgtacagtggatggccggtctgcatatgtatatgtagtggtgcattgccgaacattggacgagtggtttgacatggattgggtgggtcctgaacgatgagcaactgagcatgcatacttaggtagttggtactcctacttggtagtgccttggtcacatgcagagcacttctcttcattctggtctactgggaatttggatagataatgttggttcgtagtggagcaggcaatacccgggtttggtgcttcttgagtccctgatgactgaaaaatcacaggagtcgcactgcatgactaaccggcagtttcatggtcgaccggtaaaacaggctttcaggcggaagtgcgtgtgccagaatttgagtggtacagtctttttcacaagtgaggagtagcaacacgctttcacaggaggttggcagccatgcatcacgatccagtgcagttgcaagcatgagcctgtttggtatagcttcagcttcagttccagctctcccttgaaattggaacttagccaaatagttctagctccacgtaaaataggagcggagttgaatgaagctttttcacaaaatgaactggagaggtggagctagatttaggcagctccacaactccactctatatctaactcctgaagttaaaactctaccagacagaccctataattgcaacttaagcagttgttcgggagttcttaaaaaaaaagccagttgcttcggcggcacatgatagagaagttaaaactctaccagacagaccctataattgcaacttaagcagttgttcgggagttcttaaaaaaaaagccagttgcttcggcggcacatgatagagaaagtaagggcctggatcattgtgtgactgtagcaaaaatatatattttatacattttgtagcaatgaatgtgaatcgttaaatcaaaatatgaacggttgattacttacagtcctttttagtaccaactgtatttgatctcaatccggtaggcataggtatctgaatttacaattttcagataacccactcttgttttatccgccaaataagccatccaaaatatacaaattgtacagacactaaaaaaaaaactcactacagaaagcaaagaagagtgacggttcacagtgatgattgtgatgcaaccactctgcatcacaactcacaactcataaccctctgaaaaatggtaccaatctctcctttccgatggccatctccctgcgcccaatctccattccgcaacgcttccggccgccggacggcgccgtcctagctccctccggcggtgccgccgccgccactcgctcgtacggtgcggaccacttggcctgcacgtaccgcgcccgcctccacggcggcaggtgcatgcccgcgccgcggatggactccgccgccgcggcgcacattgccgcggcgacccccctgaaggcctcgggagtcgcgacgagcaccggcgggagcgagaggaggaggtcctggtactcggcgctcggcctcgcgatctcgaactcgccggcgacgttgacctcgacgatgtagcgagcgcgacgccccgtcgccgacgccgccgccgtcacgttcacgtactcgtggctgcccgccggcacgctgccggttctttcccacgacgacctgcacacgccggcgtcgaaccctcgggcgcggagccgctcgacgactcgcttccggatcacgtcgccgccgttgcgaacgggatcccggacggcgcgctcggcctcggcgcggatgcgggcggccgccgcgtcggacgtcgcgtccgctagcgcctcgcgcagcgcgttcttccactcggtaggctccggctccggcgacgacgacacgccgcccctcgccgtggcgtccgcgccgcgctcgccgtcgtcgtagaactcgtgcaccagatccaccaggaggtcgtcgtcgtcgtcgtcttgatcacgccggagggacgcggcaccgctggcgaacgggccacgcagccgtgccctggccgcctcgtccagcaccgccgtcgccttcttgtacgccatcggcgacggccgcgtcgctcccatccaacacgccaatcgggcggcgcgcgatcgccgggttgcctcgatcgaaacgagcactgcacgcggcggcgcgaacaagatttgttgccgtgtgccggcaaagccgtttccttttccgttgcaggttcgggtggattggcgtcttgtacgatacgaggcggttttatatatgtttcggtgtgtggacgccggggcgtttgcgcggctaggttcgttggtttttacaacgtccaggtgcaatgaaccttgtacgtccaggtgcaatgaacctttgtacgttctgtatgtccagatgcatctcgctataaggtttcagaatcagaattggttgaggcgtacggaagcatgtgagaaactaaggccccgttggtttttcagttggacggatattttcatagaacgcgaaacgagaatacatatactagcatatgattaactccctctaggttttttatatgacattggctagtttaacatacatatatatatggaggtaactaactatcaaaattaataaataattttacttggttttttaaacaacttctacataaaaactttttatatgaaaagcatgtgctaacgaaaaacgataaagttaaagtttagagttgagaaaaagaactagcctaagaataaactattggtcatatcttttcgcttatgcttagcaaccaaaatttaaatttgtaatcttaaatttaaaactgattttgaggtttttttttcatcaaagtttatattaaacatttgcttttatatcgttaagaacgagtacatataaattatattcacaaattactttatgtttgcaaatataagagtttcattaataagccaaacgatgggccgatgctggtgttaacactatggtttgtttgaaggtgccctgatgttaacgctattggccgatgctgcgtccagatacactatgcatgacatgcgtacgtaatagaagtttcaaggttattcatgggactgaaaaagcgtgccatcatgattaacttagtctattgcatataaacccacaggtccatttgccatgattggcagtcagtgcatataaccctgatcaattgccatcatttgccagaaccattcatcaattctagagaccatctaaataacatcccattttgcatatcagatatgcctggcagtaatatccattcactaatcactacagaggagattgaacatgtcaggtcctcttatgagttatgacttgttatgagctgtccatcgggttatcacctgaagttggtgcgggcgcgccattgtcgtccataggagtgttggcctccattgctccaaaagtaaaattactaggaatattacttgggttgactcgctcgaagatggacggcacgggctgctggttgaatacgggcgcttggatgtcacctgccggttttgggaaaccaaatccaagaggacgaaatgattcagttggaaccgacgattgagcaggtgcgccaacattgggtccgaaaagcttctgttcatactcaacgagctgattctgtgaagctgtatatataacaaataggttactgttagctcatgatcaaacatttggattaaccatcaattcataatgttacttgaaaaacaaaaggcgaaatctataagaacaaaaaagcttgagtagtagctatgcataagtactagggcgctactatgctaggtaaatgagccacagaagctttcaaagcttatctatgtaaatttaagagcctgtataaggtccccgtcaagcactgatgctacatcctattttgcaaagaacatctcgccaagcacctatattaatttgaataggggttggcaaagatttttcaggcatgaaagaagaaataaattatttggtatgggatcataccatctgtcagttgcacctgtggtcgccggtctttcacccattggtaagactgtgaaagtctccatcccctagatttcatcaagtagcctattacaatagctgcagacctggaaattttgtaccagagaagtattaatcgatcattcacaacaatgctaacaacatgaatgctcacaacactgctatcacacctgttttttccagacatgcaatggacaagaacacgtgatgtctccctttcacactgttctgcaatggcagataacgaaacaaatgataaaaacaaaaacatccaccatttgtttctagtttagcactgcccaagcaaactacagcataattcctactacaggaatgcatttccattggttcaaatgtcaaaacaagcacagagactatctactggagtacgaattcaagaaaaacttgaaatttcacagggaaaaaatagagatttcattccattccaaacaaaaatgctcaaagaatagaatggattttacctaaaaacctgtttgcaccatcaaaatccaagctcctctcatcctgaatgcagtgataagtgaaagaattccggtagagattctgacaatctggcacagtctgcgatatatgagaaaaatgcttacatgattaactaactaatagaggaccagtataatactaagatatcagtttatcacaataatgtattaaaaatgaagagggctatggtaccaacatttctaagctacaaaatgtccccaacttttctttactccgcattttgtcaaatctctttgtttctcttgtaggataaatcatgtttagtgaaaagacatatgtaaagttcataaaatacaaacatggcaccacagcggcacggtcatccctgataaaaagaaatatgcagcagaactacaacttttaggcctatagggtgtaaggagaaattactcaaccaacaagaaagaatacattatgagcatacgatgcatatcatccaaaagtaggaagataattagaatatgagcgaattaattacaaaggagtagaatctacttcaatctaacatgacccaattatcaatctacccagttgtgattgtgtgtttatctttacactttctttcgatcaagtcccctaccccaatttgtctcagatatctagtttgaagaaactctttacactaattgttttccttgtttctaaaaggctaatcattcattaaaaaaggccaaccactcagggggaaaaatatgcttgatacatttggtactgaaaaggcaggtcataagtaaggctccgtctgattcaattgtttggagggatattttcagcgtacgcaaaacaagaaaactcattagcacatgcttaattaagtattaactattataaaattgaaaaatatttttttaacaacttctatatagaaactttttgccaaacgcaccatttaatagtctaaaaagcgtgctaacggataacaaggaagttgaagtttggagttgagaaaaagaactggctatgagggcatgatataccatcaaacaaatgtacaggaatctgtgacaatgcaatcaacacatcccatccttcttccttgttgcaacttttctaccagcgataggagcgaccacattgtattgaccaatggatgataaccctttccctgtcaacatcaaaccttaccaacactctacaacttcttcgagacaacaagataaacttacaaccaatagtccccaaaccctagagatacttcacaaaaaaaaaatattctcacccgcagaaggggagatcatgacatcgcgcctcaactccatcacgcagaaaaacaagtcaaaataggagcgattgggatcatgagaaaggggggcaacacattacgcacgttgaggatgtgggtgatgctgagcgtcttgaggacctcggagcgggaggcgttgttgtagctgccgaggaagaggaagtccttgaggacctcggtggggaaggccgggtccagcgtcgccgggggctccccggccatcggccccgaccggtggccgcagaccccgcaccgctccccttcctcgctgttgtggtagtgcccgcagatctcgcaggggttctccctctcccgcttcctcatctcgcctcctccgccggcctcgccgcagccgccgccgcgctcgatcggccggtggtggtggtgcggtagtccagtggcggcgcgcgcgcttggagcaaaagaaagggttcggagttgggtttttctttttttttttctttttctttctaacgcaaagcttttcggctttctgggaatttttttttaaaaaaaacttcggcatttggttgggtaaaaggaagactgagccgtcgatgtggatttggacggctgggatcgtctcggcagttatggcggtgtcgtactcgtacaaggttggtgagattgcgtatgggctgatgactcttaagctaatcattttgatgaagtatagtgctagtactccgtactggttatttttcattgctatgggataatacacaagttttagataaaacaatatacactgtgttattttagttttaggtgttgggcgattaagaatttttttcaagaaatatcaatttaagatttctgcattgggaaagggttgaattagtgcccgcctgccaggttaaataagggtcctgtttggaagattagcccagggctaattttgagagctaatatttagtcatgaattggtagactaaacattagtctagggtggcatgtgcatgtttggatccatgggctaattcaaggctaaaaggtggagagagtagaaagagaggagaggagagagagagagagaacagggccaaggtcataccaaaccggacccaatgttgcactgaacagacatgttgtaaaaccaataaaacttacgagaggctaattttacttctgacggcaagattagagctaaacagctaatataaaccgcccatatgtttgaacaccactcaggcactaaccaccagtcaacagaaagaaacgacaggtctaaaacctaacaacaagatactacaacgaacacaataaagggtgtcaaaaaagacagaaatcaccattcatctgtacccatcgagatcatgtcgagccaggaaccggatcagcgtcgaagttttcggtggatgagtctgcagcttccttgtctgcaggagctgcttcgttcagtgaagttgccgtgttcttcgacgcgcctttcttgtcatccttaccagcagaccggccagtactcttgctctcgttcagctgattgccggttgatagccttctactcggtgtcccgtttgatgcgccaccgtttggctttgtgccagccaccttctttgcactggtcactctgtagggattgacccgtgttccgaatggcccctcacggtcgatgtttagtagctgttccgtctggcgtttttgttcctggaatgtgaaagaaatagaacagatgattttgatgccaattgcaacatctgactcatcatttgattgatcgaagcgtggataagtagcaccaccatagaatccttgttgacaagggcatttggatgcaatatccagtcgatactaaggagcttctgatagtataagaaaggaagtgtcactaacccgcattcttttcttctcttcttccctctcttgcctaagaatgacatactcatccagcattgctagcagagaaacaccgtcatacataaatggcagcccgtgattttcttcccaagctctcgtcttagccaccagagtttcaacaagggctaaaaaaaattgctgtcattagcaacgaacaggaaaaacaatatttacaggagaaaagatatagcctatcctgcattatgcccaaatgcagagcttcttgagttggattgtgtaaagcttagaattatcatttactgccaaaactatttacttatgcatcacagtaggcacctggaatcttgctgactagaatacgggccttttctgcacgtttgagattcaggtgagcacctcggcctgagttatacctgttgtcatcctgcaaaaggaatttcatgctcagtacttcatagcttcagaatataggtgggataacacgtttcactagtagtcagaacaaccatactctgctatagtcttcaagccagctttcctcctcgcatgaggatatccatctctcaactttatctaatatttcttttctgctcagagcttcctcctttgctttcagtatctgactatccatgtcagcaatcagttctgaaggttccatgttccctgactcaatcagtgcctgtattttctcatgggcaactgctgtgtctaatacaacatgagtgctagcataaatatcttccagtatggcttgcttcttaaaagctatttctttcatcttgctgtattttagctgatccaacctttcaacctcagtctgtgcctgaaatattgggtaatgaagatcaaaatcaaacgagaagtaaaaaatatatatgaagggatgctgaaggtggtccaataaaagaccaattagtatattgtgtgactcacttgatcaatcacatcaacagcaagtgcaccaggaaccatgacctcctcaacagttgctgttctattgcacgaaacatgatcaaacaagctcctttcttccaccggggtgtccataagatcccatagatcatagagttgagtggcaagctcttgaagctgaataaacagtataaatcatacatgagatccaggataagaatggctcttggttgctaagtataaaactgaaagaaagaaaatatgagttaccttctcaagtctcaaccttttgtcctcattaagagtaccaatggtcctatcaagttttgacagggtttcattgcttatgttcttgtgttcgttaccaatagagtcatctagactgctatggacttgagttattgttctaaaaaaatccatcccaagcacattgcatagatcatgtaccataccaacatgctcaagaaccttttccagcctacgactctgtgatattcatggaaacatatattatagtctctatgaaaccaaaaacacagagatcaccaagcaatataaattacttatgaaaaccaaatgaaacagacaaagtttgtaccttctctttctcaagctcttgaagctgtaactggaactctcgaagcttccgaactgtcaaatcatcctcattaatctgtggtagtgccacttgctgtcccatctccagagtaccagcaatctcaccacgtatttgctcaattcttgactgtatattagctaattcctttattctctcctttttcttcttgcccaattgttcaagtgttggagctatagcagttagttgttccttgatagtccgtgctgttttctcaggctgtacagataaaaaattgtcacttttgcatccactaatatttaagcataataatttagcaaacatgtgaagtgccatctgacttctgaactacaatgccagatcctattaaccataatcatcagtttcaagaggacttgcacaccgttactaaaaaaccaactgcatttttactgaacttctatgcaagtactaatagtgccagcaatca

SEQ ID NO: 30589 - DNA, 546 bp, Oryza sativa
aacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacaccttttacctgtacaacacataccccacccccccctccccaatccgtgctcccgccgaacgtgaacccgtcacgcacacacgcgtgcgcgtaccttgggcacacgtactgcacacagtgcgcatttatccgcaaagctatcgaaaatttcaggtctccaggatgattcaatgcagagaagagctcattctctaaaccgaagtactagtatctcagtattgaattaatcaggt

SEQ ID NO: 30590 - DNA, 683 bp, Oryza sativa
gcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcaaaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctacactagcttcagtctgttcagtcccactgacctcagtgctgcttctctttgaactgacaaaggactacaggattttgcttcctctcatggtaagtatgactgtttatgtagtgtgcccattgttttgttttgatatagtctttctcttttgtcacatcatgatgtctagaagaggacataaatgttgtgattttatgtttcactattgcattatcaaaactaatgcacttattttt

SEQ ID NO: 30591 - DNA, 666 bp, Oryza sativa
  unsure (1)..(666): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggcgtgacacgatttggcgagaacttgacgccaaggaaacccagtgatcgagccggcgccatctccgccgtacacgtgcccgcctacgagcctggatcaacggctctggtcgcgtctcctcctccagcttgcaaaatggtgctattattgttgctgctctttgttaattgccttgtgtttatgtaattcgtgtgaggcgatcagggaaaagaattacctgaaatcgtctaagttactagtgttatttcgtgtgtgctaaataagttttagatgtgaggtgaggtcgatctatcatgtaatgtactgaacttatatgtggtgttcttcgtggcaccgggaaatatatataagaaggttgttgttatgactagggttatgccaaatttcatccaaaaaagactaaggttatgnnnnnnnnnnnnnnnnnnnnnnnnnnnnnnnnnnnnnnnnnnnnnnnnnnnn

SEQ ID NO: 30592 - DNA, 3314 bp, Oryza sativa
acttcagcgacgtgggcgaaaaccaatcgacgcaccgggccatcacgctggcaggaatttttttttgcaaatgcgtagaagattgcaaattaatattaatatattagatgatgccccacgctttctgcggtatatatatcagataatggagaaatgatgaaatgatttggattgaaatattataaaaataatttgagaataatgatttagcatgtgaatgttttgttttagaatgaaataaattgtagatataattaatatgtgcttgcacgttgagtttgtgtgcataatgggtttatatggcatgcttgcatgtagattttataggagtgctaataaatactatgtttgcatattgagctttaggtgtttagtggacaataactttatagaaagaagatattagaaagagagttcaattatacaccacaatcaaccatagagggtcattgtccgggaataaggataaagaaaaaaaaactgagttaaaactggacgctacttctatacaagagagaggggaggcggagccccactgcactcccaacaagtccccaaaagacgcggcgccagcagctgagcataggtgtttttttagaatggactcgagaaccaccgaaactggcgagagagagagagagtaatctaacatagagttccgatccttctacagctactaggagacgaggaggactaaggaatcaaaacccttgtgacaatactcaggcaaacagaccatagaggtcggcctccagacctgaagagaggagccacaggccctaaggtcttgtttaaagagtttaagattataaaaaagctgattagtagctacggaatctggttcgtagtttattttaaatttttgtaactacactttttaaaatttcgataaaagaattttgagtgcttgagagtgattttgattttgggagaagctgtaaatgacagaagcccttcacctttgaaagcctaagaaattttctgctaagttgttggagaaggtatgccaactgtgtacgtgaaatagagttccctttgtttttttttaaaaaaaagatagtgttccttcaccagaaatatcacaaaatatattagaagacttccaggattcaagacatgtttctgttttcagcttgataaaatagcacgaggtattgatgacatgctggatgtattgcatccaagtgcaggtagcatatggggcattcgaatgaaatatatactgatctatgttggccgtcaagattttatttacgttatatatttttatagcgtccaaaccaatgagtacagttaatttctagcacacagtgatgttttcaagtgtggtattccagtttgttgaattgttgcatatttggagatctatgaccactgatgagaagcttgaactcagtgtcagtgagcgcttccgcaagtttccagataaggttttcgaacgcgtggtggagataattgggacaagaaaactagcaaatgagtgttcagcacaagaaaccttatgtggcttcatcaatcttcaactgtaagaggtgctactatttgatagaaggtcaagaatacatgaatcaggttcaacgcatcattggctcattgcattgttgaaatttcacgaaaccggcgatcattgacgaacgtttgtgtcaaattgcatgcatcaatcaaatcgcctcatccattctggcagctcaaaggaagctttaaagttatcgtcgtccgttcttcttgactttgcttttccaaaaggaaacatgatatgatttgcaccaagataatggatggattggaatgagagggtgagatatcggaagatacggtgtggctttaaagcatattctactgcacaaacagggatcttccccggctatggtatcaatgtttcgttcataaaaaaaagttattatgttatcgattttcctttgccgtcccttgcgcattaggaagatttgacatggataacgaaatagttccgttgtgttacagggatacagccagaacatgctatatttgcctatctaactcaatttccctgcaaaatttatcacaaaaccatatatttagtgctaaattgatcacaaaaccacacattcagtgctaaatttatcacaaagatttcggagcttgaatttcagcgtataaaccattttaaaacttacatgctgagttcatttttttgtggtggtggtagggtggggggagggttggttcattgtactttaattttagcaattgtttttttaactgtatgtaatataaatataaaagttgtacatataaattattatttattgcttatatggtgttttgcggcttatttagctgtaagcaaaacaatcaggttgatagattttagttataatatcacaaaatcacatatataccatcagttttatcataaacctacatattttaaatcttagatttattaaaaaaaatacagattttaagcctccattagaataacaatgttaggatggagcagttataatatgtaattttatgataaaggatatgctgtatatgtaactttgtgatatttatagtaaatttaactatatatagttttgtgatttttttttcaaaatatctacagctacttgaaatttactctttaaggaaaatctctctaattgaaaagctaatcccaagacgcaacatggttgggccacggaagcaacaccaagtatacccgtccgattcagaaaaggacaaaatagagagagacgatcgtagccattagatgagagaaaaaaatctgcataaattcttcacgaggctttgaggcgaaacgggcaaatggcatgatcatgaacaggaaggaaaacaaaatgagcggcaaaggaaaaaaaaatcctccatggtcactctcagaacctgatccaggcgctactcttcaagagcaagatgacttcaatgataggccggtgaagtgcggcggaggcggcttgatcttcctcatcatgccactgagtctgcctccaccacctcctccaccattgcatccactacggttcccgcctcccgatagctagatagataggcggagcgtgagagataggcggaaatggaaggaaaagcagaggaagaagatcctcacaggctttgctctgcctcacgcggatatatcctgatatcgatgccagcaaatctcgagctacagccaatgtgcttttaggagaaagaaaaaaaaaagatacaacaatgaaagaaagaaaatccagagagaaaatgatgtgaacacactcgcgaagggtggcccgatcttcacgacagtaggttgaaaaccaaggataacttgttgtagaaacagtggg

SEQ ID NO: 30593 - DNA, 8948 bp, Oryza sativa
  unsure (1)..(8948): unsure at all n locations
nnnnnnnnnnnnnnnnnnnnnnnnnnnnnnnnnnnnnnnnnnnnnnnnntgaaagaaagaaaatccagagagaaaatgatgtgaacacactcgcgaagggtggcccgatcttcacgacagtaggttgaaaaccaaggataacttgttgtagaaacagtgggtaactagctttataactgctaaggttggatgcgaccaagcgacggggagagagacaccgaaaccgtgagaacttcgactcgatctccgaacaaccgcaaaaccacaattcggaactaatccacacaatacggtgcagccaaactagaagccgtggtgcacgaactaggggacctcagagagatcttcctcacaagtccaaaaagaactcgcaagaacaaaggggtgtaagacactcaagcagcttggctgaaaaaaacattcaggttatcaaatcatcaaaagttgtttctgaaagcacataaggaatatttatactaggaacaaccctcctagataggtatgaaaagtcttgaaagaaggacatagactagcccaaaggcctcaacaagtgaatttccgagaagactcgcgcgtctgtttggcttatgagtagccttcagtaaaaaaaggtcgttactccttattggaaagtccaaatgacatggggtcagttgcgttggaaagctaacttaataagctttcacaccatgtgcataatgcactacgaaatattatagattgatacagttttgcatggaaagttaaatgtcatggcagactattggccttcggagcagtgtccactaatctggccataactctttagtgggaaatccaatggacgagcggtttgttgggtgtgaaactagactcaataagctttccaaaaaaaaatgctcattcaccttcatagcttttgagaatcaaaagttatgacgatttcttaaactggtctgttttgaagttgaactggtccgtttttcactgtagcggtttgatcttcatggtccgattcagcttcctcttgttgcataatcctaagcgcaaccaaagtagaacatttaggtagtataacattctcatctatagatgcatcaaatgtagcaaggagtgagttcacctgttgttgtagtttctgcgcacgactttgcgtaatcagtccttccattacttgatcatgtgtagcagtagttgaacttggtatagtcatgattgggatgtcctcatcagaaaactggcgactagcaagagacagcgacgcaggtgccgccggagtcagatgatgcacctagctagctagctgctgctggagaatggagatgatcgaaggaaatgaattgagaggatgaataaaagagaggatgagagatggaacagctcaccgctctagctagctgcgcctgcgaccgcctcgtggcttcttactcatgcctctttctcaatatcacgcctataaaataaaattatttatgaaagcacccctaggtaagtattcataatttttgttccaaaaaaccttgacattttgaaatttcaagacatcatattcatagctcaactgacagtatgcataacatgcggaaggacacacctcctctacagtacttccaatgtaatagcagtggctgatacgggagtctgattccatatattagtgtctgcggacaatctcattgatacagtaggagtatacagctatatacaggttttagttctattcatttcatataattatgagctaaatatacgtgctttactgaacatagaataaaatttactataatattacataaaattcaaattcatcttaatttaattttatatgtcactgttttatttggatttgattgaattttaatatttaaaatgggtaatttataaattttactatgagagtaagtggagtaagtggaattttactataaaaatgggtaacgagcgtcactattttctctaaagaacatattcaccactcctaacaggatagttaaaatcacctaaaatgaaatgatgataatccacataacctaaaaaattctagcgattggatcaacataaagaaaaaaaaaggcatgaaaaagcatgctcacgtgtgtagcaaatgcgtgaaaattatttctatatatattttatatttttttacatgttctcaaataatataatattattaatagattttcttacactatttatagtaggatggccatagtcgcgtgaatgcgcgagtacaaagactagtatattgtgaactacttcaggtctaccttgtttggtttgaagcaatcagcgactcaaccaaatctttataattttaatgaaatttgattattaatataaacactattaatattgagtagtaaagactatgatgcttcctcattaaatgagagattgttaggagtgcatagatgatttaagatcaatagtaaaaagataaataaagatggttgatgggatagacaaaactctaggaatacttacatttcgatacaaattttaaagactatgatgctactaaaagaatccacaatgtgtgttttgtaggtactaattaagaaaatctttttcctaccagccggccgtatatattgggcggcatgggttatacgaaaaagctaaaataatcgttcttctcttgtgatccaatgctttaaattagtaataatattatttttaattgtttacaactgaagaggaaaaacgagagatcgtaagaggcctgagttcaattntttgtttagtacaactgaagagagaaaaaaccgtttacttttttcacattgtacgactttttaaaaaaatacattatcaatcattttccacatagtgccacgagaaaataactatacattgcacgaatcttgctttgctaacccgcttttctttgatgcgtgtgctattacctcgcggggaaactatacaggacgttttttcttctatctaatactccaacgggtttcaaaaaagaaactatatacggacgcccttaataatggcaaagttgacacactgttgcgacagcaaacctacttgcctgctactaccctgctactacgtatactgtactgtatacgtatatcaccagactgtagtctgtttattaatccgcacaaaaggaaaaggaaaactcagtcggccacacaccacgtagcgtcacatcatcctcatgtaacagcctagctacctcacacgacagtattggttttccggccgttttcgatcgcctgacgcccaggaaaaagccgctattcctgtgaggccctgacgccgaccgaaactccggtacagcatatgagaacaaccacctaaccacccttcatccatccggttaaggcaatcatgcaagaagcaaacaaaaaatccgtttatgcctctgtttaaattggtgaatgtactgtgatagccagctattaaactaactcatgccgtaattaatatgggacaaattaagtatttcatagaaattcttatatattttagtttggaataaatttaagtgatagaagtccttatatttgttcacaacagcagacgacgtcacaacggcagctaatgcttctttcttttagagagagagagcggcacagcggctacagctagtgcgagccacgggtgcatatgcgaccgagctacaatgccgtcgaattcagctcatgtttccttccacctttttaatttctttaatttgcatgtctctccatcactaccaaattcggctgatcattcatgctttccattgatccccttctatatatatatgtatgaagtgtgcgtgtgtgagagagtgtgtatgtatcagtttgattgcatatgaaatggctgcttcatcgctcgacgccgaggcagcagctgcaggccaacaagacaaggccggcagcggcagctacaccactgcagccactgctcatcaaatagacacaggtgcaagcatatccatggtgatcgatgaacaaaccagcaattcttgatcttatccgttcgatttatagcaacaagaagcatcaggatccacgcattcttgacacatatattgaattgttaattattgatcggttttagtttaatcgttggacatgtacacatgtgcatgcagattcatggaggcaggtaggggtgctgctggtggtggggttcaactgcgcctacgtgctgagcttctccaacctgatgatggcgccgctgggttgggggtggggcatcgcctgcctgctgttcatcggcgccgcctcctggtacgccaattggctcctcgccggcctccatgtcatcgacggccagaggttcatccgctacagggacctcatgggcttcgtcttcggtgcgtttcatgtcagagaaattgggttgattaattagtgagatgaatagatgattaagttagctggaggctgaaaatgcagctgacgaaccttgttaatttacacggttttgtttgttttgtgaagggaggaaaatgtactacatcacttggttcctgcagttcatcaccctgatactcggaaacatgggcttcattctgctaggcggaagagcactcaaggtacaaaatttgctgttaattgtatcgaatatccgattagctgtctatctatgaccaattgtaagctcgcagtttagttagccgatttagttattcatttttttttcactgcaacctgcaggcgatacatgcggagttcagcagcagccactcaccggcgaggctccagtggttcatcgctgcaaccggattcgtctacttcgccttcgcctacttcgtgccgaccatttccgccatgaggaactggctggccacgtccgccgcactgaccgtcgcctacgacgtcgccctcattgtcatcctaatcaaagacggtaatcactaatcactacagtatagtactacatgtctcaagtattctctgttgcggtgctctataatagtagaaaacaatctaaacagttaatcttatttgatcaaatggttcatatttacattatcaccttattagttagtaatagaaacatgaagagatattattatctaagaaaaatatgtgcggagagatataattgtcattagcagtgactaaactacagtaacataaattaattatagttattactattattaatcatggattagtaaattactaatttacccctaataatactctcagcagagaacatcggagtattaatctttgatttgatcatacatgttcatgcagcatctgatcgatcgaacaggatttatatgttttttttggtttcgcatttagggaaatcgaacaagcagaaggactacaatgtccacgggacgcaggcagagaaggtgttcggcgcgttcggcgccatcgcggccatcctcgtgtgcaacacctccgggctgctgccggagatacagtcgacgctgcggaagccggtggtgtccaacatgcggcgggcgctgctgctgcagtacacggccggggcggcggtgtactacgggatcagcgtggccggctactgggcgtacggcgccgccgtgtcggagtacctccccgaccagctcagcgggcccaggtgggccaccgtcctcatcaacgccaccgccttcctccagagcatcgtctcgcagcacgtacatatatcatataccacattcttctcctcctccccgttgatggcgtgagagctcagcctagaacaaattaattaagctttaagcggattgatacattttagaaacgtggagcaaataatccatattaacaattcgacaaataatatgaaaagaagccataatgatgtagaacgaaaaaggtgtaagattggttgagtattattcactaaaaaaatttaaaaaatatttatttaatttttaaagcattttttaaaaaaatattttcacaaaaaatattgtttaacggtttgaaaaatatgctaataacaaaattgtagagtaactaagttgaattttagctctttagggtagggcgtttaatttgccgtggattaatgcgtgcgtgcgtgcgggtggcgcagctgttcacggtgccgatacacgaggcgctggacacgcagatgcagaggctggacgaagggatgttctcgcggtacaacctcgggaggcggctgctggcgagggggctcgtgttcggagccaacgccttcgtcaccgcgctcttccccttcatgggcgacttcgtcaacctcttcggctccttcgtcctcttccctctcaccttcatgttccccagcatggtcgtcctcaaggtatgacgacacatttctgttgagaaattgatagcactataattctatcaagatcatgatggatggatggatggatggaatggtgatgtgcagatcaaagggaaggatgaagcagggagatggaacaggatttggcactggggcatcatcgtcgcctcctccgtcctcagcgtcgtcaccaccgccgccgccgtccgtctcatcgtccacaacgccagcgtctaccatttcttcgcggacatgtaatcaatcgacgccggagattaccatttgcaccgtcgattaccatttgcaagtgcagtgtgctgtgatcagccgggtttagagctttgcattcttccattaaggatgagattgcaagcgcagcgctgtgattagcgggtttacagctttgcattcttccgtaaggattatatcatctttgacgaacacattggacctaaccaatgttaagctatgccaacctattacacttgacgccgaacacgatattatttttaccgaggacggcatgataccagtgtaacatagttgaggcaatttgcaggtatgccggcatcagaacaaaagcaggggacaaattcactagaaaaaatggcaccaaaaaaagtcactttcaatcatatacgaaaactgcaaatctttacaaaaacgcatgaataaacaaacaaatcttgcatgaagacggcactggaaaacgaatcctctaaaacttatgtcggccacggtgacgaaaccaacatcgcgatatgtacaaatgttcgactaatcagacagactcctgttcgatccatcaggatttctccttttctttcttttcttcaattcgttagaatattttatcaacccacttcttgcactggagttcggatcattcctagtgggtttcaatacttgagacatcccctgctccacaatcttggagcagtggattgctggccttgcgatccttgtcgatgcaaacccagtacttaacgggcttgtctgcaagccgttcaaaggctttgcatggattgcacttgaagcatccaatacaatccatcgcccaatgtgacacaaggtggtctccagtatgccacccattcgcaaatgatccaaactgccattgctagtatagctttattcttgtggagattggactgcgacatattgggcacgattcgaggctctgcccacaatcacagcaggtctgcaaaattatatactttgttagaaaaggatgctgacgctgacgtttcaacaagcccacaaaagcagaaaatgacacccccaagaagcaagaaaacactgaatctagcaagagggtgaatgtctcacctggtgtccgcagccaaacgccatgtctttggggttcacaaggcagattgggcaaacctacaggagaaaaagaattatttaagacacaaaattatgcaaatgcctgccttaagaaacaagcaacagatagcatgttgtcaccgcacgcgaaggtatacctgattgtcataagtagaagaaggtacagcagggctcgaactctgtgcagtttcatagtgaggatatgacgatgatgatgtactactctgtgggtaggtacttggtttactaaagctttttgatccatacgagtaagcatcatggcttccaccagggggagggagaggaaccctttcaggcgacttgaaagagcgacgactgatgccacatcaatattaattttagtcagaatactacagaatgaatcaataattcaacagatcaaagcattagagtaataacgtgttaggggcgtaccctaaaattcctaattcaacagttgctttgtattgctgaggtatctccatcaaggctgaaagtgcaaatgctgcctctttccttgattggggcatgtttttgttcatgatctccgaaaaattcacaaactacacagataatagatcctcagtaaggagtaacaaaaatttcatctaccatatacaaacatgcctacatgggttcattagggttctcagtgacttacttgaaaattgtcaaaagcacgagaaggaatgttgtcgtcaaactctttcatcatgtcccaagggccatcaccaactcctactagcacaatagacaacggcaattctctgcagacgaaaaccagaaagcaaaacatcagcaacatccatgacagaggcaacgcaaactatgtgaacatataaagtaatcgccacaaaaacaggagtcaaaatgcatgggagttacaggcggtatgagcatatcaaaacaatgtaaaaaaggaacttatgaagtacgaacctagctctcacaatagcatcaacagtcttttgctcttgtgaactcagctgcccagatgcagtgtctacactccttgtaacctgtgataatatgacagctaataaggtataaagaaaatgaatgtctagtcgttaggttggtccaacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcg

SEQ ID NO: 30594 - DNA, 813 bp, Oryza sativa
  unsure (1)..(813): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcctggtgaacctgggttgcgccacgggccacccgtcgtacgtgatgagcagctcgttcgccaaccagaccatcgcccagatcgagctgtggaccgaagcggtgaagggctcgaacaagtacccggtgggcgtgtacacgctgcccaagcacctggacgagaaggtcgcgcgcctgcagttgaagaagctgaacgcgcagctgaccgagttgacggatcagcaagccgcgtacattggcgtgagcaagcaaggcccgtacaaggctgaccactaccgctactaagctgtacccgccggcggcaccccgccgccggcattcaacccgaggactccccatgagactgctcgccgtctgggtcatcaacgcgctggcgttgctacttgtcgcctatctgctcaaaggcatccacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30595 - DNA, 389 bp, Oryza sativa
ccgctcggtgctgcggtggcgcaattctacgcaaatgtggtacatgaccggctgcgaccatggaaattgctcgctggagatgaattcgaacgaacgattacgccattcccagtactcggcgatcacctggtcaacgttgacgcccagcgcgccgccgctctgcttgcaccaggcgacgaactggcccggcgacggcaggaatgggcgctcctggcggcgggcaatgcgcatgccggcatcgacctgagccatggtgtggatcccgttctcctgaaacgccagcagccactgacggcggaattcgttcaggtcttcctgggtgcggaagttcgcgcatgctggccgggaacgcggcgcgcagcctcgttgaacagcttgttgaatacctg

SEQ ID NO: 30596 - DNA, 1503 bp, Oryza sativa
cctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcattgtatttgctgcaacgcttcaccctgccagcctccgactcgtacatattgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggcttttgagaacacactcatgcttcactctcttgcggtagatacccctgcctgccttatcttgacatagtatctcaaacctgtgcttgtgggtaccttgcactagagctcgatgtttcatagccttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccattccagttcttctaaccaatgttggactatccgttgggagagattcaagagcttgaggagggtcagcaacggcggtcgatggagccgctgcacgctgatcactgcatttagctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgcaagaatgtcccatcaatgcagagaacaggacgacagttcacgaatgccatcttgcatgcatgtagagctaagaacgccctttacagcacactcttgcca

SEQ ID NO: 30597 - DNA, 1972 bp, Oryza sativa
  unsure (1)..(1972): unsure at all n locations
catgagctccttgttcttaaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgcaagaatgtcccatcaatgcagagaacaggacgacagttcacgaatgccatcttgcatgcatgtagagctaagaacgccctttacagcacactcttgccaggatgttcaattgaggggaatttcttcacttcgtaagagctcccagggtttctttcctcgataacatcaagcaggcgtggcaaattgtcatatgaggctttgtaagttccaaatctcatctctattattttctgtttggccctccaggccttggcatagctaatagtatacttgtatgtctcttcaatgtatcggattattgaccttggttcatatgtgagattatcgatgacatgcgcatacatctcagatgcaacccatgcacatgtaatgctcctgtggtatttctgaacaccaggtagaaaacatgtatgcttggtaacaactgacactgtccaataattcttccatttccccttatacgcgtgcactctccatggacaacgatctttttccttaacacaccgaacttcatattgcgaccggttcgactaggcaacccaaaactctctatgaagagacactgcaaaatgttttaccagctccttcatatcttctnctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactgtcattagttcccaataaaaaccctcagttgcccgacttactaaaacattgattgttatgtcacttgtctgtggatcaactctcaagcccctcattaaccatccttttatagaaggtacactcctctcagccggtctatcaattcccctttctgatacaatgaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttcttgattagtacaactaaaaccctaaaaatataatgcatttattcaaacaaatttttaaagaatacacactatttaactcaatagtcacatataggatataggatctatgaatattacctgaaatcggcgtctgaatccggcagggcttcgccccttcttctcttctcctcccctctcctctttttttttttcactggaat

SEQ ID NO: 30598 - DNA, 1994 bp, Oryza sativa
  unsure (1)..(1994): unsure at all n locations
agggttttcctccaaaaaaatcctccctccgtcaccgcccgttctttcccgtttgccacgtcagcttgccgccctagaggtgggtggcaggggctatttctgcaattttttttggtcgatagattatttctgtaaatattaaaaaaaaatctaaaaccgaaaaaaattcgtctacaggccagtacagttatgtttttctttttactcttcttcagacgatcgatagattaacctgtgcaaatcgattcccacgtgcacaacttgcaaacgagttttcacttctcggtttctgcatgaacacgtctggtcgcctcaccgctgcttatcctctgcctgattatgcaagagatttgggcatttttctgacgttgttgcacgttgttgcgcgccgcgagctagctgttctcctctcggcgtgagggccacgtgaaaactcagccgcggcacggcacaaaaccgagcggaatgttgttcaccgtcgcgttggccacagaccatgccaaggtgtacacgtatacgcatgcatatggatggatggatcgatcagattcagagatcgagatcgcctgcgttctgcgagatggtggggagggtggtgaaaaggccgggggggctgaaacgaagggaaagaatgacaatacaggcttgcagcagagataaggatacctactgtggataaatacacagaatatacacgtcgacgtgaccggacatccgtcgcctcttcttgctctccctagcgtgggccccactgccctcgtagctacagttccgcgccggcgcaccgcctcgatctcatctcccctcacttcggctccaggcccaagcggccaagcccaagcgcggtgatcttctgcgattactgtgcatgttgcattgcgcgaaaaggaaacagctgcctgggatcgcatgcttgggtagcataggaccgcataatcttttgaaaaaaataacagccaatttttttatttaaaacttatttttgaagttggttttaaggtgtttttaccatagtttattttcacttacagtattggttttcaagttgctagaaatatatatatgtacataaattttatacacaaattacattttattactaataagccgttatggcttaatcaaattttagtctactgataggacagatattagcactagcccattttacattatatgtcttgaggaaatctttgagactggggtttaaagcacttttagacttgttcatgaaatttagttacatgaaaaagcttagccaacacggacttgtttacgaaattatttgagagcataaataaataaaatacatagtcttataggaaatgcttatatatacgagtacggagtatgcaacaacttcctttaaaaaaaaaacagaatcgctccggagacctcaacaatatcacagtaacaaaagaaagattagagaatatctataactaatataaatattcgtattttttcgatcgtcacatctaattttcgtccgtttttcgtccatacaaaatccgattcggttagcaatagccaaggaaaaaattgcaaaaaaaaagaatcggcggccgccgacgccactgccaccgccggagggagaagagaggcggcggagggagcgccgatgccggatccgcccgcggtggccgccaccgccaacggatccaccctcggacgaagccgacgccgtcgtcgccgccgttgagaaggcgccatcgccgtcgaggtcgacggggagagggagagggatccatccgcggccaccgccgacgccgccaccacccgccgccggatccatcgccgccggatctaggtcgggagggagacgagaggggaggagggagccgccgccggcggcggcctgcgaccgccgccaccgccaacggacccacccgccgacgccaccgacaccgccatcaccgccggatctagggcannnnnnnnnnnnnnnnnnnnnnnnnnnnnnnnnnnnnnnnnnnnnnnnnnnnnnnnnnnnn

SEQ ID NO: 30599 - DNA, 5708 bp, Oryza sativa
  unsure (1)..(5708): unsure at all n locations
aggggggcgccgccgccgtcgctttagagaggggatcgggggcgccggtcgctgctccgcgccgccgcagccgctcgaggaaggaggggggcgccgccgccgtcgtcgctcgggaggggggaaatgaatcctagggttagggttagggtttgggtgtatttatttaggttaggattaatctggaccgtccattcgatccgacggctgtagctgctcccacgtcgggccgccggcctattgggccaccgaatggaggacgtaaaatagacttcaatggagaagaaaaccggccagacacatagaataaaagggagggaatataaacttttctatattcggcccaatcatagaaaggaggattttgattttttttccaattaaataattgttaaatgcttttttattattaaaaattagcaattaagctatgataattccaatagaattccaaagagcgtagctaatcatggaaaatttaataaaattaaatttaaccatgtcattttatttttcacaattgctttacttgtaaattgatttaattatacacctacctatttaaaaataccaaatattttaattaattacataatgtaaagttttcttaactttttctcaattttttttctgtacacttcctgttgcaacgcacgggcacctttgcttattttaattaattacataatgtaaatttttctttaactttttctcaatttttttttctgtacacttcccgttgcaacgcacgaacacctttgctagtgtatatatatatatatatatatatatatatatatatatacatcgtgggtaagtcaaaattacaacccgtcaacatatacacacatatattgacggggttgtaattttacctcgtttgcggcccaacttcgtcaacatatatacacacagcacaaaacattggcactttgttatgggggtacaacattaattaatattgtctcagcaacgtttcagcttttggcccattaataaattaggagcaatattgtaaaaaaagttatatttagttttcattcaactcaattatattcctacttaaaaaatgcacaagttttttctaacggatggagtatactctttatattataaagacaggtgaagaaaataagtaccaagttagttttagaggaccatttattttagaaagtttctttcattccttatttacaatgtaactagcatggtgacccgcgcagattgcccggctagcatcattatattttctttcatataatagtatatatgttttctcattatattatttaaatatattaaaatgacaacataattttaaattttgcaataactttacaaaactactaatgtgtaatattcatattatattttatatacatgttagttattagtttttttaatatcaaattttagttatttgtaaattatatatattcctatatagactctagactcttcttttaatatttttttttaattctgaattttctgtaaattgtatttctatatagactatgcacttcttccaatattatttatttttatttctgaatttttattatttctagttgtacttctatgtggactctaaactcatctttcaatactctttaatttttaatttcaaatttcagttacttctaaattgtattcctatatttgtatttctatattgaccttaaactcttcttcccatgtttttcttaatttcgaattttagttatttgtaaattgtatttttatacggactctaaactctacttttaattttattatgtttattctaaattccagttagttttaaattcctatatgaactatatactctacttctaatatttcttatttttcttaattccgaatttctattttttttcttaattgtatttctatatgtactctatactctacttctaatattccttatttttaattctaaatttatattatttcctaattgtatttctatatggactatatactctacttctaatattccttatttttaattctgaatttcagttatttcctaattgtatttctatatggactctagtctcctcttctaatattccttattttttaattctgaatttcagttatttcctaattgtatttctatatggactctagtctcctcttctaatattccttatttttttaattctgaatttcagttatttcctaattgtatttctatatagactctagtctcctcttctaatattctttattttttaattccgaattttagttatttcctaattgtatttctatatggactatatactctacttctaatattccttatttttaatcccaaatttatattattttctaattgtatttctatatgtactctatactctacttctaatattacttatttttaattccgaatttcagttatttcctaattgtatttctatatgaattctatactctacttctaatattccttatttttaattccgaattttagctatttctaaattgtatttctatatggactctgctttttctttttctccgattaatatgagaatttctagtccatgagagcgaacgtggaggctcctttttctattcctttaataataattgtatttctatatgaattctatactctacttctaatattccttatttttaattccgaattttagctatttctaaattgtatttctatatggactctactttttctttttctccgattaatgtgagaatttctagtccatgagagcgaacgtggaggctcctttttctattcctttaataatataatagatggtacggtagttgaaaactataattacgtaattaagagttcgctaaaataaatcccatgttgtagaggtcaggataattatattgtattagaccattcccaacccaaaacactagacatagtttccataaactccacatcatcaagaaactagtactagacattactcttccaatgcaaacaccactattccatacttaaatttaatgctatttatatcacatgatgtcttggatgttgtgtagaaactatatctcatgcaagacatgatttccttctctttcctcatttatttacttgccacatcatttttcatcctaggtgacaacttatttaatgctatggacactatcctagtcattgggttgggaatggccttactccctccattccaaaatagcacaactactcttaacccaaaaaacaaaaaataattattatcatattatagtttgaatgatcctaataaatataatgcatatatccaatatgattagataacatgagagtgaaggatttaaaaataataataatttaatggagaagatgccatagttaattgtatacttgcatgcatgccttatattatggaacatctaagaaaattggttgtgctttatattatgcaatggagggagtgtcttaaaaaatatactccagtttgtaattctaacatattaccatgttaattggataaaaattatatatgttagatggtggtggattgaaattataatggttgatataattatattcgaaacacaaatagcatatgtggagattgaagctataagatgtatttcaaatagaatcctacttaaatctactgtatgcaaatgtatctttggaaaaagctacgaattacattaagaaaatgtattttctaatatacactttctctatcgtaaaatatagctatctatagcatttaaaaattatcataaaatataacaacttctataccaatcacaaccttcgacattcaaattctccacctagtccttcttaaccaaacatttcttttctcatttaattttatctacttttttaatcccttatatccaaacttaaaactttctatttagaatggaggtaattctgtatatagattaccaaaaggtacaagagctaagaatcgtgcatcaaattcacttcggaaaattacataagaaaaacatttgctagtttgttctacataaatctcgagaattttcacaacggaacacgaagctaggagaatttcacattttataaaacttttataaaatgattaaaaaatattgaaaaataaattaaaaaaatctaaagtcaacttcaaattaaaaaattaaaattaaaattttggctaataaacatagcaaaagccgaaagatgagactgaaagctacccagatcaaacagttctatcgctatagaggatccgagcaaaaaacagggccggccggccggcagaagaacacaccacaccactccccagtccccagcccacccccacccccccccctcgtggcactgtagccagtgtactatactgccctgcccttcaccactttcacctccctcctcgagtcttctcctctcgtctccccctctccctctcctctccgccaccacgccaccgtgcttccctcccctttgttcctgtagcgttccgaataaaagcccacctgctttcctttcccgcgaccattaccataaaaagagcttgctcccaccgcctctctctctatctccccgtcgctagctaccagcagcaacaagtacactccccccactcctcccccacacgccgcgtacaactagctaatcagaggagagggagagagagaggggtggggttttgatggaagtacaattctagctatgttcttgatcggggccatgatcgcggatctctagaaagttctagatcttccgtgcgtggtggccgggtgggggtgttcttggtagggtaggtaagtgctgcttcaatggatgaaggaggtgggagtggcgtgggtggnatgcagggaacggcgtcgaatcttctggacgccggagctcaggcgttctaccctgccgtcggcgcgccgttcccgttccagcagcttccgcaccagctgtactgcccgcagccgccgccgccgccgtaccaggtcatgccggtgccgccgccgccgccgccggtgggcttgcctgtaccgccgctgccggcgacgatggcgccgcagccgggctactgcgtgccgccgtccacgacggtggtggacggtccggccagccgcgccgtcgtgctgagcctggtgccgccgcacgcgccggaggacgagatcgcccgcgcgatggctccgttcggtgcggtgcgcgccgtgaacgcgtcgccggtggcgtcagagggcgtcgcgaccgtcaacttcttcgatctccgctccgcaaagcacgccgtcacgggggtccgcgagcagcacatccgtcagcagtgccggctcggccagctatacgccgccgccgccgcagcacaccgctttgtctccgacctggcccccgccggcgtgggactggccccacgacgacaaccgcgggctcgtcctcggccaggccgtctgggcccaattcgccgccgcctccacagtcccagacgacggcgccagccgcggctccctcgtcgtgctcaattccctccccgccatgtccgtgttcgaactccgcgaaatcttccaagcatacggtacatacaccacccccgcacgctttcttccgcgaattcctccatgtttcgcttcttgtgtttccaaccaattcattctcttggtcgggtcgcctcgtcgtgtgtttgcaggtgacgtgaaggacgtgagggagtcggagcaaaaaccgagcaacaagttcgtcgagttattcgacacgcgcgacgccgaccgcgcgctccacgagctca

SEQ ID NO: 30600 - DNA, 2878 bp, Oryza sativa
  unsure (1)..(2878): unsure at all n locations
nnnnnnnnnnnnnnnnnnnnnnnnnnnnnnnnnnnnnnnnnnnnnnnnnnnnnagctcttcggccgccgcctcgtcgtcgagtacacgcgcccttccctccccggcccacgcaggtaaaagaattcaccgtcgtgttaattcccatcgaaaacgcacggtaaaactaatttggctgtggttggcaggcgcgggcacgtgtcgcaccagcccttggccccgacgccgccgaggctgcaggcggcttggcggccggcgccggcgccgtcgcagtctgcgcagccgtcgtcgtctggctccggcaaggcgagggaaggcgtggtgcttctgcgcaggagctccgggaaaggtagctcgggtagccagtccaagggcggtggcaatgctggccacgagcggaagagcaagggcggcaagagcgccgcggcggcgtgttcgacggcggcttcagcatcgtcgtctaccgcaacggcgcccagcaagcaaagccagaaaggcggcggcggcggctgctgccgtggcggtagctggagaggccaaaaaagcgggtgggaggctcgctttctgttcaaagaacccgaggacgaggcctgcggcggcggcgacgctggccgctccgagacgcatgagccggcgagctgcaaggacacgagaaccaccgtgatgatcaggaacatcccaaacaagtacaggtcactccgctagcttccacgttgttgacgaaatgctatatttcatgggcgccgcgagcccagaattgcctgcctcgcattgcgagcttggcactgatgcctgagcttgtcgtctgttgcttgttcgcagccagaagctgctgctcaacatgctggacaaccactgcatcctctccaaccagcagatcgaggcgagctgcgaagacgaagcccagccattctcctcctacgatttcctctacctccccatagatttcaagtgagtcagctcccgatatgctgtatttatattttatggtgcccaatgcaagaacactgcggcacacactgtccacgcccaatgacaatgacggcctccatgcttcatttccgactgagaattcagtcctagaaaactaattaattttatgattcttgaggggaattgtgcaatggaattgcattgccgtgtgaaggaaggacaaaggtatatgaaaggggcttggaaatgtactgggagatgaatgggtagttgggagctctagctgctggtagtgatgtgtgagcttgtggatcgagttatctttgggctgggtagtactagcatgttactgcactgtactgctagtctgcaacacatatggacgcctactctggtgccatggctgtaatagcccaaatggaaaggaaattggcagtccaagggagatcacaccagatccttctcgttttgatgcatcaaatccttttgttgcatgcaatcctctgatcatgagcatctgttcacatgtctacctttcttgcgcacctgcctctaggatctcctgcctgccttgctctctttcttgcttgcttgcgctgtcttgacctgcacttccatagcaaagtccaacgcaaaaaggaggggctagacgtcatggagtagcggtgaaaaggtgcatcaatgcaaaagcgttttcaattttgacatgtagtaatatatttcttttcctgagaaaaaggtatggtgaccaatgcataattaagcactttcttttcactggagtaccaacttttatctttgcacgaaccaagttgagaaaagacctatcaaatgccccaatgactagcgtgcattgtggaatcaaaaggtagctccacaacaaaaatatgatagaaatattgttgtgcaagtttatagttccccgagcttctgacttcgaaggcctcaattccaagaatatttgtgttcttgaccttgacaagtcgtttgttatcattcataactcatttttggtcacccggttctttatcgcttctctacttgttgagaagtttttaaattcaggcattaaattatcttttcggctgtgctaacctgctaaaatatgaggccatgcagcaacaagtgcaacgtgggctatggcttcgtcaacctcacctcgccggaggctgccgtgcggctgtacaaggcgttccacaagcaaccgtgggaggtgttcaactcgcgcaagatttgccaagtgacatacgcacgcgtgcaagtacgagcgccgttaaatctctcccaattgtgctgataaatctagaccgatcatcatgtgtggcaagtgctaaacccgtgcatgcgcgcagggcctggacgcgctcaaggagcacttcaagaactccaagttcccgtgcgacagcgacgagtacctgcccgtggtgttctcgccgccgcgggacggcaagctgctcacggagccggtgccgctggtcggccgctcgccggcaccgtcgtcggcgtccggggcgtcgtcgccgcccaagagctgcgccgcgagcgtcgacccactcgcgcaggagctcatgacagcgccgtcttcctccggcgacggcgcctcctccgcctcctcgtccaatgcccacgccgacgaggatgacgtccatggcgaaaccggtggtgaccgtggcgacgacgcggggctcgatctggagctacagcgcctaggctacactgactagctggcgtctggcggctttgcttcgagaggtggtggcaatgatggtggctacggctgctgcatgcaagcaagggaagtgaagtgaacaggtgatttcatttatggctttaagcagagataggagtaggaaagaactcgagaaaagaagcgatttgatgttattttgagaggnnnnnnnnnnnnnnnnnnnnnnnnnnnnnnnnnnnnnnnnnnnnnnnnnnnnn

SEQ ID NO: 30601 - DNA, 3569 bp, Oryza sativa
  unsure (1)..(3569): unsure at all n locations
cttcttggtcatgcgttcgtttgttacattaattacaacttacaacactccaaatttcgagtctgtgtgatgactgatactagatttgaagagatctcccaaatctttttctcaaactgtcctcgtcggagtactccagtatataagcatttctttatggttgaaggatgaggtagcacgaagaatacgcatattatgggataaattacggattattattagtactttggaatggagtacttgattatctttttggaggattttagcttccgtcctgaaataggagtttgacgtgaattagatgagatatagtaacaggttgaaatggtgttgattgataaattaaatgatagataaatgggatgatgaggtcggtaaaaaaattgatatatttatggataagttttaaacgctaaaaatactatatttttggatgtgtgagtagtattttttacaactgttctgcgtgaaatttaatgtcgtctttaggaattttagtggaaattagtcctacgcaaaatttcttacgtggtcatttggatcgagatgggaaatcatatgagtttcttttggcttggcgttcacagggtttttgaatgaattttaacatgagatgcatgcaattgcttgaataaaatatttgtgattcctgattttttccctacgccctttctaaactatatttgattcaatccatgcatacgttttgggatgataggtactataattcctgtaattttcctattctgtgtctcaaaaatacttctttctgatgaagcagttcttacctaatttgcacgtcccctctttgatgtattcaagtaaaatcgaaggtttttaggtttcatttacaaccgaggaattttatgggaatactacaggaactgaactgatcaacgagaaaattatgaaaattcctctattccaaagacccttgaaataaatcatttacctctcaaacaaccagtaaaaattgcttaaaagagccaacgaaaaattaaaggagagatgaattcagtatctgtgtgacaacatgacagcgagaaattgtgaatacgggacaacatcaaaaccggatgagatgtttttaaatactacggttgcatatctaggtttataggactgtggttgcatgtccatgttcggaggactatcaaatgtttcatccagttctattttttttatatttagaaatatattatatgggcgtgagaatatttttaataggtcttaattttggtgtctatatatcctgatgattttcgtccacttatctctactactaaaggagggagtagtccacgtaaaaatcttataataatcggttgctctaaaaactgtttacttgaaaaagaaaagatcggtgcaaaaccaaatagcccaatctgcttaaatcgtttttaccaaattgaattaaaagccattgtaatgcacaatagcccaatcaacttaaatccttttaccaaactgaattaaaagccattgtaatgcacggtcctgtaaactttaaacatgtatcctgaggacgaactcacaaatatttctttcttctcgcaaaattttcaagctactagtataatctatgttgaatcacatcgtattatatgttgctatattctgaaatggaaggacttatagaccccttttattcaaaggaaattcataggaagtttagagcattttatttctataggaatttttcatgtatagccatttgaatcaaaggaaggaatggattttatagaatcctatgaaatttttatcaaatttttatagaatgtctgataccatgtaagttttagaggaattctaatatgagttagaacctcatggaaactttcctttgagtcttatctctcctctaatgcctacgttttttctatggtcaaatcaaccggttattgctgtgttttttctatattttgcaattctctaatttacatttacatttctattaaaatcctatgtttttttatattcccatattttttaaggtgcccttagtattgccaaattctgacgatagactaaacaagtcctagatgtgatgaatgatatcaattcaatttctcagggaggatggagcactggtcgtgtaataaccggccaatgtatctcgctccgtttacctgggacaacgccagaggcaccacgtgtagcggccgtgcgtactcgcgctatatttcatgtgtcgttactctccccttttcgtgcacggccgagctcaggtggctgcggtgcggggccatcatcccctccctggcctcgcatcgcgaccagcaaccctcccctgacacagcgccgagccgctttaacggccaggcccgtagtcgtagccagccacccagccacggcagcaaacgcacagcggcagctagctagcgctcgcacgccaactcatggccggcttgcatgccccacgacacaaacacacagcagcaacgccaccatctcccgcggcgaaacggaaaccgagccagccacagcccaacccggccggctaccacccgtgtgggctcgtgtcggtcctagtgctttgctttgacccgcgcgtgttctctctcgcaaaccataccgtaggataggaatacgtgcgaagccattttactagtcgtagtactaatgtgtgtgtgtgtgcatgcatgcgctgcgtgcgtgcgtgcgtgggatcgtacggcagatgatagatagattagcctgagccactggcgcgtggtcccccggagtagtggaggggtgcaaaacggctttgccgattcttgtttacacaggtgtgtgtgcgtgtcgtctcggtgatcgatgccacagctgcagcagtgccgagtcgcgatcgtgcagaaggcgaccttcctaaaactaatcgttttttttactggcgctaatgacacaaaaccgatgcactgcactcgtgcgtgcaggcacttcgatttgctttgctactgcaaactactcgtggctttagtaatttgggaggtgaggttagtttatgcagggtcagggtcgtttccagcaggtaggattttgtgcttcgccaaggtgaggtcgacgacgacgacaaggtgagttgcgccggcacacgtcccggtgccgaagtgagatgcactagcacgatcggatggctgaccgggtgcccaaacctgcgatttgcgggcgctttcgggttcaccgaggcagcgcattagtttgcgtgttccgaggcgcctgcgttgcgacccgaaacagtgggggtgctttggcgatccatcgcatcgcatgcaccaacatttggtggcttgtgttggctgctcgttgattgcaaaactgccaagatattaacgctactcgactgtttttttcttcctggggttaagaggtcaggagtactactactagagattgacagggaattgcttgctccgtatgcgtgtgtttgtgcgtggggccgcgggagggggggagtttgtacagccgaccgagacaggagaagcgttgataaatttttgaatatgttggtggtgcgatcaatctaccgagacacnnnnnnnnnnnnnnnnnnnnnnnnnnnnnnnnnnnnnnnnnnnnnnnnnnnn

SEQ ID NO: 30602 - DNA, 406 bp, Oryza sativa
  unsure (1)..(406): unsure at all n locations
nnnnnnnnnnnnnnnnnnnnnnnnnnnnnnnnnnnnnnnnnnnnnnnnnnnnnnnnnnatggagtatactctttatattataaagacaggtgaagaaaataagtaccaagttagttttagaggaccatttattttagaaagtttctttcattccttatttacaatgtaactagcatggtgacccgcgcagattgcgcggctagcatcattatattttctttcatataatagtatatatgttttctcattatattatttaaatatattaaaatgacaacataattttaaattttgcaataactttacaaaactactaatgtgtaatattcatattatattttatatacatgttagttattagtttttttaatnnnnnnnnnnnnnnnnnnnnnnnnnnnnnnnnnnn

SEQ ID NO: 30603 - DNA, 483 bp, Oryza sativa
accccatggtagcgtcacttctcttcccgcctcatatgcagctggcccgcattaatccaacggctaatgatggctttcaactctcatgtcaaaaaaactttgcaaaaacacccttactcttactctgatctccacaatttccagcgatcctgtaattttccaaaaacacccttgtctaaatcgcgtattactccccacgaatccgtctctcctgagccaaccaccgccgaatgccgcatctcccgacatccggctcccgcgaactcatcccccctttccacggtttccgtcgatcgaaaccctaaccctagggtatagagaggatgaggccctcggcggcggcgggcggcggcggcggcggcggcgggaggcggaaagcggcggcggcggcggccgctttgagccgggagtggctggtcgtgccggcgtcggggcaggcgcgggtggaggaggccgggaagcacgcggtgatggcgcggacgg

SEQ ID NO: 30604 - DNA, 5776 bp, Oryza sativa
  unsure (1)..(5776): unsure at all n locations
accaagacaaagtttattagcaggtgcagatagatatggagaaatggtccaggataatgcataggcagaacaatagatgatggtttacttctatgtgctgaccgtgttaggggttatatcactaaatgtcttttcttctttatcaggctgcagaatttactgatatggaaggcgaatcatctgcagttacttcaccatttcctgctctgacttcaaccacaccaaatgaattggagatgactaacaagaattccaatgtggtaggcggaatgactcacagcaacagtatgcccacattgactgctgcaaaagatggaaataccaaagttttacccttcgatttccgagcacttgaagtgtgccttgagtcagcctgtagaagcctagaagaggaagtaagtgctttcccttatgcaatcacctgtatgtaaagtttggtgaagttttagaatgcatatatggaactgaattaataaaaagctttgatacatttttcggttgtttggtaactaagtggtcattgtttttacatagaagattagataatttatcttcacatgtgctggttaagtggttattaacttgaggccaagcccttaggagagacatatagaaatttgatgaagcatggttcttcaaattcgctgtgaaagaggtgttctgaaccttagttatggagaaactcatgcatcttatgaaaccagacaacctgtaaaacatagcctacttgatgtttatagtgtctgacctttttcctccttcagacgtcgactctggagcaagaggcgtatccggcacttgatgagctgacttcaaagataagcacactaaatcttgagcgagttaggcaaattaagagccgcctggttgcaatctctggtcgtgtgcagaaggtaggaaattgtaccttttcaatcacacttcatgtcacctacctgtaggttctttcgttcttacctatgttaaatcttatttatgttgctctcatggtttggagataaacactgagtgtgtatctgatgtttatgccatcaaacatatttttttgatcaagtgcaactgctaaatgtgtgaacttcctaattggtcaggtgttattaaacatgatttttttttttccttctgctggctgcaacactacttgtttaaccttcatatagttgtgtgaagtacttcccccacaccacttacacccaaaggctaaatacaacaaccgcagcccacaacaatcgcatgcatgtgcatgcacacacaagcatcggtcttttgttgtcctccatagtttcctctcaagcttgcttgcctttcttctgaatattatttccttcaacattctctgaatgcattccacccttgttaaaatatttatttcttataggtgagggatgaacttgagcatttgttggatgatgaaatggacatggctgaaatgtatttgacagaaaagcttactcgacaagaaataagtgagacttcatctagagttgaggttgatgacccatctcaactggaggtggataggtaagtcatgagagcacaacatgtctacattttccttgaaagaataaaacaggatgtatttgtgtctcttccacccataatcagccattgttgtctctgtgtatgtataattttatatctgtgtagggatgaagattatagaagtgaggcagatgtaagcaatggtacctttattggctataagccacacattgaagaactggagatgcttttggaggcctactttgttcaaattgatggcacacttaataagctatctcatgtaatgactttgcctttccctgttccttgtattgctccaaagtgttcttacaacctattatttgttgtcagcaagtatattaccaacgaatctacaattttataatgttttatgcatgttatgttgggctgctaggaaggttgtgcgttgcgtttcatggatccattggcatttgctctgtttttttcctgatttcatgggaggttctttacaatgatttattttgattctcctatatgagcatcgcatgcaactgtgggaaactggtccagggagttgtgcagttgagggtttataaaccaaattcatgttgttttatgtgcagttgagatttgacgtttcttctctatgcttgcagctgagagagtatgttgatgatacagaagattatatcaacatcatgttggatgacaagcaaaatcaacttctacagatgggggtcatgctctccactgcaactgttgtcattactgctggagtggccgttgttggtctttttgggatgaatatcggtatatcgctttatgctgatcctacaaatgaggaggagaaacgagcatcaaacatgaaattttgggaaaccactttgggaaccattgctggctgcacggttatgtacatagtagccatgggttggggaaagagaagtggactgctgcaataatgagggtgccacgatgaatcacacaagttgacgattgctagcctggtcagacaaagctctataaccaagaagacaacatagggctcgactgtatacctccttgaacatatataactgttgctctgatggcttgcatgtgcaaggaacagagatgaaaaggaagcgatctttttagcaactctgcgcggcgatgcatgatgtaactgagagatgtataacaatgtaactcggtttttgatatttcggatggttgcacgattgcttgtctgcaagccgtcgtactaatagtttgtgctgttgtcgtatgtatctgtaagcttcttggaagctgtaaatgaactattacatcatattcataaggaagtactaagagcatgtcttatctgaagggttagtatgagctgtaaatgaacatgttattcatagggaaatactaagaactgtgaatgaaacatgtcttatggtcagggacttagtgcttctgtgcttgcactctgatcgttgcttagtacagtacgtactcgtcaacaggtgcataagttagagataaatgatgtctttttggacgaagataatatccatttaatacggaaaagctaacaggtgtgatttgtgtttcttctctatttttaaatttcgatttgataatggcacagttttcgggtcttcggacaaactcacaacatcatgtcttaggtttattttatgggatgaagagagtataagattattttgagagagagagggacatagagaaaaatccctcgtttctcatgcatatttttcccaaaatgctaaacgggtgttttatgaaaaattatcctaaaaatcatattaaaatatttttcaagtttaaaataattaatatttaattaatcatataccgatcgtttacatatattttcgatattttcttctcctctcacacgcagaactagcttgatcggttggtcccaccagttaacgaggcccatttaaaaatctagcgaagttgttctcggcccgctcagcccaagagagtttgtacggccgtctcctattggtgaagtctgtgtgtatctctttctcccccttccccttgtcccgaagacgccgccgttgccaaatcccaaatccgccgcggagcgaaagggtgggagatcggaggagaagaaggaagatggtgaaggtggcgacctacttcgccatgaccttcggcgcgttcctcttctggcagtccatggacagggtccacgtctggatcgccctccaccaggacgagaaggtaacactagctcctgccctaatctatctttccccactaaattcatcagtttggcatgttagatctaggcgttgcctgtgtgtgattgggccgcgtgggtgttaggctgtgctgggggttgccggatccgtcctgccctgatgaaccgcggatttttggagatgggttgttctagttttagggttcagatttgacgctttggctctctgcagtgttggtggctgtgctgcactgtcgtggcttacattttttttaaaaaaaaatgaatacatctgaaatgaaacatggagagttgtggtaatcgaggaaacaatggttgcatctcgcatcttaaggcacaccaggcacacaagaaaatcaatttatgcactagggaatcacagcgtagcagaaacgcctgtgaacccaatatgattatgttgtgtggattaattgctgcagcctgcaaactcctgactgttgtgcaagttaatactcagtgccgaatgctgtacaccctgtggttacagaggggttcatattaagcgtaaattgcccaaggcaactagtaacctgtttgacacattagatatggttatattcatttaattatgctgggctcctcctaaggtagtaaggttgaatcacccaaggttggcttataacctatgtacgaagtctaggatcagtattctgttttgttgatttcttcatttgttgcatttgtctcacattaagggtaattgctcatgaacaacttgctatctatttgcaaaaaatagcacatcagttgttttttatgtactccaccagcactgtgatgctgcgattgatcatcggtctatcaaaattgtcttgggcgtcaggattgttaccaaactccttagaaataggaaattctgtacaggtagaattcgactttgtatgcatgttcacattcttttggctcctcgtttgctagattgctcttgagacaagtgaacattaggtgcctaactactgtcagaattttttaaatgctagattgagacaagcgaacaagttttggtgttctgtactcctatgtgctcttgagacaagtttctacctgtccacccatatacacacccaccaccgaaaccacagcgactgaaagttggaagtccgtgtgcaaattgatgtgttttgtgcatgtactgtgtttgttggaatatgctgaaagtggttttgttcttgcagaaagagaggatggaaagggaacaggagataaagagaatgcaagctgagctaatggcccaagcaaaggagagtgaatcatgattatcatttggcaatggttttagtagttgctttgtcaaatttcttccttggaatgtactttccaagtgataatgcttggctgatgtattctccacagctccaataaacaagagatcttataactttttgtcaaatgcaagcggctaagctcatgatgagttatttgcagtttgtattatacaaaagagcaaaacatgcagctccatttccatggtttggcgtgatgtttagtatcgatttcatagatgtttcagctggtcagtctttttggtgaaacaaatgtctaatgtttagaacaagatgcgcatcttttggttgcctttctgcattattattgttctaacaaactatatgtatttcttaaaaaccaaatatttgcatcgtctttttttcagctcgctgtgcccctttttgaactgttttcttttgagttcgtcttctttctttcgtcactgcatcatgtataaattgtgtgctttctgttactcgagttacccaacttacaaaagtgaagtaaagaaacgacaaacgattgaggcctgatctaatgtttgtttatcaaggtttgttgaaaaccagcttggatccttcatgtttatggtttgagccactaagtaatgtcggtttgaggcactaatgtcttgcatattgtgttcagaaagccacatgttgtgttgaaggctttcagattgagcttccaagggaagggcataaaaagtctatcaatgtnnnnnnnnnnnnnnnnnnnnnnnnnnnnnnnnnnnnnnnnnnnnnnnnnnnnnnnnnn

SEQ ID NO: 30605 - DNA, 1926 bp, Oryza sativa
  unsure (1)..(1926): unsure at all n locations
catcatcgccggcctttgccttcgccttcgctgccgccttctcctcctcctttctcctgaactgcctgcaatacacaatgcaaagatttttttttcccaagtcaaaaccagatcaatgtaagctaattgaatattacgcatacgcatttagactttcaacgatattttagtgagattagatgatatcgctagttttcatcttttcaagcgtatgtttaaaagacgcatttatgggtgtgtgagtgtgacattgtgatcactcacatgcagagaggggtgttgcagtggccgtcggggaggtcgcagagggcggcgtggaggcggagcagctgccacatgcgctggcagcgcgggcagctggtgcggtggcaccgggagaagtggcggatcagcagctgcagtccccggcacgccgtcgcgtacgccgggcacggcgccgccgccggcgcacgccccaccggcccgacctccgtgcacccctccgtgcagatgtggctcaggcagtccatcgcctcgctcagctccacgtagaccccttgctccgcccttttcctcctccacttcctccgccgctgcaccattcaatcacaccggagaaaaaaaaaatcaaccaccatgaattctagtagtagtaaaaaaaatactaaaacaaaaatcatgcgattttatcagtctatttcagagattattggtcaattaagggcctgttcactttaatgcaaaagaaaaaaacattaccaaaattttggcatagttgtcaaaattttggtaattggcaggatttcttatatagttatcaaaatttgacagcaaactaaatgtagccacaattttgacaactttaccaaaatttggtaagattgaaaatgacatcaaagtaaacaggtcctaattaggttcttgtcaaaatcaaaatcattcgaccataacaaaaacgtttaggatcgggaaacttcgagacggtaagccgttcgaagtccattcaacgtggttggacagaccaaccggaccgacctagcctcccccagatacaagaaatttctcattcaatccaccaaccaaccacaaaacgcaaagcacgtctcgacataaaatgtgtgcacgagtgcgacacggtggcccccggctattccagggacttaaggctcgaaagatcccagtaaaacacgctcaaaatcatgttcccctagtgcacgacccactgtgcaaatcctcccatgcatttcggtgtcaatggaaccgtgtgtcacagagccatttacaaaagcgcccaacatggataccccacaccacatcgagtgcacaattcaaagtttgaattttttttgtgtgaaattcctgtaaaattctaccatgttgatgaacagcgataatgatgtataccaggtcggcgtcgtggagggactggaggatgtcgagctcgagccaggggtcgttctcctggaggaatcgccacgcctcggtcttctccacggacttgaactccttggcgagcagcctggtgcagcgcaggtgcagctgcggcgcgtcgcacagcgccgccagctgcatcgtgtccaccaccgactccgccgtgagccgcgacccgatcgccccctcgcaccgccgcttcagccacggcacccggtacgcgtgcgccagcaccagcatctgcgccgcgctcttctcgtcaatctcctcctcatcaccactgcacaattagttaacaaaatttacacagtattagcacgtctaatatgcaaatgtttttttctcaaatatttctactacacgttttgtggtccaagttacagaaaatcacatacactttgacacttggcacttgagtacatatattttggatgtgtagtttcacaaaactacattatcgatgtatnnnnnnnnnnnnnnnnnnnnnnnnnnnnnnnnnnnnnnnnnnnnnnnnnn

SEQ ID NO: 30606 - DNA, 10425 bp, Oryza sativa
  unsure (1)..(10425): unsure at all n locations
catcgcacgaaattaatatgatgtcacgtcctcatcttagatggaacaaccacgtcatctcacgggtggaacaaccatatcatctcacgggtgaatccattcatcgatagtgtggttttatgaaactaaactaccgaaatatatgtacttaagtgtcaagtgtcaagtgtcaaaatgtgtgtgattttctgcaacttgaaccataaaacttctacttttgtgaaatttactctattactaatgttgagaaaggcacgaaagtcttcattcgtttcaaacggatcgggacactgggacagtttgggcaggtccctacctctgcatctccacacacaaaaagagagttctttttttttttaacaaaaaccaacacgagatgatggctgaggcggcgagcggtcccggccctgcaagccgcaccagcgacagcaacgatttttcttgtggcgccgacgagatcggctgcctgcttggtgctcgcctgcaaggggagggttccaactaggcaggcgctaccacaccaaactccaaaccaagcggcggaaaaagaaagccaaaatcatcctcttctcgacttctcctactgctctagtggtctagtacttatcgttgcttcgctttactactactttttctctctttttttttctctgtctgtgccgtccaagtcgacgcgccgaggcaaggcatggattctgctccacgagatttgtttacggctctcggagctggagatggcgatgtttcgatgctctgtttgtgtcatttgtgtggggttgtgttgtgtcaccttacctgacctgccttgtcaagactcgcacagtttgatgaggcacaaaaaatcggcaaattggccaacttggaggggattttatcacggaggctgccaaagcgatctgtctaatcacttagcgagattcttggaatggttcattggatctgtaagctgtgtgatagatgaagaaaatatccgtggtttagccgggcctgccttgattggactgcctatctagcaaggactttggacaccagattttttttttcagtttttttcctacagcattcgctccgaaggttttgctcgttctgctacagatacagaatagtgattaagcatattttcacccactgtttatcatcgcttaaaaactttcaacatcatttcgtcgtatctaccgttttcatagtttaggtagcaattattagtagccaattactgctaccatgatcaacagaaaaaacgtaccctctaataaaaaaataaactaaaaatatataattttcaactaaaccatagaagaagagatcgagtttcttgtcagcgtggcctacacgtgtgacatgtttttctttccccctcgtgagttaatacgagtaattagtcttcgaagaccattaattcttcaactaatcgcccatcttttgcaagaaacggatgctcgaaaagcaaagactaccagcagaaatcccatcctagaggggaatggccgaatggaatggacgagggcacggtacctgctgccggcgtagaggaggcggacgaaggcggccgcggcgtcgtcggtgacgccgcggatcaggacgacggccctgcggaccttgccgccgccggcggcggcgtccctctccttcttcaggcggcgctgcaggatgctctccagcaccggcgacgccgacgcctggtgatcaaaccaaacaaacaaagaattaaacggagatttcctcgtcagaacacgcccgacgccaaccagaatttgaccacagaaactatctccagctaaaaggattcatgaatttgctgatgaaagaggagaagcttacaagaacagtggaatgcgcggggatcctccggcggccggaggaggtgatgacgtcgacgtcggcggcggcggcggcgtcgccggcggcccgcacaccctcgcacatcttgtgctagtacggatgagccgatgaatccccacagggatgggaggaaggaatcgtgggaggaaaaaatatcttggaagagagcgaaatgttcagcagaggcgtcgcggcgtgcgagtactatgcatctgagggcaattgccgcgggtttttgaaggtttatatagaaatccaaaaactgcggtcctttgaacggctgttcttttttgatggaagcccccgggtagaattttattttcacaaaagccctttatccttctctacactgtgcgtggtgaggacgtgactacgtgaggttggtttaagacgggctgaccatcgtcaactgcacaaacttatttatggaacgtaatcatatgaggaaaaaaaagtatgtatattgagcaattatagcaagttttagctataaatctgaacacacaattatatagatttatagctaaaaatatttatatttgggacagaattagtataaagtatagaattattcaaaactctttcttacattcaccaaaaagtcttttacaatcaaaacacaaagatcatggatggtagctaagttaatttatagtaccactagttacacaagtggccgacacaaaacgctaacataaggcaaaaatgcacgagcccctctacagagttcacaagtaaccaagggatcaaaccgcaaaaatctggctggcaaacgcgggcgccgtgggcgtgcgtggtcgcgtcgcctcctagaggtcgagtagctaaaccggctcttggaacgagcaagcgccacataagcctccccccacaacgtcgacgtggcgcccccgtgggccccaccccgtcctcatccgcatgggcccaccacggcccaaaggaagcaacagccagtgacagctcagcatcgcccccgcctccgcggcgaggcgaccaccttgggctctatccgggggaggcgacgtggtaagcacatccgacgtggcgcctgattagtttagtcccccttgtacggccccgcgattagttactaatcgagtaattagtagcaagttggttgtgggttatgggatgtctcggccacatgcatgaacggcggacgtggcgagtagggtgcatggtttttgtgagacttatctctttttggatggattaaaccatgcttgatctgttgcatcaagtgtagcaattctaaagaattctacagaatataaatagtgcagttgaattgacatgcactgttcttaaatgtgcacttttgagcactttttgcttcttcggagtgccaaaggttagttccaagattattctatagagcatattttggttagctacgaactatgtttaattccatggataaattaagtagtctgtgcatgacatgaagaagaggtccatgcattaatctggaggaaagaacctatgctagttatacctagctatgcattaatctggaggaaagaacctatgctagttatacctagctttctgttgagcttaccttttctcgagccctaagaattgcttataccaaacatcatggcctaaaaaaagattcaacttatcggttaagatagatggttattagatcgcttgagatatctgatcacttcgtttaccaaacaaatttcctaagtacactagttttcttctggtatagtttgacctttcagacacgccatttctgggccactgagaaggaggttaatttgccccttgcagcaatccaatgtcaccattgcagtaatcttagttcaggaggtgatgactgctaatgacattgatggggtgggaccagattaatcattgacctgtttaacacttcagcatatgtgtgttcatgcatgacactattgctgccggcgctgtcggcttcagagttgagctgctgcaaaattatcgcacactgaatatccgcatcacagattcactagttccatcttctgttcaaatgccagagcatcaaaacttatctatattaaatgtaaatttaccgattataatttgcaagtaatgaaaaggacttctgcaattaaggcagacaaaaagaatcatggaggggacttatgatgctgggataaacacatgggtgactaggggccttaacctgcaagctgcaagaccagaacaactactccgtggtcagccctttttgtgtgatttttgtctcagaccagctaattttcccattataagactattatatacacacatggaaaatgctctgaaaagctgacccataacaaagatctcaacgcttgatattgcaactaacagcacagttcatccagagaaagaccaattttttttaagacgggttgagaaagaccaatttgttcctggcctagtcaaattcagagtttcagacttgtgcactcgattttgttctaggaacatatatacgtcactttgtcatctgcaccgtaaaatactccacttggtatatatgcgtgtacacttacgcctgaccttctgacttactcgtctagttgatcacctctaacgttatcattttcttgcagagcattcctatctacttcgcctcagcttcctgcaccgactactaatacttgatattgacagagattaattatgtgccaaacacgagatggtatctataatcttgttgtcactatcgtcacaatccaatgaaagcatcattcgcaagctttgttaggtgtcaaaatgatttagtagttcccaacacagtacaagttggtgatttttttttttgagtgtgcgattgatatgaagagagagcatatgttgtcatttgttcaataccttggtcctcttcttatctttgcctctgatcgtacgtcaaagatctatctgtaaattaattatgatctggtgtttgtaatgcccgtctacttgtacttctcttcttcttaacgcaatgatacgtagctcttatgtgtataagcgtattcgagggaaaaaaacagtaataattatgaaataaaaaagaaaaaagttcagagtttggttctgatgctgtacataattgttgggcttgcacttcagttaggcctgtgacagagctacgactaaactgggattcatagctgggccgaaatttcggcccagtacacattctcaattattaggaagcccacatgaaactggtggccgctttaatgagaccgtgaagtgggccctacttaagcatgaaaagtaagcttacgatctgagccgtccatgagcgtattacaccgggtcccacaagatctacggaccagaacggatcgcgatgcgtatcttccagggcccaagaaattcagatattctgacgtcatccaaaattccaaatccatggcgacctcaccgcgatccccgccgggggcgccccctccgccggagttcgagatctcgcggcagtcccgtctcctcgcggcggtgagatttcctgaagatatcgcgttactaggctctgtgtattcgtatttggcttactgtttttcagctttgatgggtcgttgtgggttggggaattggcgcagctgtccaagaaggtgatagatctcgatgagctgaggatgctggctgctcagggggtccctgacggcgccgccgtccgtcctactgtgtggaaggtgctctcgatttgctcgtcttttcattaatctcggatcgttccgtaggtacagccgtacaggtttggaggttaggttcatgagcgtaatgacagtagattactttctgttgcgttctagagtctagacattgttcaattattctactgtcttatgtttctgatcgttgattacacatgtccattatttagtctaatcctttacccctatcctttatgacgtaatgtccgattaaaatcggccttatggtcctattgttcatctactcagggctgctgttttttttctgttagttaatttgatgtgatcagcatgccagccttcaaaaagttatgctttatgtgtgataaaatctatgttagttttgcagctgttgctgggctatttgccgagtgatcgtgccctgtgggagcaggagttggcaaagaagagatcacagtacgcagcctttaaagaagaattccttagcaaccctgtatgccccttcagattcagatttgtgactttctctattttgattgtaattttaagatacacgtgcggtgtagtatagtacctgagatccctttttgcttgttagacctcactacaaaatagagatcctgaattctaattctgttaggtagatggaaattgcacggcaacgggaattagaaggccaagggagtgagaatgcagggagtatatataatgggttacttcatagatcagaggttacacaagaagagcacccattgagccttgggaagacaactgcatggaatcagttctttgaggtgcccactgttgcctttggatatggatctttttacatatgttgttgttgttgtttgtttgttcatctacaaattattgtcacattgtgactagttgcatcttcttagatcttatattagaactagattggtgccagtagcagatgtgcttacattcttttggaactattttggagcttttgtgatttgatcatagaaaagaccaagcataactagaatattgtaaaccacttgacatgatgctaatctctaaactattgtgctcttctttgtttcagtttgttattttggggactacataattagtcaaatacgtgctggttaaaagaataggtttgcattttagtattaggaggatcagatttttgttctagtacgcgcaccctatgtttgtatttttcaccagcttgcatcattctgatgttactactaatttatatcagctttgacatatatctttcgtgcagtattcagagattatcgagcaaattgaccgtgatgtgaagcgcactcaccctgacatgcattttttctgtggagactcatcttttgcaaagtccaatcaggtgaactccactatctaagtctaaacagagttctgctcagaaacctgactgatcataggtcatccttaccaggaatctctgaaaaatatactgattatctttgcaaagctgaatgccggaatacgttatgtacaagggatgaatgaaattttggcacctctcttctttgtgtttcggaatgatccagatgataaaaatgctgtatggagtaagcaattgttttaccatatatatgcttaatgccctgtatgatttagagcagactgtagtcagttgctgttcgttatagcaatagtttctgtgggactatctaaccatgattttattttgctatccggaatccctacagaactttgcagaagctgattctttcttctgcttcatggagttacttagtgggtttagagacaacttctgccagaaactagacaacagtgctgttggcattcaaggtactctctcaaaactgtcgcaacttgttgcgaagtatgatggagagcttcagcgttatttggaaataacaacagaagtaagtatgttctttgtactgagtactgtcaatttctgatgtgtttagtgtggtcctctgacagatttgctttatgtagtgttcaaactacattgcatctatttcgatctggcatggacctaataattcatacagtagttttgtcatcatgctaggaaacattgtagcaggaaatccacactactgccactgctatccttatttgtgcctgcagcaaaattaacacaagcatggtttctgtttctgcagattaatcctcagttctacgcattccggtggattacgctactgttaacccaggagttcaactttgctgacactattcacatatgggacacactattaagtgatcctgatggtcctcaggtagcaaacaaaacaccctggtttatcctgcaaggcttggtttttccagttcgtcgcctgaaactttatctgccgagtgcaggagaccttgctcagaatctgctgtgcaatgctgattcttgtccgaaaacgcctattggctggtgatttcacttccaatctcaagctcctgcagaactaccccccaacaaacatcagccacctcctttacgtcgcaaacaagctgcactgaactcaactgaacctcgtctggaagacctgaaacacactacccctgctacaatgtattcggtaaaaactgtgactgcattgcagaaccacgtaccattacgaatgctaatcacagccagtccattaataaaataatttggatccctacctgcttgggattccagttgcacattgtgccctcatccaggattccagtttgacatgggcagcactgtaacagtgatcatccgtctgttactactgctagtgccattctcctgtgcctcctcatcaaaagtccacacatgttagaaaaacattttggctgtgtttagttcagcgtaaagtttggatttttgttgaaattggagatgatgtgactgaaaagttgtgtgtgtatgacagattgatgtgatggaaaaggattgaagtttggatccaaactttggatctaaacacagcctttgccaacaaacagggccgatcaatctacagagatggaactggagaatccatgtacacaaatatagaaacgagcgttgcacatgcgtatcagtgtatgtgtatctttctattctaccactgctggcccagcatcccggaacagtgccgttccggtagtggagaagcttcaccggtgccgaaaggctacaggagctgccaggctacagtttgctgccgcgccatttctttccccatttcgatccccagaaaccacagaaaacgcagaagcttttgctttcccgtgccgttttctcgcagctacgcggcccatttcggtgcaaggcgacctcaaccttttccttcattgccctactcttgcagccttgcagctgcaggattggtactgtagctggcaaaaaccacggcttcggtccagggggacagcactgtaaaatcatctgagcaggagtacatttgagttgatttgacacttgaaacaagttaaattctgccaaaattttctgcaggaaaaactaatgttcacagcctggtagatagagaaaggcttgtcatggcgtagagtaaatttggaactgcaagtgaaacacgaatgcattagcctggaaaaatacgggcgcgaccgctactttgtcctgctagtgagggtattgatgatcggcgtgaggaggaggcgaggggcgatgtgctgaaggatgacgagcagctgcaatctgcaagggatctctgatctctctgcgacaaaatgtacagagagagatactacctctatggtctatggataccaatcgacgagctatagctatagctataggtgctatttacatttcaccctaaaattttttaccctatcatatcaaacgtttgaacacttataagaagtattaaatataggctaaaaatatatagattgtgactaatcttttaagtctaattgccccataattagataatatggtgctacagttaatatatgataataacagattaattaagcttaataaatttgtcacgtagtttactgactaattctataattattttttttagtgtttaaatacctcatgaaacaccatatataatattcgaggtggcatgctaaaactggatctaaacaccctcgttgcctatagctagcggcacaaccgctgccttgtgcagtttgtgctgctgcatgctctgctgggtttatgactttatgatcgatggatggacgtcaatcgggcataatccagatacagtagcagtaatttatggaacatgactcgccatcccagagcccagtgtactgtactgccaccttttctcagttgatgatgatgatggaagcccacaccgctcgccatcgtgcgtgcgccacgcactgattctatgtggccggatgggtgattcagtacgtagcgaccgtcgagagtgctcggctaccagttttgttccaaatatttaacgaatgtaaactttcaaatactacgataacatgttattcatgcgaagcgaaagtcgggaccaaatccccgtacttactccctccatccttaaaaaaatgacaatctaggatgtatcatgaatctgaacaaatagagtacgtgtgttttttcctcctctatttgtatgaatcttaaagtaaatttgacagtttcaaaattatacgaaagttatattgtactctctccgtccaaaaaaaatatctaattctgtgaatgtatttgggcatagttgttaccgtgtaattacactactatattatactccctctgtctcataatataagagattttaagtttttgcttacaatgtttgactactcgccttatttaaaaaatttgtgcaaatataaaaaatgaaaagttatgcttaaaatactttggataataaagtaagtcaaaaaaaaataacaattctaacattttttgaataaggagactggacaatattgtaagaaaaacttaaaatcctttatattnnnnnnnnnnnnnnnnnnnnnnnnnnnnnnnnnnnnnnnnnnnnnnnnnnnnnnn

SEQ ID NO: 30607 - DNA, 3289 bp, Oryza sativa
ccaaacaacacttggctggctgtggcggccctgtttagtctaaagggaattggtatgtttagacgctaatttaaaatattaaacataaattaattataaaatctattttataatttagactaatccgtgatataaatctagtgagactaattaatttataattaggctatgtgatgctaccgtcaatatttactaattatgaattaattaggtttaaaaaattcgtctcacggattagctcttactctccgtcccataatataagggattttgagtttttgcttgcactgtttgatcactggtcttattcaaaaaaattgtgcaaatataaaaaacgaaaagttgtgcttaaagtactttgaataataaagtaagtcaaaaaaaataaataataatttcacatttttttgaataagacgagtggtcaaacagcgcgagcaaacactcaaaatctcttatattatgggacggagggagtatttattagtctatgtttaatacttcaaaattagtgtctacgtacacattcgatgtgacatgtactaaaatccagacaccccccgctttgcttccactagctggagttatatatactgtagtagtgatttattttaacccaaacgcattttccaagtttccaaccaggggttttagagcatgtgactgagagcaaatagccaggagtacaataaaataataatataagaatgttacatatactgtcacattaattttgtaccgagagtgagataaaaaaaaagctacacatatatgtatatccagttggaacatgggctctaataaaccccatgatagaaagatgtggtgtaattatatatctagctattataggatgaactactaaattgaccatagataatactctcagtcaattattgctataacggttttacctaagttaacccaataaatatttcaccaccgccaatatatgtaagaaaaggtgcaagaaaaaatgtcaagacaccaaacaattgcaatctaggtagtataaaatttcatggtctgcaaggtctaacaatgattccattttataattatacattaaatatatgaagtaaatttaagacatgaatttatatatgttccatacatataaacttgatattaaaatatattggtttctcactacaaattctagcaaacatcaggtaaaattaattagcgaacgtacgacatatcgactatacagaggtctctaaattaaaaagatatgaaggggagatgaggattgacattttatgtactccatttgctacacgatggccattaaaatctagggcgagaaggaattgatcaattagctgactagtaccattgcaatggtagttacaagcaattatacatacatacatacatacatacatacatacatacatacatacatacatacatacatacatacatacatacatacatacatacatacatacatacatacatacatacatacatacatacatacatacatacatacatatatacatatatatatatatatatatatatatatatatatatatatatatatatatatatatattacaatttcaattcagtattactgtgaattaaataatttagaaatatggaactactacgtactgaatgtctagttatagattatttaaaatatgtgttaactagtactccctccgtcttaaaatataaaagcatcattagttatactatacgtacattagtttcatataaacatatcatatacattaatacttggctcatctctcatacgcaaacactatctcgtagcacgttccgaatctatctttcttctccacgtttatttgtagctgatttattatctgaattgtattgtacttgctctatgaggataataattgagtactccataagcttatgtgtgacaaagattaaaaaaattatgagtgttggctttgctgttagagttagctatacatatacttgaaaatattacactgaatttatagtgagagagaaaaaataaaaccaagtttatagctaacttattatacatattagtatgttaatagtaatttagttatactaaactttttctaagccgaaccagatttggatagtcaataaatgaggcacacctacacgttcacacggtcaatgaaactgggacccactgacatggtgccctgagcaaaggtagtgagtgctgcaagggtcccatggctcagtccctgacaggtgcgcgtccagtaaaccccaaaccctcccggcgttcaactcaccgtgcggagaaggattttctacgccgagatgccatgttgactatcatttcatacttaaatagttatagaaaaaaatttagtaacatcgattgtaatgatataattctacacataaatatgtaggactaaatttgatctacaactagagagataaaactaataaaatcagatagtgagtagtacccctataacgtagataaaatttgttatttttgtttcttcatatgtcgatgaatttagacttgtaggtttgtatagtgtcttattatagtctatcttattaagttttatgaaaattttatataactgtttaaattacatgcatatatctaggtgacatggtatctacactccatctgaaaaaacgaatctacgactagatatgatatcttttagtataataaatatgaacataggtatatctaaattatagtactataatatatcactagattgattttttatgggggataagagagtgtaaaatactttcggtgtccctcaccgtgcccctctctcggcctgcaggaccgtggacgtacggatacagtcaacgccatggaccaccaggtcattggctccgatcgtcctacgtggcaggctacagccactgccacctcctcaacttctcctcttcctcctcgtaacctgcgccctcccgcgatctctctctctctcctcttttattggccttttcgcgcgctttttttcttccccctctcgagatttttttttgccgtcgcagtcgtggcctcgtcccgcacacggatcacccttttgcatggccggatcacccttctaaccggataatagcatgctccctgctactatctctatgactcaaactgtttctctctctacgccgtcgcggtggccattgacgggcacgtactacgtccgtaactccgtcgtccacccggccaccagcccaccacccaccgggggggctgaggtgtggggcccaatttcacgtggctcccgcgtggtgcgtgatcgtatgcgttgcatgcatggaaggagccaaa

SEQ ID NO: 30608 - DNA, 770 bp, Oryza sativa
  unsure (1)..(770): unsure at all n locations
gttcctcatcggtaccaatccctacgcctccaccagctgttagattctagggttttagcgattttttttctccgtgtaacacgctcgtttatctctctgtttctcttcctagggctgcccttgctgctcaagtccaccgagatccaccgctcgccgctgccgtccgacgcaatcgccgccctatcccgccgcctccactccaacccgccctcgttcccctgcggcctccatgcggtcttcctccgctccggccgcgacccctccgaggcctccgtcgcaaatcgcatcgagcgggaaatctccacccaactcgtcgatctccctgacgcttccaccgccggtaaaatctccgtgtcagtcaccgttgagtccgctggtggctgctctagtagcagcaaagtcgcctcgccttggcgatgtggtgctgtgactaccgcggacttggggcgcggcgatgaggtgtttgatgaattgcttgactcggcattgggtgatggaggcggggatgggatgagggtttacactgttgtcttcgtggacagtgacgatttgaagagaattgtcattgggaaacaccggcatgcttgggtggtcgggaaggttgatgaggctgaggttgtgtccatcattgggaaggtattcgtcaagtatttcatgaatggtggtgtcgaggagggcgaagcaagcactgtgaaaagagaggttcatgccagttggatcaaatgnnnnnnnnnnnnnnnnnnnnnnnnnnnnnnnnnnnnnnnnnnnnn

SEQ ID NO: 30609 - DNA, 761 bp, Oryza sativa
aagtgtgtgcatgtgctgcctcatgcccatcagcacctgtgcatgcgtgtgtgtggagaggcagcatacgcaaaacgccgactggctagctactcctcccgctcctgcgtttgcagcagcagcgtttgcactgtactactactactggctggcttagctgctccgaccaggtaaacagtaactatatcgggcaaaatctttcccggccatttctggtgttgtagtagtaatttctaacgccaagccagcaaaagaagaaaaagaaaaagaaaaaaatcattgctctagctccatctccatatactacgtgtggcctactgggttgtgtggtctgtagatgatcggcgatcggtgtgtgaggctacggagatgcatggcgcagggtggggcgtgttatcggccgcgggtcgcgacggcaacctcgtattggtcccccgtccccggggcgacaaccccgcggagcacgtattcgtgccgtcgtcctgcgtgcccacaccttgcctccccatccgccaccgctcgcccggatctaccgtccctccacgtcgcaaaaaccgggaccgaacctagctatagccagtagccgatcgaggggcctatctatattttgtcaaacatttttttgaagatgtaaatacaatactccctccgttccataatataaaggattttaagtttttcttacaatattgaccagtcgccttattcaaaaaatgttagaattgttatttttttttgacttactttattatccaaagtat

SEQ ID NO: 30610 - DNA, 6310 bp, Oryza sativa
catccaacttcaaatttgaattgataaacaaggaaacaattcaataaaatcttataaatagtatgatattcatataacctattgagatataaattttcaaaaaaaatttgatgtattccgtgtagttaccgaactttatactaggaaagaaaataatagcgaatgaaaaaaaaacgaaaacactttcaatttatctctttttatagttaccggttaaaatttcgatgatttcgctcagaatttcgccaaagccgaccggttttcgcgagcttatcagtaaacttagataattttctattcaaattttggtttatgttccatcaaagaaaagttccatccaataaacaattggtttatgaaatttgttcgaaatctatcggctttccatcagatttcgtgaaaaccgttattccgccagagcccgaaacagaaggccaactcaagtacccaacattcttttttaggagtaatgctcaatcataattatattgaatttggatgaaactcatcaaaatctcagacggcttctactttcgagcatcgtcgaaacctcgaaatttcacggaattcgaacgtttttcgtcggaattatgaaccctatatgttacccattattattgtttaggataaaacttcactggaaacagaaaaacaatatgagtacattcatctcgaaacaatagtagtatattcaactcgaaaaaataaaaccaatactgtatatgcatgtcaatgttattggtggacaacatcaacaaggaagaaaaaggaaatggaagttcaagtttagagagctgtttctcaaaaaaaaaaaagtttttcaaaaaaagtttagagatgtttggtgataggtaggtcggcgtgagggcttctccaaaattctagtccgtgtatattaatggttttatagcgagataaatatcagaccaaataatatagttcaaaacaaatcatagaatttaccgaattttaatcaattacatgatgtggattaacacatgagtataattatatgtaaataatttgaaatcaaaattgcatgcatggaagtctttttggtgcaattgtgttcttatccttgctctacagttcaattgtgattttacccctgatttttagggtttatgattttccctagttttttgaaatgaaacagccacatgtccttactctgttaactcatggtaacggtgttaaatgtgtagtgaatggacaaatatgcctctactattgagatcaacgacatggcggctgcggcagtacggcggcggcgcacgagcgagtagcaagcgcaagtggcacgccgattgggcgaggtgaggagcagaagacgcccgggctactctaggcgggccggtacaccgtgcatcaggcgtcgggcgcggcttcgcgaagcagcccagcacccggtgaagcttcagctccggcggcagcgcgcgagcaggtgggggcggagcccgtgaccccggcaggagcagttccaacggcagtgcgtgagctcgcggcgtcggcatccctggcagcagcacgcgagcaagcgagcatctcgtccatgggcagctagctagcaacttctcttggttcctcttttccttttccatatatgtttctctctttcttcttccccatctttgcaaggaattcatttggtgatcaaatattttcctggtgaatgtgatgaattccctgctcgctgctcgctggccgacggagccgctgatcctcttcgccgcgcgcgaggatgctgctcctctccgccgcagttggcccaccgccagccgcctcaatttggggaaatcgttcccaacaagtggttggccctttaagtaaaccaagggtaggatagtcattcacaaattataatattattttctttcttcatttaattaggaaattccgggcctaccaaactaccatcaaaaccaggggcaaacggttgtttcatttaaaaaagcaggggcaaaatcacaaaccctaaaaaataagggtaaaatcaactgtgaagtaagggcaaaaacacaattgccccaagtctttttcatgaaagtggcacggagttgaagctgatatcccgacgagatctcgatcagcaaaggctttagaatcccctcaatcatcgcaactgtttttcttttaaaatttagagaagctgattttgatttttttttatagaagctgaatttgaacttgaatatttgtgaagtgatatattgtattataatctacttattttttttaaaaaaaaagaactgtaactggttgacatgtccgtctatacaagtttgaacccgcggtggaagggaacggggaaccaagcggaatatgcgcttttctgcatctgcctgtcgctagcgtcaactcttccacggcgtctgacggcgatacatgcagccatgcaggttgcaggacgctccaaatacagcccccaagatgctgttgctgctgctcttcgtcgcaagctctgaattactcgcttggcttgatcacttctcctactatgtaccaagtatcaactgaactgaatggtcttctctgctgcttccatgaagctcatcaccaccgaaccatcgatcgaacagaaccaggtgcacaagcaatcaagcaaccactgccactcgatcagtcgatctgctgctctgcctcctcttgatcctttttgtctccactctgctgcctgcaactgcatgcaaacactgtgcagtacaaccgttgcaaactggaaaagaaagattaagaactgggagaatctgcttggctgcaggtgcaggcagagggaagttgattaagtgattaagccggttcgataaaactaatccctctaccagatcgacatcattaacgtggcggttccacagcagctgtgcatattctatccggcaagtacaggacctgatcacatcgatgattaaccaatctaacttgagcagcagcatccccaaccgaaaatactgttcgtctgtgcaagcaagcgtacggcgtaccctctcttctttgtcagcaacgagattagaatacggcatcggaggcccagcgcatgtgctgtatccgacgtagcaatcatcggaaaggaggagctgagatggatttgcttttgcgcagagaccaaatccaaatgcatctgatcctgtgttctaggtgcgtctcatgtcggctagattacaaatcagtaggggcattggcgctgggggatgatgatctgaatgtctcgctccatttcagcaccctcacatgccactgtcataagtacatacacaaatgcatttttttctacttatattcgatcgatgcagcttggtagaacgcgttgtttcttgctgaatcttttccaattatgataattcgattgggacaacgattagatatgaacagttgaagtaagaaactgataggtatattcttgcgttgccgtgccttgctgaacaggagacagataaaccaactgacaaccggtgagcggtgaggtgaggcaattcatgcaaaggcaaaggcggaaaaccgtgttgcggtgttgccacccacccatgtgggttccaaccgccgctcgcagctagcgctagctgcgtccgctcccgcgtattcaaccccatcccaaccggtctcaccttttcaacgctatcgccgtctcgggcgatgcctacaggtgtcgactctcaaggatcagaatcaagaggtttttttttttttgaatgactgaaaaaaatttttttgaatgactcgcacgagacggtgtgaagttctattgatagagcaggaaaaaattacaagattacaaccctgaagggtcgtaaccaggaaaaaggaaaagaataaaccaccacccacacaccgacaacgccaacacacaagaccaggagaaagctagcaccggaccggccgccgctaagcgtgaccgaccgccgctagtctaacaaaggaacacaaacgagatcgccccctagggaatgccaaaacaacgtcttcaagaagagaagcgacggaaaaaccgccgccgccgtccgtcgtggcccaaaggagccaggactgggcttacgcccggcaaccagccttgaggggtgagacagcacgacaacgcccttaggagggggaatgaaccatcattgtcggtccggccaaagccgggttaggttttcacccgccgctcaccacctgcgaatccacggctaacgccccgatgatccaccaccacacaagctctgccaacatgtgggacccctgcaccggcgcccctcgccagccagccttcatgcgccgaagaccgcgccacacccaccagcagctcctcctcgccccgaggtcgcctcatccaccgccggccgcgcctctcgcgccaagccggcctccatcttcaccgcccgcgcctttcgcgccgagccggcctccgctgccattggttgcgcctctctgcgccaaaccggtctccgacctctcctccaaacgatgccgcgccagccagatgcagtcgtctgccacgccctcgactagccgtccgaggccgtcatgcctccggtgactgcagtcacattcaccactgcagccgctgttgccgtcaccagccgccatcactaacctcctcccaccgtcgtctgccgatgccgtcgtcaccagccgccgtcggcagtgccgactctgctgctgtcagcccccactccacgcccatcgccgccgtccaaggcccggcatcgccccagccagatctggcccggggaggccggatcccgccgtgtgggggccgaatccgtggccgccctcgctggggcgcgccgccgctgcccgtgcctccatcgaccccgtcgccatcctcgccttgcatccaccgctctgccagctctagctgtagtgccggtctgctcccgcccccgccaggcgcacagcaggcaccatcaccgccactgacgccgacgccggctgcccacccgtcagatccagccggacccgtcgggtccgagcgcggaggctagccgcgccgccgtcgacaccgccgccagcagcaccggtgtcacaccctaaagttctttcccaagcctaaattgaatttataaatcacctagagaaaatatcggtgtaaaagcaagagagaaaccctaataaatttgtcggtgacatggggccgggggtatcgtgactaaaggcttgggtagccgtggtcacccacgtggcctgaccccctcggggggtcgggcccgagggtgacatggccacccctccctctgtctccctgaggggtcgggccgctcccgtttagacacagagggctggggcgccccgaccccctgtggttttggcgccacgtgtgtgggttaggtgagcacagcggcgctcacctaacggcatttatagcgggttggacaagcgcgccacgccgcatttaatgcggcgcagcgcacgcttatccgggccgtggcgggtcgcggtgtgtgaccggtcacagaccggtcagatcgcgggttaggtggcaacaggcggcctgtcacacgcctcgccccgtcccgtcagaatgatgagagcttcttggctctcgtccctagccgaagccggcgtgctaactcctggagttggtatgtcagtcccggtcagatccattccaggcttcagcgcaagtatggcaaggaagtcgctggccattaaatgaaggttgaaatgggcgtccaccggggaaagcggacgagcagggcagaaggcgtgtgctctgcttgtcagaggtcacttccggctgtagacgagccctcattgtaaaaagcatgtttcctttcttaggcagtgagaggcccatgtggtgacccctgaccagataaaaaggaggcccaggcctaggagaggagggggacggatgggttctagagcctaaactctctctcgctctcgagctctctgtattccatcacacacagatccaccagaacacaggagtagggtgttacgcttctcagcggcccgaacctgtctacgtcgcccgtatcttgtgcgtttcctctctcgctgacgttcctcagatcgagggcgaagaacctcacttagcgcccccggccgaaccggcaaaggggggcctacgcggtctcccggtgaggagccccacgctccgtcaaaattaatgcaaataataatcggaattggcatgtggaattttcttgagttctacgtgtcgaaatatgctaacaagatttttagtggaattttcagagctctagaaataattttaatcaattaaaaatgagcacaagcaatatttaatcccatgaaaattcttttccccctttttcttttcctttttcccctttttatttttcgaatgggccgccggcccattctcttc

SEQ ID NO: 30611 - DNA, 5918 bp, Oryza sativa
caggcggtagatcgggccagtccatttggccgcccacgtggctgccgcgtggccaccgtgtcggcgccacgtcagcgccacgtggtgtgccactccttccccggcctgtcgacccggtccaccgtggaccgccccccctcgcgtcactgccttgtggggcccgcatgtcggcgccgccctctctctccccgggattttaattattgcgcaataaatcaattaaggatttttctgtttatagtaaaaacacaatgaatcttctaaaatttatatctaattcatccgagctccgtttaagcccattcaagtctcagaaaatcaagaaaaatacatagaatccattaaaaatggttttgttctctatttcagtagtcttatagcctgtttgtattgtttgctttgtatgtcgcttagattccggctctcccgacgctctggtgtactttgaaatagtcgccgaggttcctccagcagcagagcaaggcaagtcatgcttgtcacttgaacatgttgatcctatattgcaaatgctctaccgttttcccttaaatactgcattgttttataatgttactatgggatgtttgactactgttacagccatactattttgtaccatgcttctttgttagcttgggatataaacatgactagagattggactagggattgcttagccttgcttagttcaactagcacacaatggggaaaatcacattaatgcttagacttcaggttctagtgttggtgttggattaaggccgccgtcctggtgttagtcaattaaaatatacatatggtgggctgtgggtgcatggttttgatggtcgcgcccatggtacttaaggaccggttcgcgggaaaccctgaaagaattcctcgtacttgccacaagccagcgtgggcaacggctgggcttgtagtgtagctttcctttagctgatgcatctaggcaagggtgggcgtgatggagtttggatgggccctgcgacggcctatgcagcttccggattcacctaggcacgagaggggactgcccgctgccttgcgaggagtgggggtgaaacctgaggtgtggtgtacttggttagagggggttatgcgaagggtcctgtcacggcctctatctggtatgtcgtggtggcatgtcagcgcacgggaacgtgtcgtgggactgtgtcttgtggatacagttgtacacctctgatcagagtaaaactattcggatagccgtgcccgcggttatgggcggtcaaccagattcactgtgattagtctcaccctagtctagtctattagaattaattagttcaggtggatggttgggcctgttgcaacgtggagtagcgttggacaatggatggttaatattgattaattattacaactgttttactgctttcaactactgtttataaatgctcgctttatgcaaaagaacctctctagctatcctttggtaataccctgcatcataccctctattccggtatgactcgctgagtacggtggttgtactcagtcttgctctatttttcccaaaccccagagtttgagtacgcgtcagatggcggtttctccgaggagtaggcttcgtccgtgccgtcgaggatgcctgtggagtggtgttcccgctgcgatccaagtcaaggcttagctccagttatcttttaattttccgctgcatttatgtaagacttttataatgtttgtaagacgtggatctgtatgtcaactttgtcgtttgtgtaccccggccagtcctggacggtggttttaatgcacattctgcttggaattctattcgggaatttctgggcgtgacgactggccatcgcagccatcgccggcatggccaccgccgaggtcgcctcgccggaaacggccgtgcggcatggatctgggcgggaggagcaacccccaccgtcgacgtcctggtgccccactccttctagcgccgtcgggggagaaaagggccccgccgccgccatccttgcagccaggcagcttgccggcgggctgctcaggctgcggcgaggtggaggagaggggggagggagggaggccggcggtggcgcgtggaggtcgcccgcgtcgccctagggctggagcccgcgtcgccctagggctggagcgacgcgtcaagaggtttagtttaagaagggattagttaatgcgccggagtaactaaacaatgggttttgagcttaatctccaatcattttcccttgggcgcgcgcacgatgggcggccatggggggcctgtctctgtctgtcacgacttaacctcctccctgccttgtcctcatcggcgcttctccccctttaaaatcttcgctctcttgccagtctcgtcgcgcagagcaaccagagaccagcagaggaagagagattgtgagacagagaaagatcaggagaggaagtagtagctgaaatggtgaagattccgagcccgaggaggctgttcaggagcaggtccaagagcatcggcggcgccggcggcggcgtcggcgcggacatctgcgcgatggtcgcggagcacgagaagatcgagtgggaggtgcggccgggcgggatgctggtgcagaagcggcgggcgccggaggagcaggacgacggcagcagcagcatgtccgcccactccggcgcggacgccatcgtcgtcagggtctccaccgggtggcaatggcacgacgtctccatcgactccaccgccaccttcggtgcgtcccacattgcattgcctcgattgccattctcctcagctgatcatactagaaaggaaataaactgagctgttctttgccatgatcgatgcaggtgatctgaaggtgatgctgtcgctggtgaccgggctgtggccgagggaccagaggctgctgtacaaggggaaggagagagacgacggcgatcacctgcacatggtcggagtccaggacaaggacaaggtgctgctgctggaagacccggccgtcaaggagaggaagctccggtcgaccaccctggcgcagctcatgggagtgccctgccattccttcatcgaagtctagaaattaaattaaacccgccattttgacttgttcttttttggtctgcttgcaagagtgacaccacgcaaagatccttttttgtttccagctcaatcgtctaactgcattgttcggagtcactgttccatttctcgagttcgagggtagtctggattcagccgattgaatcgaatcgtctgcaccaatagtccaatacgacacaaagacataatgtaaattaatgtaattagataatgtcagtgtgtgttgtgtattatttcagctgtaatacttcttaccccatgtatattctcctactgcaatttgcaatacagattatatgatgcacccccgtcttcttgttgaccagtttgtcagctactgcacaactagcctctcggtcgtacgttccccatctttctctctctctcatcaactcgtactgatcgtacaataatccgtggtagttgaacggcattgttggttgctcgattacttttttcccaacacaatgtactgttgcatacctgctattcaagtggcagttaaccgacccaggtcgcagcaggtttacggctaccaaacatgtaacgccagcctgcactgaactgcctaacctggaccgaagaaatactattgcacaccgtaatcagtagtagaactgagcactgactaaaattgctcgcggaggcaatcgctgatactctgatagcacggataagatgggcatttgcaaaattcagtttcaacgtactggtactgcttcttctactgtaccctgagctcccttttcaggctgttattttctcacattttctcttggattaacatgccagtgttaaaagtaacatttagccttttgatcattgatcaagtagcagtacatgatgctggaccgtggacaggggcatgaatgaaatattgaaatctaacccgtaatccaccgaactgtacgcgcgggacctggaaaaaacagatgagacgacgctatcaaccagcggtccacctgtccccctgaactcgtgccgcgaagagaggagcgacttgaatgctgatctcaccggcggctcgacctctcggccaaatccgtccccgcgcgcgcatgtgccggcactgaccgtgatcagcgcgacgcggggtcgtggcagcgacggccgcctcctggtccggtggtcgtcgacccgtccactgcgcccattaaaacccgaggtggtcggcagcgaggcgggcggaagaaaaaacgacggcaacttggctatctcattctcgcaacgtgcgtgcgtgcgtgcgggcgggcgtcgcggcttatccgatcaggaggaggcccgcggatttggccccaggtcggcagcggcatgtggccatgtgcgagtgccgaacggtgcgtgcaccggggggcggggcggtacgtagctgagctacctgccgggcgctgctgatggctgggctggtgcggtggtggtgccggtttatcggttcggtgcggtgctgtgcgtgcgttcggtcggcggaacgtgcgcgggctcttcagtcttcaccgttttgggcactcgcgttgattacggggctaatcaaatctcgcgtagacgacgtcgtagccgtggccaccgctagccgaccggacgatgcagcattgtttctgcccagctgaagcgcaccagagtttgaagggggcacccgatttttaatagacgatgttgttaatttttttacacacatttgactattatttttattaatttttttctacaaatataatgaaaaatgaaagtcatgtttttacaataaaataaataatgatttatgtaatcatttaatagatataaatggttaaaagtgtgttaaaaagtcaatgcattatctataaatagatagatggcagtaattagttaatatgcaattaaatttagcgtataaaacttgtactaataaattcatcacactttaaattactttcagacaatattagttttatagatggtagaatattttatgttaataattgtggcaaagtttaggtcctgttgcccatatttctaataattcaaaatggtttattagaaaataattaatttatggataaaacttttatatatgtatttttagcgacttaaaaacaagtaattataaaaaaggaaattaggttgaaaatatcttaaattaactttaaaattagatttgaaaattcaaattttggctttgtatttagcttattagggaaaccgatggggctcttagtattaaagactttctaaaataaaaatatatgttataaaaaaattgaataggaggaatacttctctctctctctttcattttcaactatagaaattggatactttgttttgttgggcctaaatggtaagatgggctttaagccgggacacttcgagacaggccatacttggacctaacgtagtgacgttgccaccggggcccagcgtatccggacctgtaacagataaacttcttgggccaggccttcgagcacgctccgctcctccgctgcttggtcaccgacccctcggaacgccgttcatctgagaaaggatggcggtcctggcggagatcgccggcgacgagtccccgccgccgcttcctccttccgaaggcggcgaagcttccggagccccgtccacgtcttctccctccggatgccgacggcggcggcaagccttcgccgcgcacgtcgaagcccggcaggaagcgccttcggtcctcaccgccctccgtcctcctctcgttccctcatcggtaccaatcccaacgcctccaccagctgctagattctagggttttagcgattttttttctccgtgtaacacgctcgtttatctctctgtttctcttcatagggctgcccttgctgctcaagtccaccgagatcca

SEQ ID NO: 30612 - DNA, 13964 bp, Oryza sativa
ctagtagcagcaaagtcgcctcgcctgccgatgtgtgctgtgactaccgcgacttggggcgcggcgatgaggtgtttgatgaattgcttgactcggcattgggtgatgaaggcggggatgggatgagggtttacactgttgtcttcgtggacagtgacgatttgaagagaattgtcattgggaaacaccggcatgcttgggtggtcgggaaggttgatgaggctgaggttgtgtccatcattgggaaggtattcgtcaagtatttcatgaatggtggtgtcgaggagggcgaagcaagcactgtgaaaagagagttcatgccagttggatcagatggcaatatagttctttcatttagcctgctgaatgctgatccaagtgattgggtgtatgattggtaagaacaagacatgtcttatgtttgtcttattgttgcttctctgttatatagaaatccactttatcagcatcgttaacaattgtcaaatgatatccctgtctcgttctatggtagtctgtttaaatcaaagaaaatatactggattgcatctacatttcttaggcaatgtgtaaaatgtcaaggcagtaaggctgtggaatcgcgcttattcgatgcaatcgatgaatatattgtgtatttggcatcttgcaaagatgaaaattattgtcaaattattcctgcttcttcattgttgtttcttttacatttagatgtcctgcatgcagggagtttgaaaatattggtcaaaggatgttgactcctgttattgaggcgttacgaccgattgcgaacattaatatagagagtcaggtgcaaaattgcctattttgctcaatgcttgtttcttccatcgtgtgaagctgtcaatgttgataagtactgactagtccttttgttttcaggttttgtaccacacaccaaaatcatcctattcttattctgatgataaacttggtggcaatgtccttagcgtgggagacattcctttctttgtatgtttctgaattcctctgtagaagtcatgtagccatgatggttgctgcatactacagttagctgctgttagtgtttatgacatttaactgttatagatgcactaattcaatatgcaatgaaattgataggttaattcaaatgagtggcacttggatacatccatttcagctacaggacgatcaaaagttcttcaatttgtggtgtatgttctttagaccagattggcatctttgtatttaatcttacagttcactcatcctgaacagataatggaaaaaaaagcagaataacctttcttttctatgactgcgccctgccactccattttatctgtgttctatgttcaactatatttcctgtgtcaatctcctgatggatattaaagtgattcaatgatttggtctttcttttactccttactgtgaatctaaatatcgcagactacctcatttgttaattgagatttatgatttacaaagtgtacaacagtcagaaagtattactgtgatgttctaattaccatatttcatattagttatatgatcagttgtggatgcccatatactcatttgaattgtctgtgcaataaccaccagatatattccatcagcaagggaatgccctttgtacctgcaacttccagatggggagctttccaaaactaatgcatttatatccccagtaagtgctgttttacctatcttccttttgttacccattttatcattttcttaacagtgtgtattatgttgtgcagatgtggggaggtgttgttatttggaacccacctggctgttcatttggttctaagccacatggggccctggacaaaatgtcatctgaggtgtctgtaatcaatttattgccctttttatatgatagaatgtacatattgaaatgtcacagtagttagtctgatataccttcttgcactcattatctgctgagtgctgacacatctatatggaacaggaactcatggagactattgaaatcttcataggacagctaaggcagttatttggtctaaaatcaagttatcacacacagagtatggatggtgtaactaagttcataactagtccaaaagggtttgcccaatggtgagactccctctatttccttactaaaattatctcagtaccaactcccgcttaactacgcacattagctggatgctgacacatgctacatgctctcaatttgaaaagcaaccatgaactattgattctttaatctgagattacattagttatctgcatctgacatgatgatcaataaagctatgggaattttatcacaagccacatgcatagaggatcccgtagaaatattgacaaaatacacatgtatggacaaatgtatccacataggatccaaccaacccaatttttgaggaagtctgagacaaccactagtctacaatcatcaccatctcctattgtagaaatgaaaatatgttgtgtcattggattggatcattggacaacatttttcttcatgaagatgttctcaaaattgtagtgtttatattctcaactcatcaatactgtagtctgcagtatgcaataatatgcatcaatcagggtggacttttatcaaagttagaagatcccaactacatgtcaacagctgaaattctaaatgtcccagataagattttggatgctatatgcttgatttccatatgtctcatagtaggtttttaaaacttacaagtttagtgtagttgcgactttagaagtccatctatcacatgtaacctcttaaggcgctaagccactaactgttactatcttgaccctttttttcctcagggaattggatttattataccggcaccatgcatgttccaatcttttgtcctgtctcaccaccttggaatccctttccagtttggtatgtaataaattcttgataatacataaaagactgttcttcatgctgtgcatgcactaatattattattattattatttttgtaggtccaatcactccccagaatgattgttatggatgaaattgggaggcaggtttgttcctattacattcttgccaaatggtagtagcacatagttctgcatagtagtcatttttttaaaaacaactttgcaccttctttactacaaggtctcgaagcagcatatcactcagatgataacttgggcatgtgtttcgtctgcctttttttttttaccattatgtgtactttgcaagcttgtacacagttatattctgtggatctagtgctttacaaaattaatttcgcactaagtttgtgtcatggtctaaaaaacatttaacagagcctaaatttgttatgacaagtgacatctctttgcaggttgagctttctcttgaagctgcaagtttagctcaaagaaacgcaagcctcggaataagtgactcttcagcaggcacgttaatcttttgtttgcactaaatgtaaaaaaatgataaattttatcaagaattgtgctgttctgcaattttattaagaattgtgttgttctgcagtatctgcaacaagagcgagggctttggctgaggatgcattttttcatccatctgttatgtctatcagttatgcttcaatagagcactattttgcgatttacatggtcagtatactcttctactttacacttattacagtccaatttgtgtttgacacttctgaattctttctttatcttgggcaatatagaaaactgaaaacaaaagagttaactattctccggttttaaatagtgaggattagagcttagtagcgtgcagagcaataatttcttgtccaatttgtttaatatcaacatgcaagttttacactaattgcaatcccttcaattctagaattttgctttattatttcttttgatcataaaagtaactactttagattaaaaaaaattacattgtagcacttcagagccaatactgatatgcttcgaattggcattttctgcagccattctttgcgccagtttccttgcatgtgctgttggcggtaatgaaagagctgaaacgatacatggtagagagaaggaaatattcagcatttcttgcttcccaggcgacatcttcctgatcttttggtgattatcagcagccctgtttcatgcctagtactatcatccacaccaagtctgatatagatggtagataatctgcaacggttcagccacagctgggggacgcgtcttcttaccatcaagcaactgctgggcagacaggtagaccaaatggtgtgtgcctgtgaactcgcagaccaggtgaagatgtgagggaacccagtttttgtcacaaatacggcgttcttccatgaaaccagcttggtgaggccttaactgatcgtcgggtatcattcacattttttggtgaggccttaactgatctctgaaactacagaccgctatctaaagccaatgcatctgtaaattgttgtataatttgagagcgcttgacaaactccccgcagaccaatgttggattagcagttaacacgaacttttacgggtttgatgtgtgtgttcacgattgtttttcatctgcaacgcatgcatgggattccccctctcgtcctacaacggcacacccggacgaaggaactacccgtgtggccgtaactgcatcctccggcctgagagagagagagagagagagagagagagagagagagagagcccgctagagtaacatgtgcgaaaagacctgcaccattcggttaatacaatttccaaatcatagaaataaaaagttaaatgattcggataggacatggacttcaatcattaagaatttattattttgtacaagagatcttaaaaattatatgaaatactccatccgtcctaaaatgaataaaactagtactacaaatttagaacggtactaggttttaggtcctttttaagttcccaaataaaaattttcactctgtcacaaaatgtttggacacatgcttggagtattaaatatagaaaaaaaactaaattgcgagaagaatcttttaagaccatttgctccatgatttgacaatgtgatgctataataaatatttgctaatgacggattaattaggcttaataaattcgtttcgcagtttacaggcagaatatataatttgtttttttattagtttatgtttaatacttcaaattaatctacgtttaatacttcaaatgtgtttccgtatatccaatgttacacactgaaaactttttacctctggaactaatcagggctttagtttatttaagtttgagatggggagggtaaggttataataggattacaatgtaagtttacaaggctacaatctttgaaatttgataggagctatttctccggaacgaacgaagcatatatggaaaaatcgtaatttttcaatactacgatatgtaatattttgaaaattcttttaaacctaatgagccccgtattgttaccgtggcagcctggcagggtgcaaggcaaccaccggcgtccagggcacaccgccgcttcgcgacgaccgccatcggcaaccgctcgctgtcgctgcagtagactagcgcggacgctccctccctccctccatcccaatccgtccccttcacttcactcccattcccatttcctctcgctcccaccaagaccaaccaaacccctgtttctccctcaaaacctccctctctttcccccccgaatgctcgagcgctgcgcggcggaatcccctactcccctccgatgaggccctcgccgcctcccgccgccccggcggaggaaccggtgcccccgtggctgagatcgctgtccgtcgcgcccgagttccgccccaccgccgccgagttcgccgatcccgtctcctacatcctcaagatcgagcccgccgcggcgccgtacggcatctgcaaggtcgtgccgccgttgcccccgccgccgaagaaaggccacctcttacaacctctcccgctacttcgacgcgctccaccggacgaccgctcgccgtccttccccacccgccacaaccaggtcggcctctgcccgcgccgcacgcgcccggggctcaagcccgtgtggcggtcctcccaccgctacacgctccggcagttcgagtccaaggccggcgccacccgcaagtcgctcctcgccggcctcaacttccttgcctccagcctgctccccccgctcgaccacgaggtgctcttttggcgcgcatcgcccgaccgccccttcgtggtcgagtatggcagcgacatgtcgggctcgggattctccccttgcgccgcgcagccgcagccgccgccgcagcagcaaccgacggcgcgggcggcggcgcaccttggggagacggcgtggaacatgcgcggcgtggctaggagccccggatcgctgctgcggttcatgccggaggatgtccccggggtcaccacgccgatgctctacgtcgggatgatgttcagttggttcgcgtggcacgttgaggaccacgacctgcacagcctcaactacatgcaccttggggccgccaagacgtggtacggtgtgccgcgcgacgccgcgctcgcgttcgaggacgtggtgcgcgaacatggctacggcggggaggtgaaccccctaggtgaggcgcttgaaactatcaattttcattaggaacacgctatgctctgttttcccaattctgaattggttttcctgaactgcgagttggtatgcagaaaccttcgctacattggggcagaaaacaacagtgatgtcccctgaagtgcttgtggagtcgggtatcccctgctgcaggtgttatttccttctgtttgttcagtaactagccaaatttcccgtgcaattttgcatggaactagcttaaagtttatttgatgtagaattgcttttggtatacgtcttctgcttctatttctataaatacaatctataccattataagttgaacccgacatgatcaaagcatacatatatctcttttctcagattattaatgttgtgatttctaggccctcagtgaatttggtggactcttttagccttctctttattaataatatattccataatagatagatatattttctatggtatgtgccatgtctaccagtggtttgattaattgattctctgtgtttgaacagattggtgcagaatgcaggggaatttgtggtcacttttccaggatcttatcactgcggtttcagtcatggtgagactgagcaatcacaatagctagcctcattttcctatgctacattttgtacacaattattcctgttctaatcatgcctatgacattttttttcatccctaactgcatgaaatatatgtcttacacagggtgcaatacccatagaatgccaaccttttattgagacatgcctataccaggaaaacttataactcttttttttttaaaaaaaaacatgtgtataccatgtgcagtgcaaaacaaataggtattctatctactgagttaatcagatgtgattgcaggatattgtgtaaaagatttgaagtgtttactaaaaatagtgaattaacctatatttgtgctaaacgtctgccctaccctagtacgttacaactattatgatgttaccatttcctgaattcgattgttcatcttgacacgggcactcttcatttcattccagcaacacaggtgtactgtgtgcaatatgcaattgcaaaatgtgtctctgttgtaaccactgcaatgcacttgatcactgcctctttcatataattaatctaatcaacctcatgactcatgagggcatcatctatttgggcaggattcaactgtggggaagcatcaaatatagctactcctgaatggttgagaatagcaaaagaggcagcaatccgaagagcttcaatcaatcgtcctcccatggtttcgcactatcaattactttacgatctcgcactgtctatgcgttttaggtatgtcataatttgcatgtttcatgatgtgcacttgttcttgatttcttgtgagagattctatcaacttctgccccccataaaatacttatctcacagcccagtttggcactttggctatggcgcatttcttctccctgtattaacttagagtacattagagtagattttggaaaaccctgtttcatgacgtgcacttattcttgatttcttgcgagagattttgtcaacttctgcctcccagaaaaatacttatctgacaacccattttggcactttggctatggcacgtttcttaatcactggataacttagattatgttagagtagattttagaaaaccccatgtttttgtgaaaccttagaccataatacctaggggttatatgacgtaagccataatacctaggtttttttttccaactttgatggcatgacctttttttccttaaaataaatcattatgctatcaataaaaatggtcagccagttagtgcagaatcaataatttccatgtattgacctgtgcacgactctgctcagtgatgcaagtatccccattcccacgtatgcaacatcaataaagtcttaaaatattccaccgtagtgtcttacggtagccaaggtttttatggtgatgcttcaatctgttagcggttagcgatgtatatgtgttatgagagctgctttctgacagaactcttttgatacttgctgatgctatatgaaaataagacaatcttttttatgcatttgcccccttcatttttttatggcaatcctttatcttgttttgaacttctacttcttcagggaaccatccaatggtgaaatggagacacggagctctcgaataaaggagaagaagaaatgcgaaggggaacaactggtcaagaagatgttcatccaaaatgttattgaagataatgaactgcttagtcatcttctaaatgacggatcatcttgtattattcttccagcaaatgcccatgatggtcctggtctttctactttgcgctcaacagatcaatcaaatatgaattccagaatatcacataacctatgcagtagggaagaagctccagaagcctcaggatgcttatcgccgaacaggaatggtgataccagaaattgtatttcatcagatacgcataacatggaaggtgataagggagatataatgagcgctactggattgttagatcagggtctattatcatgtgtcacttgtggaattttaagtttttcatgtgtggctgtactcaaaccaagagattctacagcacgatacttgatgtctgctgattctaattcaattaataaccagctttctatttctggagggagtattctggcagatgcgccaacaaatgaaaggaatggtgtcatttctcgtaagttttcatcttacaatctgtactgaagacattttatttcttacgctcttgttttcagcttatcttatgtacttccacattaaaagggtagtgagttactgatattttttttccttctaaggtagtaaaagaattgctattaggtgccatagattattgatctatcataactaaggaaaatttaccctgtacgaattggatgttttgaaacaaataaacctcctttataactccatatctaatgaaatgatctattggagtttcttatgtgtttttactatgggaatgaatggactgtggttctatatttgtttatctgcatttgtggtaggtataatcaggtgcttgtagggacatttaattttcagttaatttggtgagccgaatgctatttactattttgtccatgtgctttaacaatcattttcatctgatacagtatatgcatttgtaatcaacacacaggtccatattctgaacactgttgcaacgaaataatggccgatgatgcagaaatcgataagaattctgctcttgatctcttggcatttgctcatgggggtcaaccagatcctgaagaagatccactggagaaaatactgaagattgcacatggcattaacaaatcacaacctaatagttcaaataatgttggttgtgttggaacaaagctgtcctcaagtagcacagagcgccaagaaagaccatcttcccagaacgctcattgtaatggtagctcagttatttcaaatggaccgaaaggtgttcgcacgagaaataagtatcaacttaagatggtactttctgaaggttttcaggcaaaggatatctattctgcgaaggaaaagaaggttcaatcagaaccatcaagctcaaaaggggatgttaaggagacaattgatgttagtggcacagagaacgatgtcggatgtaaaagcactacaatctctgtcagtgaacacaggggttctacaaagaatatgtattcagtgaaggaaaagaaggttcaatcgaaaccatcaagcttaaaggggactgttaaagagacagttgatgtcagtggcacagagaacgatgctagatgtaaaagcattacaatctctgtcagtgaacacaggggttctacacctatgaccaatagtttagctgcatcaatcgtgaaacctgacaaggattcatcaagaatgcatgtattttgtcttgagcatgctattgaggttgagaagcaactgcatgctataggtggttctaatattatgcttatatgtcgtccaggttagtcatcaagctgtttgctcactgttatgaagtgcaattcattttcaaccatttttaagcatttttctgcatgccttttattgttttcattggtaattggttcatagtatgacttagcactttagcagtgacaccatatctgtacacatgccatcttacatgatgttcctattagctttgctgaaatcagaataagtaggttgaaccttttggtgcttctgatgttcataatactaaattttcaagactgctgcatatgttcttaaaacattaattaactttttttgttatgatttgtacagaatatcccaaaatagaagcggaagcaagattgttgggtgaagaaatgggactggtatatgactggaagggcattcatttcaaggaggccaacatggaggacaggcagaagatacaggaagttctgcgggatgaggaagcaatacctacaagcagtgattgggctgtaaaattgggtattaacctttattatagtgcaaatctggccaaatctcctttatataacaaacaaatgccatacaacagagtcatttatagggcatttggctgtgattctcctaatgactcgccagtaatgttcaatacttgcgaaaggaaacaaagccaccagaagaaaatagtggttgctggccggtggtgtgggaaagtatggatgtcaaaacaggtccatccatacttggctcacagagttgaaagccaggaagcggaagaagcagatagaatctgttcttatcattttgatgagaagcacaaagctgagccagttgggaattctagtagagtggaagcctccaaaagaaagagtagcagtttgacagacgtaacagaatcaagcaatagaaggggggaaatacctggtgaggaaacaaacaccaagaggcccaaacattctcaagagaacaatctcagagctttggaaaccgttgctgaagttgtggtgccctcaccagctggaacaggtctccgcgttagctccaggattgccaacagggcaaacaagctaaaatcaaagatggaaaaggaggatgtcccttctagccgtccaaagtctaacataaaggagaaaagcagtcatgctagcggtcagaaatcaaatgttcaagaggcgaatgctaattctgctagccatttgagagcaatgccaccaaaacagaaggctgaagcagaagcaaagaagcaaataagaactccaaaacctccaaagcaagcagtggagtactcgtgcgatattgagggttgttctatgagttttcgtacaaagcgggacttgtctctgcacaagagtgatatctgcccagtgaaaggctgcgggaagaagttcttctcgcacaagtatctgctgcagcatcgcaaggttcacacagatgaccgtccgctaacatgcccatggaagggctgcaacatggcattcaagtggccatgggcaaggactgaacatctcagggttcatacaggcgacaggccctatgtttgccatgagccaggttgcgcacagacattcaggtttgtctcagatttcagccgtcacaagcgcaagacaggtcattctgtcaagaagaagaagaaagcaaagagttgagctcgtattacagcaagctagttatggtagaaccggacgcagtaggaggtagtttgtacattctacttcactagtttagcactgatctctctatctgacggattctgttggcaccacaatcggtgtgctttgtgttagtttatattagttttcatgattactaattctcctagttagccttgcatcccatcatatgtttgatgtactgacaccagcacttgcttgcatggttaactagcaaattctaatgttatcttctctttgtatttactggttgacgtgtggatgataactagattctggtcacgtatgattttgcccttcttgcaggggaagaatctgactgctgtcgtagatctgtttgtgctgttgggctaccagttttgacgatgctgcttttttgttctttctttctttctttcttcttttttggtgatatcaggcctcagattgtagccatctcagaaaagaacaacggaatcataaaagcctttgtgatcttaggtgcgtcattctaggtatcaacaggagagcctctcctgctggattcctgaagggctgaaactgaaagtgattcagaagaaggctgcagccgcatcacagcctagtctgtttaacttgatcaatcctccatatcaagctaaactcaatatcattttttttcaaaaacaaaattagcaacgtccatagaactgcactaagttcgtctaattacgagcaccagaagaattcccgtgggtagcggtgcgtgaaattggagcagcctgaagccctgaaccgtgaaaaactgggctgtgagactcagagcgcgaaccaaatctgtcatggagaagatactccctccgtactcgtaaagaaaatcgtttagaacaatgtttaagtcaaaccttgagaatataaatcatgaataactatcaagttgttgagttttaaaatataaaaattatatgaatagatttgtcttgaaaaataacatacatatatcactttttaatgaatatttttataaaaataagaagttaaagttgtgttttagagaccgtgtcgctgtcctaaataacttactttacgagtatggagggagtaagagctagccgatcaaccgacgtatcaacaactcggtggtctctgcggctctgcctcatcgcaaccaattcctacacgccgcgcaggcgcagcccctcggcctccacgaccgccattaataccgtcctagccaagctacgatcaatcacagagcaaagcagccattcctcacgtcacgtagcccgaccacccagtgataaacttcccagcaacccagtactagcatccataaaattgcacacctaagctagctacactagattcaatcaagtcatgaacaaaaaccgatcgatccgtatttgaatctggccagaatcttcgacgccattggcaactcacgtagcccgccgctaacgtagcagccgtccatcccaactccctagctgaatctgacaccatcgcacgcatctttctgttacccccatttaaatccgtctcgtttcccgccgcaaatcccagctataaatacgtctcctcccttctccttcctcctcatcgccctcaccctccaattccaatccctcccaagaactagctgatcacgacgagcagctagtccactgctactgcgatcgatcggttgcaaagttaattaattagtggcgatcgatcgatcatggggagggttattagcagctggagggttcttgcggtggtggctgctttgatg

SEQ ID NO: 30613 - DNA, 4706 bp, Oryza sativa
ccgtccgcgcccggcgcgcgccgctggtggtgatcgacgggcaccagaacgtgccggccaacagcgaggccgcgctcgccaaggccgtcgccaaccagcccgtctccgtcgccatcgacgccggcgaccagtccttccagttctactccgacggcgtcttcgccggcgactgcggcaccgacctcgaccacggcgttcgcggtggtcggctacggcgagaccaacgacggcacggagtactggatcgtcaagaactcgtggggcacagcctggggcgagggcggctacatccggatgcagcgcgactccggctacgacggcggcctctgcggcatcgccatggaagcctcctaccccgtcaagttctcgccaaatcgtgtcacgccaaggcgcgcccttggcgccaaggaaacccagtgatcgagccggcgccatctccgccgtacacgtgcccgcctacgagcctggatcaacggctctggtcgcgtctcctcctccagcttgcaaaatggtgctattattgttgctgctctttgttaattgccttgtgtttatgtaattcgtgtgaggcgatcagggaaaagaattacctgaaatcgtctaagttactagtgttatttcgtgtgtgctaaataagttttagatgtgaggtgaggtcgatctatcatgtaatgtactgaacttatatgtggtgttcttcgtggcaccgggaaatatatataagaaggttgttgttatgactaaggttatgccaaatttcatccaaaaaagactaaggttatgccaaatttcatccaaaaaaaagttatctcaattgcttcagtttttagcttgtctcgctgggcgttcctatgacttatgtgagttacgactcgtgggattcgcaaccaaaatcgaagacgagagctttgcaaccggagaggaattcggcctatttggtattttggtctagctagctctgcaattcgagtgagataacaaaacggcctacatgtggtgggctgggctctgggtaagtgctgcttgacttgtgaatagctatgtgggctgacgacaagtggactacgcactttgacagaaataaaaatggaaaaagtccaatctggctcctaattataggtcgaatcaatttttcctgaccacttaaggtgcacacgtcttttttttcatcaaagagaaccgtcctcaaaacagtaagttgttttgtatgactttaatagtttgaggagtcattataaccggttttacagttgaaagataaaaaaagatccgatctatatttgaggtgtcgaattggatctatttttttattaaataaaaggaaaattatgacttgtttggcgtatgaacatatggctatctttcttgcatctaacctttagcaaaagagtgcgtggttagccacaaaactgtgaccacatcttacaagaaattagcagatcatttttatatgattgaataccaagttatatttaaagtataaaatacttgagtataacttttgcttttttttccacgtatatgtagtactgtagttatttaactattttgtatatacaatgatgttgatcaatacacaccttataatcttcactcaccagtcaccgctaccaaacttcgcatatcttctctttttctttatctccaatcaacatcaacacctattcaccatctcttatacagttatactgtaactaatctactcaactcaatcaaacggatggcatgccatacgtgtgagagctaaatgtagacttctgcataaaacccaatggcgtttttaacactgaatgtctatataaaatatttttaaaacttacaccttagaaatttaaaactgaattctatattaatttttttaacctactccctccttcctaaaatgatcattatatatatttatataccaagaccaatgataatttaaattacatcaatcaagataccatgcacatattttgccacaatacatgcaacaattaaaacaccatgccaattacaccttagcatccacacattctctcgtgctgtattattgtattctgatgaaatccgtatccatatggctatatgatgatcaatttaagaaattttgaattctattatatgatgatcaattttgaaggagggaataataattacgtccacattactccagctatatagaagaatacaactttacagcgctagggtaggaaaattgttctatgacatagagtaggtaattaatgttgccgccggcttgccgccctataaataatatcaaattatgtgtgagagtataaatgaatttttcgtcttttgtaattagtaattaggttgaggttctgtatgaactgatcggtgcacaatttaacaggtcagcacagctagaattctatctcttgcatgcctatgcactctctccttccaaaaaaatatatatatatatgctcgctctgtccacattcatctctaggattagatttattttgggataaacggagtattacttttatcaccaaaatcaaataaaaattaactaatcttacatgtaataaagatcaagaagtgtatacatacatgtatgcttatgatgacttatcggattctgatgaaacatttaatttatctcttcatttaattaattattcgacgggtagaagcaacttatttgaaaatacttaaatataaaatagatataactcttatcgatggagggattgttttttagaaacagtaatttgagctagataatttacagttttacacgccgatttggagatgagaggctgtgtgcctgtgtgcatgcaagcgagcatgacggcatgagcacgccagcccacgcagcttaattgtggtgacccccggatcgagcgaccgaccgatcgaccagctgaggtgaaccacatatatctacgcagggttcaatggttgcattctgcagatggccttctctttcccggaattaactacgcgtcgtcgcttacgagaacgagagtcccaagagctgtctcttgtttcttccgaacgtacagtaatcgtataaaatcatgggaattacagtaagcgtgacaaattaaaacaagtttagtccgtaggacaacttgaacgataatcaaattgtttgaccactagtataatttttggtagcttatttaattctagagaaaatttaccaagaagtgatttcctatttgcctttgtcttgagctcgacgggtagtagtaagagcaagaataataatagactgtctgatgaatcttatttggtgactcagagctacttcctacgtctcttaatataagagattttgacatattgcttgtactgtttgaccattcgtcttattaaaaaaatttgaaattattaattattttatttatgacttactttattatccaaaatactttaagcataacttttcgttttttttatatttacatatttttttaaataaaacgaatgatcaaatgttacaagaaaataatgaatatctcttatattagaggacggaggaagtagctagttagtagtagctcttattggaattcacaacacaggaattttaaagatgatgtgtttagatatctcgcatgaaaatatccttttttttcacgaacatgcaaaaagattacatgtcaatatattagagggaaaaatttttttgatacacaacgcaatcagccagatcggtttatgctaggggaaagaagcgcatgaaaatatctgttttcgcgaactcataaactgtgatatcacgcacgaaaatatcataggaatttgattgccttctagaaatacgaagagagaaggatttaatagaggtaaaatgcatgaggtgtgagctcatgtgaaaaattcctatagaattgaactatggaaaagcaatactacaaagaaattatcaacttccagtcctatcttaggccttgtttagttggaaaaaaaattccggtttggttgtcgcatcggatatacgggcacacatttgaattattaaaagtattaaatgtagtttaataacaaaacaaattatagagtccaccagaaaactgtgggacgaatttattaagcctaattaatccatcattagtaaatgtttactgtaacaccacattgtcaaatcatggcgcaattaagcttaaaagattcgtcttataatttacacgcaatctgtgtaattagtttttcctatatttaatactccatgcatatgtccaaatattcgatgtgacaacgtgaaattttttattttgggaactaaatatggccttaattaaacaaccaaattagaaaaagaaaaatcctataaagctgaatccttcaaaatttcttatgagaatcatgagcgttaagagaaattgcacttgtacggatcgctgtaccagcagaacagcaacacgctcaaaaaccgaagcctggcacgaccaccagaagagcctcaacctttggaactacgcttgcatatatgaattgtataaatgatccatgcgctgcagtactcctcgctgctgctggtcgctgcaactgcaaaagcctcatgttgcccgctggttaaaccgcggtcacccgcacccttccaagaggcgcacagcaactcgatcgaagcagtgcatgcatcatgcatgcattgtatggcagctagcgtacacacgcccgcgcatgcacatgcacatggccccctcgcctcagctcgccggccgctgccggtcaaacccggccgt

SEQ ID NO: 30614 - DNA, 5681 bp, Oryza sativa
gagaaattgcacttgtaccgatcgctgtaccagcagaacagcaacacgctcaaaaaccgaagcctggcacgaccaccagaagagcctcaacctttggaactacgcttgcatatatgaattgtataaatgatccatgcgctgcagtactcctcgctgctgctggtcgctgcaactgcaaaagcctcatgttgcccgctggttaaaccgcggtcacccgcacccttccaagaggcgcacagcaactcgatcgaagcagtgcatgcatcatgcatgcattgtatggcagctagcgtacacacgcccgcgcatgcacatgcacatggccccctcgcctcagctcgccggccgctgccggtcaaacccggccgtgccgtccgtgtcctctccgagacgtaccaatcgcaagcccttgtctctgcctcggctgtttccgatccaagcacaagcacgcacaccgccgacacacgctctgatcacgctgctgccgcgcggttggtgtctctctgcgtgtgtgcgcgcgtgtcgtcgcgtttggtgtgcatgtcgtcgtttcggagagcggttagttctcggtaaagagaagctagttttctggtgggtaaccttcacgtctcacgagctacgagtacgacgcattggtgcagcatgcaggggcgtgcaggtgcagctttgatccaaaagccaaaagggagggcagcgagtgcctaccaaactgccgtcagcctgactgcatgaggggcaagacccggcacacgcgtacaagtatatacgtcgcgggttgttgcccgagacgcgaacgcattattttgcgcatcgccaggggaggccggcgccggtggaaggagtgaacgaacgatccagcgcgcgcggggccggacgccggagcgcatggaaaccaccgtaggcgcgcggccggtagctagagtgcgctcgggcctaatgtgttttgggtggaataccggggtacccggtaggccagtacaggccgggttggtgtaatcatgggtatatgatttcatccaataggatttaaatcattgtgcccacgtgagtattacgcattacgcatatgcagttgcgtcttcgcacccatgatgttttgttaaaaaaattagtcgatcacccaaaaacgctattagtcatctactcatctgcatataaccgtcgacgtccgaaaaaattggttgaccactgaaaaacgctattagtcatttaggcttcacggtaccgttggctccaccactacatgtgcttatagtcggtttataatattatagaagttgtttgcggttatctatccgacccattaaattttaggtattgttaaattcttggtaagttttgacactagtaattcttaaatagagttgagatggattatacatgtttgaattgctatccgtgtgaagccaaatattgatgatgtggagaagttttttattagtacttatagtgtactgtacactctctattacaaaaatataatgtgctttagctttttatatggtcgctaacaatgtactcctacttggcaatttgtttcgtaaaatatcattagtgaccactgaccagtgagaagccaagattatctcaagtctagagctgaattactgtagtttttcatatactccctccgtatatgaaaaaaacgttgttctagccataacctcgtttgcgatttaaacgacgttctgaaccgcagcagactatgtggacgaaattacccttgtgtctattcgatagccgctcccgcaattaatccgcagcacgcccgcgctcgcctcgtttaattccttaagcgtcgcatgcaggcatgcaacacgccgctcaacctcgccgctcacgcttgccgccgccgcttgcgtcgcgctcgccggtcgcgctctcgtcactctcgccgccgctgctctcgtcgcactcgccaccgccgctgcttgcgtcgcgctcgccggccgcactctcgtcgcgctcgccgccgctgctctcgtcgcactcgacaccgccgccgcttgcatcgtgctcgccggccccgctctcgtcggccgtgctctctcacgctcgccgccgccgccgccgccgctctcatcgcacttgccgctgccgctcgcattgttaaagtagtagagattttgattgtgtttttttcatcggaccggtaacaacctgtcgtgtttctcccgcaggaggaggcctgccgggcagtccgcggttgggccggcacacgcgtagtacgtacgcgcgtacgacgtacacatacacgtcgccgtttgttgccgtgacgcgtacataccacacatctcgcgcatctctcatcgggtgcactacgcagcagcccagcacgtaggcagcggctcgctgccggtggaatagttgagccggcgcgtacatgggcgcgcgggctcgccgcgtacatgcgtgtaggcagcgccgcacggcccggccgcgcgatcgcgatcgcgacgagatcatgagatgacggaggagcgcgtcacgcccacacactccaaagattgtccctatatatatctttggttactcttcatcaggcgagatcttgtcgatcctattttcgtacataagcggtaaaaataattgcagtgcccatgttatattttgaaccgctacaaattactatgtgcagaaatattatgataccactaatcttatttatctctgctagagtccccgcgaaaaaaaaaagaagaagaaagaaatctctgcaggagtgcaaccaaacgctccaatgggcaatgggggcattcggccactgcagagagaataaactgaaaccggtgcatgacctggctaaggagtaaatgcaaaaaacatgtaaatttcccgaatgtatcgatgaccattttcgttttgtatcaaatgttttgcctagtatactgtatagtttttttttagagctagtatactgtatagttgaatcatctagaaacggaaacccaaaatagtaacagtgtcccataaacaacaaataaaatgatatataggacttttttgtttacttgttttgccaatataccattttgtccagaatttttgagaaaccataacttttacaaaaagataaaaaaattatcgttgtacctggatgttgttatgtttacttgtccttatattcgatgttatcgtcatgcttagggatggcaggttttcccaatagcgaggacccattgggggtgcatcgccctgaaaccgactagaggtagagcgggtttgatagtttacccacgaggccacatgggggccaaacaataacatagtaactatccatcaaaatatatatacaattgattattactccatcaaaggatggatcagtccatggcagcccatatgccatatgcaatccaatccatccaaccatgcataataccatcgtcgcagaactcgtgtacatcgcacaacgtgctacctagcacctctcacgctcttcctcctggtaccaatgagcaacggccgacctctttttcctccaccaactcgagcaaggagatggcccagcaattggcgatgttcttgacccctaaatgcccaacgattgcaatcatccctaacatgctgatcaggtctgctaattctctttattactccaccattgtgttctgcatgcaggctttgtcaagccatcgaccatcatccttcctccttgtcgcatcaactctcgtcccatgccttgcagggccctggttaggggtacgggaactcgcttaagatgagatgagagcatattttgccccgaagtagacgttgaggattggggaaggggacgtttcaggttcacccgctctattgtcacccctaaccaacatggttcgacactgttgttatgtcttagagtggacatggcacggccgggctaggtagatcgatctagccatctcagcacttaacccgagagctcttaaatatatagtttagcttgaaaaagcaatggtgatgttggggtcgtaggtgcatacctccacttatcaaggctcaaatcacggcgaccacgttgttaggagatcgatagaaatttaatgagattaagtatttatcaccgaatttcttctttttaagcgtgtgttaaaggaacaaattcacggatgtgtgagtggtttgtatgtgcataaaggtgtttatggatatgggtctaccttgtaatgaaatgaaaatggttgggcctatctctctttttctactgttttatagtagcaccatttgcaccaatacgaggacactcctatccttgttcgatccgaggaattgactgacgagggatccctgtaaagatggccggttaatcgcttatgtacactattgcagtgatgatgctgtactcgtaccgtatgtgcccctgctgctactgtacattcagctgcacagtgcaacatcagcctgtacgtgagacatggcagtatggcactactagcagtagcagcttgtatagcatgttcttttcacaagctataccggcgaatttcagaattcagatgatactaccacagcactcgacagagcttggtcgttgcgtaattattccgcgcaaccagggacaggcagtgagtacccaaagctagcctatcaggtgcgccgctgtaagtacgtgacactgtgactgtcactgtagccacagtactgcagacaaacgtcccaggatctgatgggctggaagatggggttcctgtacactcaggccggctgcatcatcagaccttcagttcaacacatcgaaaccgcacagactgtaactctggccggcccccgcactgtcgcattgggctcagcccatctgatctgtagtctacaggcgaatttttttcgtttttagatttttttttaatatttacagaaataatctatcgacaaaaaaattgcagaaatagcccctgccgccctaatggtgggcggcaagctgacgtggcagacgatgggtcgaccgcgccgtctgccgccgtcggccaaaattgcgattaggcccttgccgctcgtacagagggcggcaaggggctaattgcaattttgccgcccataaagagcttgcggccgtacttttttcatctgggtcccagatgaaaaagtacggccaaaagatttttctatgttatgttaataataaataaagaagtatttattggtaaacttgttaatattgttataaaaatgtattgaagttggttgttgcgcaatttcatatgttaagtgaggtattattttgtaccttattcgatgtattattactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggaggaaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctatgtggagttagaacccttctggtgtctatccattctctgtattgacatcacgagacctaaagacatgacatgccgaagtctgacattacacgacgaaacat

SEQ ID NO: 30615 - DNA, 513 bp, Oryza sativa
agggagagctggagagcgagagattccggcgtctccgcctcgccgtcccccgtctcaccgccgccaccgacgctgcagtagcagccgaggccggtcatgctagccgacctcaacgtcgacccgccggagagcgacggcgaggaccaaccaccaactcccaaccccaacgtaaacccagccaccgccgctgtcaccgcggcgacggtggtcgccatcgattcctccactaggtacgcgcacgaagttaattctcgatctgaccgtacatgatttcttctgcttgtgccctcatgtcccctgaagtagtttggaattgaacgtcagattcgcggccctcatggtcgtttgtcgcaaccctagaatttatacaggacaaagtgatttttgcgtctatgggacaatagtcctgtcatggcatgttttttgttgggcgtattcatctgaaatgagccatccgttagattttcgttgctagctgaaattatttcataggatcattctgtaaattttaac

SEQ ID NO: 30616 - DNA, 25720 bp, Oryza sativa
tgcttcctccggtggcagaagcggccgctcatgtcggtgtcgtcgtggcagccgcagccatagcaatggccaagctcccaagtgatcacccatggtgttcgacggttcgacctcgagagctccatcaatggcgtctagcttgctctcaagctaaaggtaccccactccatccatcgttcgcattggcaaaaaaaagattggatcttacgaaggatgaactgatcatagtctcagtgcttcatgtatcgatgatctagcattctagctagggatcaagcaatgatcctagctagctaagctaagctacctgccatttttcatggcaactcgagcttggatttgtgatggacacgttgcatgagaaggcgccattgttgggagaagaaaaagaggatcttttgggcattcaacttggtgagccagcttccttctaccactagctctagcaccaaattcttttcattttttttttgcttggcaaatcttgatttttttttcctttagttactcctacttttgtttagctttgatacccaaatctgatattggtggagttgttatagattgttggttttgacactactactactacataatatctagatttctagatctgtgttaattactatgttaaaagggtttgtgcatgcatgcacgctcttgcaaaattaggtcatgttgcatatacaattggtttctttgatctcaaataatgaagatgatctccctattgtggctcaatggattgggctcatttttaaattttatccttgcatttcacttcctctctctgctgtttgatgcgcttgtttgtattataactaatcatgctttggccaccactagctataaactaatgcaatttggttggtctttgttttacttaggggggtaatgaacaatgatcactcttgtgtgctgcgaaaggccagtgcattcttgcacactgtagctagtaattaattactatatttataccactcttgtgtagctaagctagctagtataattctcaaatgtgtgctagctaagctatagctgctgcattaagagaacaaaaaatagtagaatcatgtctcctgctgcctaattaaggagaattttattgtgttcttgtcctgtgtcagtgtgtctatgccccagatatgctgggaagctgtccttgggagagcatggaggaaatggcatgatcccatgcatcaatggcaaccctaattcctgccccctgtcccctctaacaaaatcatgggatttctcaagcccaagtacccccttttggtggcacaccctgcaatccttaaatctctcacttagcttgttctctgctgcctctcatctctctgaagatgaccattatttatttttactccattttggatatatgaatctctctctctctctctctctcacacacacggaccatttttactccatttttactccattttggatatatgattcctctatcttttttttttgaagactttgatttctctatcttgattttgcattgggatctttgaatgcatgaattcttaatttgttggttgaactgcattccatatttaacacatacataggatttgttaatggttccttcattcttcttgcattacggccgctttgtttaattgcatactagttggatcaaaggaagagcgaaaagacagtgccattcatggaaagttctttaggttgaccacttatagtctaccagtcgtaccaacctttctcccaaagttgttcttattaggagtagtatttagagaaacaaagttaactacaaatcgaagcactttttttttgtgtaaatctgaagttatcctagctcacacttcaatttaattattgtgccccattaaattcattgtttctgcatatataccattttatggctaggaacttaataacagtaataatttattagacatgtccttaccaaatggagttcagacttcaaactaaggaaatgattttattcatgtgtgtcttggttcttgaatttatagcacataaatagcatgactctcagtaataaatcatctgcttagatatcataaattgcatatcgaaagcacggaccatcttttatccatgctcaataaataaatagcggagaaaggatcaacattattgattgcattctttcgtcagtatcacttttagttgattttagcacatcagcaggcagcagcatagctgtacatttttacctaaccataactgactaactactaagtatttgctgacaatattatatgaaaaaggctttttgctgatgatgactatctaaatttaatttgtgaatatctttgtgtgattcctagctatatatatgtgtgtttctttaaattttgttgattttgtgatcaatgcatacgtcatctgtagtcattggatatatatatcacatctacaacctctagaaaaaaaaatctgattttgacttttcaaaatcaatatatcggacctattttgatcactcaactgtgtatcatgatatgtatattatatattcaaaaatatgtataaacatgtaatattattataaacatatatatgaacaaaaaaaattttaattactcgtgtatcgttccatatgtccaaaaatatatacactttagaatatttttttttgtcaaagttactccctccattccaaattgatctacatatttcataagtacaccaagattaagaaaaactaataattatctcatattatatttactctagcaacaaactcgatgcatgcaccatccccgctatttcctagccaatagcaaattaagatattgcatgtgggttataaatacttgtgtgcatggatgtatgcatcaatgtctatttactccaatgcataatccaatgcataaatagcaaatagacttaatgaatgaacataaatatgtagattatttaggaataacctaaaaaaactatatgtagatcaatttcgaacggagggagtaattaatatctattgattgcacaagttctaaaattaattactgacgtatatattttgtggccaaagggatgtgacattgttctagggctaattattatctcatatattcttccggagattttgcagaatttttcatacgcaagcttgattttctcctaaacaatttaacgtatagtttggttaattagagcagaaaaacgcatgcaaaatctccaaaaaggccaaaggcaaagtactgtttgacccaaaagatttgccctagtataaactaaattaaccgaatatgacataagtcaatgataggatcatgacatatttggtggcatccatccattttctttaaccattcttgacacatacgtgtacacacagttgccaacagcaatgcaagcatcatgcacacgtaacatcacatcggccagctagcataagctagcacaaattaaaggcagatttcttactgaacgagcaaaaacacacatgcaattactacgttttctttctcaaaacacataacctactgtatagcacttttcgaaagatcgacatataaaattgacaaaggtaccacgtaccactaaaaagaattattagttgcagtaatatgtagggcttgatcgaacacctcgggtgagtaggtttaactgagtgtatttagttatcataatttttctacctttttctacacatatttttgtaccttttgttttcatacttactcctattttgcaggtatatatttttataaaattaatggctgttgatagtacctttttttttcaaaatcaaacataaattctttagttgttatcaagcagagtagctgtatttaattggttcaaacagtcgtgcagcacaccatacgaaccacagattggtcatatagagtctggctatcaaatggtgcttatatatatagttagttaactggaaacatacatgactagtatatatgtatctttttgtagggttcttaattaataagcttggtcgctactagctagatactgtttctaattaaagaatacaattttcgtagagacaaattaataaaagtgttagagcccagaggtcggatccacattatccaatatacatatcttgtatactaaagcttttatggtagagcatgatcaatcttccttatcatgcatactctaacaaggaggcagctagaaagttaattaattaagcatatgaaaacaaaaccatctcctaattaagcttctgaatactgaatcatctatctcttaattaagattgaaattaaacttagtcatgtgacagacaattcgtgcgtgcaaaggtttccgaacaaattaaacccaagaggagatcgtccgtgcatgcatgtatgtgctatatgcttggacggaagagattaaacaagtggattttaatttgtagagaaatcaattaatttttctgtcttggctagttgtaaaacttctttctttgaggttgtttaggttcatcatcagagctttcctcagaacttcgccataaagttgtagaactaacgccatagagttatatccaatttaatttgcattaattgtactataacacagaagagtacatgtatgccaaaaatatgatatgtgtccaattccataagtttgcatgcatgtacaattttaataattaactccattttgtacagctcatcagcaaactccatacacgtggcacgtagcgattggtctaacggtgtcgcgcaaggtagcttacctactcagctagcaacacgtctccatgccgccggctcgccacgccggccgccgtgggcaccggccgccggcggctcgggcttccgtatacgataatatctacggccgtgggccttgcggcgtcggcgatggcgccggcgggtgcccgtcctctccgcccgacgtcgtcgccacgatctcctccaggtccggcagccgccgccgccgcggagctcccctcgtggtggtggtgaccgtgatggtggtggccgtgatggtggtggtggtggtcgacgtcgccgccggcgtcgtccgcggcgtcgtcggcgccgcgggtgctgtggcgtcgcttcatgagaaaggggatgcggaggtgggagtgcggcggcggcgccgccttcttcttcctcacgtccgtcgcccagctgtgcaccgacacgtgcaccgtctcgccgaacgcctgcagcttgatgtccccgcccatctgagcagcggcgagcgtgacgtcagccccacgtcatcggagtcacagttaaagcataatatacttaatttttttattatactccctctatttcatattgtaagttgtttgatttttttttatcaaacttttttaaatttgactaagcttgaccaagttttttaaaaaaaacgtatttaatttttttataaacttaatctaacttaataaagtttaacttaaaaaaaagtcaaaatgatataatatgtaatggaaggatcggagtagtagcaaagagtaattgtatgttaattacgtgggtaacgatggcgtatagcggcagcgtgctgtagctgcagagcacctggacgatgattctgcaaaagttcatgacagaaacatcacattactgttcagttcaattcaattcagtgcagaaatatgtactaaaatttttttttagagaaggtaatacagaaatatttgaattttttttaagattccaattaaagaaaagcaatcaatttctagcagaaatcagatgtaaagctcagacttttagtactgacccaatagcaagtctggggagggcataaatcttgttctccatgatgcatgaatcaaacccatatgttgcctgcaattgaaatttaccagcttgtttaattagcaccatagttttatactaattaaaattgcagaaacccatatgaagacataagagtactttctgcaagataaattaaaagtgcaggaaaaaaaagaatgtaatgctgtaaaacagaccagaacccagaagaaaaaacccatctcaaaggagttctggaacaggatgaagtggatcaaatggaggacaatcctaggcttgctgaaccagaagtgctccttgcatggctttgtccaggggtttcctgttgcttcatctgggcagtctgctgcctcttgtgccagcctagtgcttatgagctccagctttgtgccaacaatgagtaggagctgcagatgtgccccaaaagttggaattcctcaatcattaaaactgaaaagagtgtgctcactgttgacatatatgttgagttgtttgaagttcatacttacaattaagggcaagaaagacagccagaagtatgtgtgccaccctgcattggatgcaaatgaaaagtttaggggatagccacctgaatagatgatggaaactggatagtttcattcaatgacaaaagacaatcctagttcaggcattcaacagtctgatgcagatcaattgttgttgtgatccatgacttgttctgaatgagtgaaaatggatcatgttcgtcaactggaaatgctgtggttaaagtctaaattgtggtactagaaatagaataagtcgtatggtaacttaagtggatatctcccagcaaaaaaaaaagaaaaaaaagaaagaaaagaaaatttaagtagatatcagtgtgatggaattcagttatccaaacaattacatgagggcacttgtttttaggtttatgggagttaccatttatattcagtagcaggaagacaataacgaaaagccataggtaccagctgcatgtaattgcatagcattagatacagtaaagatgatgtagtttttaatcaagtaaagttagtattttaaccaagatactaacctgattccaactacttctttaaaatcatgctcaagagcacgaaccatgtacttgtggaaatcaaaatcaggacggtttgggtagtgcctctggggaaaaaattatgtcctattagcttcaaaaatagtacaatgacacttatgattgagctgaagttactcagagatgcatctgacctgaacaaaagctgatctaagtacttgataatcaggtttaccaacagaatcataaaactgcttcaagaatgagatctgaaatcatgtatgaacaaaatcggctgtattagaatatagctaaagtaagttgaaatttgtatttgagacacagaatttctgcaataactatgcagacagtatgcattgtcctagtacaagacacatcagtgtttcgtcatgatattgccatgttgcagggagacacctcaaataagaaaaaaaagtaatacagtactgctgcagtttgtacccatgctattcatatctttgatgtcaatagcttttccgtaccttaattaaccttatctgacaatggaccatctacaggtattctattcctttatcacaatggagcttgcgtgtgtcctgatcacacatttggactttatgaattatgacaacttactcgcgagggctctacttttatattttgctggttatcgacatatttaattcctaacttacatgatcttatatagtaaaattttatttttgagttctagttctgactcttgagtgtttgattttttttttaaaaatattttttgtaaaattcactagaggtggatgtctttttttacatgataagtggatgccacaataaacgaatcaccgttaggtgttctaggaaagcatatgattacttatcaattcaaggtaacatttaaccaacactactctaaagagtagtatgattttctggccggggtgcggttgaaatccgaattgatcattggtggaacagcgaggcaagaacagaataaacagagaacctattttagtcttgttgtcatcctcctttgtaaattgtaactgacgatttaataatggagttacaaatagtaattgataagcataataggtggcccgggttacttacggcacatcttacaacaatgaatttcatccagcctggcctctttggtcgctccttggttcttccttgttgaatttctttctcccatttctcccattttttcatctgcagaatttaccatagatgagttgattttactgatgcaccgtgaggagcacatatttatccatacaaatagttttaccttggctccaccaagtaacaatgttgtaacacaaaatacaacatggacaataccaaggacaaagataaagatgtgcagctgatgcaaagcctcttcagatagcataggaacttcaccctacagaagcataagaatgtgatttcggaacgaccaatctggtaaaaaattcatgaagataacagtttcttgtttgttctactcttcaagaaagaaaagatacccacaagaaacaaattctttagtgaaaaataacaaagctaaacaatccagagtggacacttcgtggtggagtttatcaaaaattcccaaaagtttaagaaaatctctccatagttcacatcctacctttcgcttgcaaagtttggaagcatcttctgtggtctcggacgtctctctagtaatgcatggaagcatgagatgtgcagcactctccgggatgcaaatgtgattgataaatttttggaagacgctaagcaggaaggaaatgaaacccagaagcatcaactctgcacaagtaatcaacaagctggatcaggcagtgaacaaatggcacaaattattgtggcataagtaaactggtatgaaatgttctggccatcgtgtcatgaagcattttattttatcatttggtgacgataagatcatcttttcaggttctgctggcagtaatatgtgaaagaaacagagtgaaaattgtcctttgtatccaagaaataaattgttgtacaggcagcaatctaacattctaactataagaacttggatgatattaccttctttgactctctgaagagcagaaaacagtgcttcttgcccattgaattttagcacctgatgaacaaggatacaacaattagtaaaaaaggcaaacttgttttgagcgaagttattgctgtaaaagaaagtgatggctcaatatactgcaggaatttgcaaggctaaatctctgcttcctacagagtaaacttcaatttcgagctgtctaacatctgaatctaacctctctctctctctctttttcaatcctacagttgtatcgcccgagttcatcatgagtaaagccatacgagaaacagtgcagtgcagtgggaagtgaagcagcaagcttgaacaacaattccaggtcactgacagatactccctctgtattctaatgtatgacaccgttgactttttgactaacgtttgactattcgttttattcaaaattttcgtacaaatatgaaagtatttatatcatgcttaaaaaaacatttgatgatgaatcgagttacaataaaataaatgataattgtataaatttttttaataagacgaatggtcaaacgttggataaaaagtcaatggcgtcatacattaaaatgtggagggagtagttaccagcaaattccatggtatatactatactatcaatttgaatgagcaggtgatgttcttcatcgaatctgaatgcttagtaccagaggattttaactaagaacaactggaaacactactgatttgagccgcaaagataaaaggggaggtaattaattgaagcaaattaagattggcttgccttgccgaggcggtggaggaggcgctcggcggcgagcgagatggcgacgatgatgaagcagactccggccaccacccatgtcggcgtcagcgccagcgactgctcctcccctccctcccccgcccccatctccgatctccctcctcctcctccgacgaggcgatgcgcgcgcgcgctacccgcaccatgcggctgccgttaaaagggccggggggcgcgcgcgcgcgcgcacgacagcgagcgccatggatggcgccaaaaaggcagcctcgctttcgaactcgttttttgtggcttctgtgctcttgcgtgctactccctccgttcaaataagatggacggtcacgttgtacacggagactcggttttttttttattattattattattattattattattattattatggagggaggactcgtgtactagtgtactagtactactgtggtggcgctcgcggcgacgtgaggcggcagaaaccggcagggcgtcagccacactgtggagtgtggatgttgatgcgtgcatgtttgaatgctcttttcaacaccaaataaaaagaaagaaaagaaagagagaaaaatgtatggatgctgctgctgtgtggtgaaaatgggactgactgacctcatctgctgatatttcatctgaggctgagctactgaattatttatctattgaaacaaaaaaataaactactacatacatcccaaaatataacaaacaatgcaatacagaatgtgatacatcatattactacgaatctgagcatatctcatatcaagaatcatcgtactagaaaatttctatattgtactatgttgacggatgcatactgaatcattcatatatgtagtgtgtatatcttagttgtgttggacttattcatggataattcttctgaggaaatgagattgaactagtgacttaattacttcttcaatttcatattatataacgtattgttttctccgtccatggtctagattcactaatatacatataggtttaaaaacatttataacacatatgtagattcatccctcgtatagattcgctaccatacaaaggccactctccagccacttggtttatcatgtcatggcctgagcagtaaacttaaatgggcagattatcgagaatatcaagtcgatcctcttctaggaggacagatggctacaggattcgagccttcgctcttaggcacctgagctttatgatcgcgtcccggtgcgtgtccgccgaaagctcttggtcgctgatgcgttggccaacaaccgttggatccgcgatctccatggctccttgggagtccaggcaatgctgcaatacttgcagatttggtcgttgttgcagacaacaactctctcaaaggaccatcctgattctttcatctagaggtgggagagttcggggtcgtactctacccggtcggcttaccttgccctcttcccaggcaggatctcattttagcacctaccaatctggcgcttttttgcccctctcagtgtcgctacttcctatggtttgtcgctcaacggagctgctggacggctgaccggttagagaagcgtagtctgtcgcacccaacctattgtgtcttctatgaccaactggaagaaacaatcgattacattctgattaggtgcgctgagtccctccagctgtggtggactatcttttcgagccttggccttcttcaatgcttcccctctgacgctgattccttccatgagtggcactgctctttccggctcaaaattctgagggagcgtcgtcgtgggttcgacactattgtgactcttggtgcctggtccatttggaaggaaagaaacaaccgttctcgatcctagcctgaggttgtcgcagccatgtcgcaagagacagcgctttggcttcttgcccatcccccatcgccaacactttctagttagcgtgtttggtcgttcggccgtcacattgtaatcacgagaatagacttaagtctttgctttcctttttttcctttccaccccctcccccctccccccctcttctttgtttgccgtttatgtaacttttatttctcttaatgcaaaagtgtacaatgctcttttatgtattccaaaaaaaaaagtaatcgagaatattctataacctttcaaagagcagtagcgatggttatgacttttttacagccactgctttactagctttcctatggccgttgttatgtcctacactcctacatccccgattccccgtcgtagttagtcgagcagggtccaaatggtgggttttggttttgataaaaacgatcaaccatccatatcatggataacgacaatatcatttaccgttaaagaaaaaatgacaataccatttaacatatactggtataattagctactttctttacatagataatactcgtcgtttggaattggctaatgtcaaactttggcctagattagctcccaactttttcttcaaacttccaactttttcatcacatcaaaacttttctacacacataaacttcgaacttttccatcatatcgttccaattttaatcaaacttccaatttaatttggcgtgaaataaacacacccttttaaactttttaactataaatattttaaaattatttgttttaaaatatgaagactatatgtatatattagtcttaaaaagtacatcaatgaaattatattattacaatatttctatttatattatgatggaggaaagtggtcaaaattgtttttcgagaccgtttacttatctaaaacaataagtattatgaacttggtgggtgtgagcttattttcttatatagctcttgttcaagttcagaaatcttttttaaaagaaaatatagtgggtaaaaaaaatgatgattgtcagggttacgggttaggcataccctttacccttcgatatatgttacatatcagtatggtatacccacgcgcatacagatacttcttgtatattctatggaaatccttcacggaatctacggatgggaagaatcctactcggacaagattgggtcgttgacgtatcgaatagggtctgatatctccaagttctacttggagacctccagatctgtgatataaaagggaccccccggtgagggcttaaaggatcgaatctcagagccgacacaacccacgtagcctacgaagccggagcctgcaaggagccaagccatcgagatctagtcgaatcaactcgactacgatttcgccggattcgacaagttccattgttccctttgtaacatgtgttttccaccatataatcccacatcaactggattagggctattacctatcaaggggcctgaaccagtataattcttgtcttttgttcgcttgatgtcgtactacgtagatccttgtaccaacgtaccccaataccctctatatccggtctacgggcatcacctatcgacagtggcgcgccaggtaggggcacttggtactcaaggttctactactatgtcatccagcttcgtcgacaacggcgtcaacaccaacctcagccaagtacaccctgctttaacgatgctggtatggactcaagtcagcgaaatcgtcttcccggtttacaccacaacgccgatctcaaccggtcccccaatgaccggaaacgagaacgcagtgtctacaaaccaagacgacttcatgtcgaaaaatcctcccgctgagacggagaacggagcatcgacgacatccgagctcgagaaggattctgatgcggccaaaccttgttcttccgacatgaatcgcgagctgacaaagatgacttccgaagccacaaggtcctggtgtcctatccacaaaaccaggaaacacactttgtaagcctgctaggttttcctcaacgtccgcgctgaaattcgcgcctgcaaagagcgtggaattcagcgtgtttctccaactcgtgatgtctattgtcctattcacaagacaaagaatcacgacctctcaagctgcaaggtctttcttggcgccatgaaagctccgtctccgaagtcatacgtccccatcagggataacgacaaggaacaaggagcgacttcaacttcagatcgatttgttggggtaatcgatatcgatcctcacgaatcatcagtcttacaccttctcgaagactatgggtcatcgataacgagtgcgccgcgggaggtattggctatcgatgacgttggcacgtcagcgcatgccaacgcagaagcgggaggacaattgactactccagcccagcacattagggccgttcaagctatactgagggaaactccctacgatcccgttctgaacgatgacctcgagcgttggacagaatgactacgggaatcagtgaccaacctcagcaacgcgtttgaagaagccgctaccgcagcgcactcggagcagccaccaactggcgatgtcaatggtgaagacccagaacgaagggaatcaccccaacgagctacccctccacctcgcggcactggcgatctccgagatcacatcaacggccgccgagaggcacgacgtacacaagacaatgtgaatcgttctcggcgtcatgtctcttcacggcgccatgataacggaaatcaaagagaccgctcaaacgaggaccgagaccaggacaaccaccacgatcacaacgatcgcgaacgacgggtgccagacaatacaggtcgaggccatcgccataacgaagacgatgacagagatcggcgccgagacaacagtgggagacgacgacaggattcccgagatccaggccgacatcctcgtaatcgtacgccggaaccaagcgacccgtcgtcatcgtcatcatcctcgtcctcctcatcatcagacagacatccacgaaggacacacgaccgccgacaacccaccgcccccaacgctgggtgtagggctttcggtcgttccctgcgtgatgtccgatggcctgagagattccaacctggagcaatagaaaagtatgatgggagcaccggcccagaggagttccttcaagtctactccacagtactctacgctgccggagcagacgacaacgcgttggcaaattatttaccaactgcgttgaaaggttttgcacgttcatggctgatgcatcttcctccctactcaatctcttcgtgggcagacctatggcaacagttcgtcgccaatttccaaggaacatacaagcgccacgcgatcgaagacgacttacacgtgttgactcagaactcgggtgaatcactgagggaatatgttcggcgcttcaacgagtgcagaaatacaatccccgaaatcaccgacacttctgtaattcgcgccttcaaatccggtgtcagagatcgctacactacacaggagttggcgacaagacgcatcacaaccactcggagattgttcgagattgttgagcgatgcgcccacgcagatgatgcgctaagacgcaagaacgataagccgaagaccgggggagacaagaaaccagccacggacgcatctgagtcaagcaaaaagaaaaatcgcaaaaatgggaaaaggaaagctcaagtggaagttcttgcagcagaatacgtgaaccctcccaagcgcccagacccacaaagtagcaacacaaagaaagcatggtgccccattcacaagacggacaaacattctctggaagattgccttgttttcaaaaaatcgctcgagaagcacatcgcatttgaaaaaggcaagcgagtacgcgtggtcgagaagaacgaggaggaggttcctcacgaatcggatccagcgtatccagactccgacctccacgtttcacacatcttcggcggttccacaacgtactcctcaaagcgagaatacaagaaagtggaacgtgacgtctgttcgacatggcagcgggctgcacccaagatgaagtggtctgagcagaagatagagttctcggaagaagaccaccccaagaccgccgtcatcccaggacgatatccgatcgtggtcgaacccactattcggaacatcaaggtagcgcgagtcctcatcgacggtggcagctcaatcaatcttcctttcgccagcactttggacgcaatgggaattccgtaaagcgagttgacaccaaccgatcaacccttccacggaattactccccaaaaccattgggcaagattacgttgcccgtgactttcggccaagccaacaacttccaaatagagcagatcacctttgatgtcgctgaattcgacacagcttacaacgccatcatcgggagaactgcacttgcgaagttcatggccgcatctcactacgcgtatcaagtgctcaagatgccgggaccgaagggaacaatcactattcaagggaacgcaaagctggcagtgcagtgtgacaagcggagcctcgacatggtcgagcaaacgcccagcccacccgccatgactgagccacccaagaaagtgagcaagacaaacaagacgccgaaaccggacggcaccatcaagatcgttccactctccagtgccaaccctgacaagaccgtcaagatcggggcgacactaaacgagaaataggaactcgcgctcatcaccttcctccccgataatgctgacgtgttcgcttggcagccgtccgacatgccgggggtccccagggaggtgattgagcacaaactcatggtgcgacccgatgccaagccagtaaagcaaagactgcggagatttgcaccagaccgaaaacaagccatacgagaagagctcgacaaacttctcaaagctggcttcatcagagaagtacttcatccagagtggctagccaatctagtcatggtgcggaaggccaacggaaaatggagaatgtgtgttgacttcaccgacctcaataaggcatgccccaaggatcacttccctctccctcgaatagatcaactggtggattcaacagccggttgcgagttgttgagcttccttgacgcttactctggctaccaccaaatcagcatggcaaaagaggacgaagagaagacagcattcatcacaccgttcagggtattttgctacgttaagatgccgttcggactaataaccgcagggaatatcttccagcgcacggtccagggcgcacttagcgaccagcttggcaacaatgtcgaggcatacgtcgacgacatcgttgtcaaaaccaagacaggcgactcattgattgccgatctgcggcaaacgttcgacaacctccgacgatatcgcctcatgctcaatccagagaagtgcatgttcggagtaccgttgggcaagctgctcggattcctcgtttctagcaaaggaatagaagcaaaccccgagaagatcaaggcaatcaagaacatgaagtcgcccacaagactcaaggaggtacaaaagctaaccggatgcatgacggcactgagcaggttcatcgctaggatgggagaacgaggacaacctttcttcgctctgctaaagaaacaagacaaatttgtatggacacaggaagccgaagaggcatttgttgcactcaagcgctacctatcaaacccccctgtacttgttgctccccaacctaatgaagaattattcctctatattgccaccacaccgtattccgttagcaccgtcattgttgtcgagagagagaaagtacaacgaccagtctattacgtcagcgaagctctccacgacgcaaagacaagatacccacagatccaaaagctactttacgcggtcatcatgacatcaaggaagctacgccactactttcaagctcacagagtcacagttgtctcctctttccctcttggcgaagttgtgagaaacaaagatgttgtcggccgcattgcgaaatgggtagtcgagctgagccagtttgatgtccactttgtgccacgaacagccatcaagtcccaggtactcgccgatttcgttgccgattggactatgccggataacaaatcagacaaccaagttgataacgaaacatggacaatgacgttcgatggcgcactcaacagccaaggagcaggggtaggatttatcttgacgtctccctccggagatcaattcaagcatgcaatccacctcaacttcagggcgaccaataacacagcagaatacgaaggactacttgccgggataagagctgcagctgcacttggagtcaagcgactaatcgtcaaaggggactccgagctagtcgcgaaccaggtgcacaaagattataaatgctctaaccccgagttatccaagtatcttgcagaagtaaggaaactagagaaaaggttcgatgggatcgaggtccgacacgtctaccgcaaggacaacattgagccagacgacctagcacgacgtgcgtccagacgagaatcgctcgagcctggcacttttctcgacatcctgacgaagccatcagtgaaagaggttagcggcgaagttagctcggacacccccgacattagctcagaggtcaccaaggtagaacgtgccgtcgccgacatcgagaccacagacgactggcgcatcccactaatcaaattcgtcaacagcaaggagttgcctgaggacgatacagaggccgagaaaataacccgtaaagcaaagatctactgtatggtcggcaacgatctatacaagaaagcgccaaacggggtacttctcaaatgcgtctcgaccgacgacggcagacaccttctcctcggtatacatgaaggcatatgtgggttacatgccgccggtcggacattggtcgggaaagcttttcgacaaggctttttctggccaaccgcccttaaagatgcatgcgacatggtctagcgatgcgaagcctgtcaattccacagtaaacacacaaagctacccgcgcaagcgctccagactatccctctaacttggccgttctcgtgctaggggctagatatacttgggccattcccacgagggcagggcggctacagattcctattcgtggcgatcgacaagttcactaaatggatcgaagcagtacccacgggggaaatcaaggccgacaacgccatcaaattcatcaaagggatattttgcagatacggactaccgcaccgcatcataactgacaacggctcccagttcatcagcgtcgatttccaggattactgcatcgggctaggggtcaaaatatgcttcgcctcggtctctcaccctcaaagcaacggacaagtcgagagggcaaacggcatagtactacaagggataaaaacccgcgtctacgacagactcatgtcacacgacaaaaaatgggttgaagaactcccatcagtactatgggccgtacgcaccacaccgacaacgtctaacaaggaaacacccttcttccttgtgtacggctctgaggctatgcttcccggcgagctacgacatcagagtacacgagtacagaagcactgcgatgaggaccaggaggaacagcgggacatcgatgtaaatcttcttgaggagcatcgtgaacaggttgccgtccgagcagccagctatcaacaggcccttcgccgttaccacgagaagcgcatccgagcacgcataccttcgatcggcgactacgtcctccaacgagttcaaagccaagcagggcgaaacaaactctcaccaaaatgggaaggaccttacacgatcacacaagtcttgtggccaggcgcattcaaaatcgcagacggcgacggtcgcgagttagcaaattcttggaacattgaccaactacgtaaattctatgtatgagtcaataccatccatacctgtaagacaccttacagtatcaatgaagcctatttttaggcccatattacaatcaaagtgttttcgcctgatgatcccttaccctgatgacacctcgcgttgaaacctgtccttatgtccctttacgccgtcttgaaaaggcctctgaggaacctaagggatcttcggctggggacgcccagagccgataaggccttgtcagatcctgtagagacgaaagaccatgtaagatctggtcatgtaagtgttctcgccgtgcgtattaaccaagccgtaaaatcggaaatcaactttccaacttcacggttgggggctaggatcagagcttatttaaccaaggcgggtcaaaggtccaagagccttatcctccgagaaaatttctccgacaacaaggctgggggctagggagagtgtacgactcaaacggctgactaaagtcgttaactgagaacgcactcttacacacgacattcagagtaagagacatttgttaaagatagatttctttactatttcacacaatacttgttacagtttttacacaaatctttcgctacattacatctttttcctaagatatttgtcacagggtacgaaaactaccaagaaggccaacgctagtccatagactggaagatcttctcggccaatggcgacatcgacctcgctagatggtctatctccgccggagtcctccgagaacaagcaaaaccctcacggagaaattcgaggtccaagctcgggcgatgacctcgtaggcaagccaacacgtgccctccggcgtatcggctcgatcgacgacactcctgcttcaaggcctcgtcgatacgcttgccgatgccatcgagttgggcacaggccccgttcagccacgagatgtacccggccgccgactcctcaggatctccgcggaccactcgaagttctttacagactctggctatggatgtgcagcaactctttaagtacgagttaaaccacacctcacgacctcggagcgtttccacagcctgctctttcttcacggccagcatggttctctcgagttccgccacttcaaacttcatcttccagtattggatatgacgatcttggctagcaagggcaccctcgagatctgcataatgtgataaccactaagtcaagctgtacgcctctttcgagaacatggctgatctagtcgggatggcatcaaggggtgaagggactactaacctgaggaagtcgtcgttatccctgtctccgtatcaagggtctaatccacattgtcgggcgacacgtgtggttcaaactcgagtactggaattatcgccagtgactcgggctgcccgcgctgctagacatcctcgtcatcagcatctctacaaaggacaagagttcctgaggtcaacatacaaaagtaaactaggatgataatcgcccgcacgaaggaggttagaattcaagttttacacattgtgtcttggaagtacaagaagtcctactcttcaaatagggggagaacagactcccccaaatcaccgacttcttccatcacctccctccgcgtgtcactagccgccccctgatccaagatctcgcgcagatcgagttcaggacgcgacagctttacacacgcgaggacatgacacgccccagtgtagatcccgttcgacgtctccttcgcgatcctggctgcatgcttggaggggatctcccccatcgccgtcgccagttccgcaagggaggaggtcagcgagaactcgtcgggattcaccaggatcgtaaacttgatgccgcactccccggcgagctggtgcaggccagtgtaggtgacccgcaacgagccctggatctccgataggttgttcccgagttccgacatgcggtcctcgagcctcttccgttgtcgctcgttgccggccaccaattccctcatcttcgtgaggtcttcacgagctccagccaactcgcgcaccagccggtcagcacgtgcgttcgccagcgctgcttccgacctcgcctccgcaatctcgcggccaataccgcgagcacccgcttcgaggaggcgccccatcttgacttagagctcctcccaggtgaggacggcagctggtggatcacgacctaccgcgggatcgctgactgggccgctaggcgtcgccttccagctcccggctgcgggcacgacatccgtcgaagccgcggcaggcgacgcactggaagtccctccggacttggcttgcgcagcctttgcccgcgcctccctacaggacgaccatgggtcagacaacgcttgaatagaatcacggaaatctaaaaattcatctacttacttctcgccgatcgtcacaatacgttgtcgtcgtggaggtgggggtgacgcgtccgaggcctgaaagacaatcaacgcaaagtaaggcaaaatccttctggctgcacgatctgacgacaggataaattaccgagggtgtcggcgtcttgcgacgatgtccgcttacagaggagaacttcctcccctttgtcgcaacattgccaccgctagtggtggcagcagcagcatcatacgcctccttggcgaccttctctttcagagacgccgccacctgatggtctgtgagtggcccgatgatgtcagtcagaggaagagcctacgcttaatcaagtcataaggtgatctcgaaggaaaaatgcgtgatgcttatcgggtgcacttacgttgatagcgtcatcacgctcggccgcccccttttcacaaagaggcgtggggatgttgctcgccgttgtcggaccgctgatcatcacctggccgacacggcgctccacggcctcactgttcagacctgtaaatcgagaaccagatttcgatgagtcaataggaacgcgaacataagcatgtcaggataaatgcgagaaagataccccgaggagaaacccgggtcgcgtcctccggtccggaataattataagctggataggcccgagcctggagtggctggatccgcctaccaacgaagtctgcaatgacttcataccccgacaagccccgtactcggagatcatcgatgatgtcgataaacggctgaagagaaggggtcaaggggggctttgcggtccaagacgaaatcttgtccggttgttctttgggaacaacgaagacagggttcgaatctttgatctcaaggtagaaccacctattccgctatttgctgcgagaagaagggcactggaaggggatataacgcgacttcaggccatcctgaagtcggaacccgacgcaaccagataccctgttggattccatccaacacagttcatagtaagagcgaaagagatcaagaaaaggctctaccccaatgtaggcctcgcaaagatggggcaaagatgctaagaaaggcaatggaattggggttcaaatggagaagagaaagaccatagaaattcaaaaccaagagaagaaactcggaaggtggagggagaagaccgcagagaacataatcttcgatcgcaaccatgcgacccaagatgggctggggattagtacctcctgcttctctctccatggttccacggccaggaaggacgccgtcttcctgaagcttcttcagcgacgcactggtggaagatgacttgctgaggtccattgctgattcaagatcgccggagaaagggcctaggttgatgaactagggtttcttgtgacggcgaagaaggcgaagagcgcttacaggtggaatgttttcaacacggttggcggacttcaaaatggatctccaaaattcctttaaataggcgcactaccgacggtgcgaattccaaggacagagagagatgcccgccggaaatttctgggtccgttacgcgcggcggttttctggacttcagtttaaaattcgctcgtgaccgttgggctttgaatggcgtgctcgactacggcctgtctccgcgatcctcgcaccgggaacgacaacaatctcgacacccgaagtcgtgaatggttacacgagcccattttaagcagaagtcgggggctactgtcagggttacgggttaggcataccctttacccttcgatatatgttacatatcggtatggtatacccacgcgcatacagatacttcctatatattctatggaaatacttcacggaatctacggatgggaagaatcctactcggacaagattgggtcgttgacgtatcgaatagggtctgatatctccgagttctacttggagacctccagatctgtgatataaaagggacccctggtgagggcttaaaggatcgaatctcagagccgacacaacccacataacctacgaagccggagcctgcaaggagccaagccatcgagatctagtcgaatcaactcgactacgatttcgccggattcgacaagttccattgttccctttgtaacctgtgttttctaccatataatcccacatcaactggattagggctattacctatcaaggggcctgaaccagtataattcttgtcttttgttcgcttgatgtcgtactacgtagatccttgtaccaaagtaccccaataccctctatatccggtctacgggcatcacctgtcgacaatgatggttcatgagttaagattcgagacataggttcataggttcatgagttaaactctcaactttctcatattctaatatgatcaagaagaggcaagatgtttatgtctttactgccataaattgaaattatgataatggttggatgcgccaaacggtgttcagaaatagtggtaaaaaacagtactagtaagtctagtactccctctgtttcaaaatatttgacaccgttgactttttagtacgtgtttgacaatttgttttattcaaaaaattttaagtaattatttattcttttcatatcatttgattcattgttaaatatactttcatgtgcacatatagttttacatatttcacaaattttttcgaataaaacgaacggtcaaacatgtgctaaaaagtcaacggtgtcaaacattttgcaacagagggagtactttcctcttaaaaaaaagtaagtctagtatttgttgggccaaattttcctccataagcatttgctctcagcccattgcagcccgaaaatctaacaaatatgagccattgattcatatccttgatcaatggtgaagattaccacatcctttgtgataggaagaaaaaccctagctttcatggagagagttgagataacaacaaccattgaggacgagaagaaaaccagcaaaacacaagagagagagagagcggagagtatagaagaaaagttacagtttgttcagcttggtagctcttatccgatcttcatcaagtcagcgattggaggttcaaacgtgattgaattggcaccaaacttggtgagtttgttccttactttgagcactttaatctggctagtttatgcaaggattggttgagtagagtacctgatttgagtagtggtttatcagctcgagttgctacagttacattatgcaacatttggtggaatgtcagtttgaagggtcaaatggtgttcaattgtgttgttttttggacagcttggaaatgactcataggccatcatttgtaccaagtttcgtgcaatttgcatatgtggtttgggagatctcagttgagaaccaaaaaggatctgctatttctctgcttgtttgttgatatacctcttgttagttttggtggttgatgttgatgatgtcaagtgtgtaacttgatgttatagctgatgttgcgatgtgcatttagatgttctagtgaagactccatttgtgcccattattgtttataacagaagcttggagtgcatcgttggtcccatggttttttactcctcataccgaagaggttttccacgtaaatcaccgtgtcttgtgtgcatgtgtctattgttgttccactgctgatttgctagttgaaactgtcctcaaagtttatagcaagatgagggttgattgtgtaaaatatgtttgccggttggtaaattatagtttgcacagtgaagtaatttggttcagccccaacaatatttaaatttaaagaagaaaaagggaaaaaaataataaaagaaaggcagtacatcaatagatcctagccgttcgatgcacgcatccagcggctgtaaactgctcgaaacggaaaacagtcgagaggactcatctccactcttctcctttgcttcgaactccggcggctttgcgacggcgccgtcgcgatgggctgcctccgccgcgcgctccgcctaggcctacgccgtgggctctcctcctcctcggcggctccggcggccgcggagcaggctgagctccccc

SEQ ID NO: 30617 - DNA, 13451 bp, Oryza sativa
agaacggtacaaactgctgttggtatgaactatatattttttttatgtgtttctgaattgcggtgtctgattggagttgtatcagggagtctcaatcggtggagggattggaagcatctcagacattttagatgcatcgcagatgatacttgaaaatgtttgtatccacactcttttatttttttttctattggtattattagctattgtggcagatatggcagttggatttctatatttctagatgatttatcttgaccgctattgtgtttctacgtgctgaactctctactcgtcatcattcttttatgcttttgctaagcagtgccataggtgacttgcaatgtaaacgacaatcttccagtaacttcagcactgaaatttgaaatttatttttattatggcacagcgtctacgtcgcctcagtccatatttcattcccaagattttgattaacatggcatccggtcatgtcagcatgagatatggtttccaggtgaattgtcatatgccatagttcaggcttttcattctataattcatttcgtacatggatgctaattcagataattaatggttcaaacttagggtccaaaccatgctgctgtgacagcttgtgccacaggtgcccactctattggtgatgctacacggatgattcaatttggagacgcggatgtaatggtggctggtggaacagagtccagcattgatgctttgtctatagctggattttctaggtaagcatctttgttcttgttttgtttactaatgttccataatactcttttatatgctctctttatgcaaatgctgtaagttttttcaatgctttatttaggttatatggtatacctttcacattatggctgtaggaagtaataggggacctcaaccaactatgtacacaaaacacccatggtccataaatatccatatgcaaactttatctctaatttttcagtgttccctattccctattgcgtctgctcctctgattagtgtggccaaccttatcttatttcattgtgatgttatttgtttttcagattaagagcattgtctacaaaatataactctcttcctcaagcggcttccaggccatttgattgtggtagagatggatttgtgtatgtcatcctttatcaaatcataccccctttctttttttcctttttcatgtgtggctattcttatctttgtttcaaaataattaataggattggtgaaggttgtggagttatggtgttggaggtgagttcagaaaaatgttggtattttacaccttcgttctgaagtttctggttgagtgtagtttaatatcagccatttaatactttgatctgtcttatgatcagtttgactcacatatccacttattgatcccttaatattctaattctttttctctatcgtgtatgcatttttttctatgtctggaaagtgtcatttagttcatcttatttgaccttaagagggttaaccatatactcttctgtaggcacttgatcatgcaaaagaacgtggggcaaaaatttatgcagaagtgagaggctatggaatgtctggtatcctcctattccacaaagagttttgtttattctgtcgttaggatgcctttcattgtgaatgactctttcaggtgacgcacaccacataactcagccacaaaatgatggtagaggtgctaccttagccatgaaacgagctttggatcaggtgcaatgtcatacacctttgtgattttttgtgtggcacattttagaaatttgacattgttgttaaggaactgtaaaatgcatcatggctatttatggtacattctgataatgttcttcctcttattctagtcaggccttcaggcagatcaaatcgattatctgaatgcacatgcgacctcaactcctcttggtaagtggcacagtcagactgacaaagcctcatctggactgacagcacttctgttttttcatatatatatttttcattataagccatgttcttggttctacgtcatctgtagctataatgataaaaggtgatggtttgatttgaaccacaattaggtgatgctgtagaggctaatgcaatcaaatctgtctttggtgaccatgcaacatcaggtggtcttgcattgtcctcaacaaaggtatagcccccacactcatgtgcaactaattcatcacaattccttcgtctcccattcacgacaaatggcacaacattcttcagggagcaattggtcatctgcttggggcagctgggtcagtggaagcaatcttcaccgtattagccatccaccatgtatgttgtctacagttactgaccaccaacagtttgagttcaggagttctctgcataacattttatcttcgattttcagggcatcgctccaccgacacttaatctagaaaaaccagacacgctgtttgaaggcgcgttcatgcctctatcttccccaaagaagatgcctatccgagctgccatctcgaattcctttgggtttggtggaaccaacacgtcgctgctgttctcgtgccctccttagttgtttctaacagcaccctgtctgttttgcctgaagagctgtagctgaacatccacagagattttttttttccctgcacaaacaccgggaggcaccatccgcgtgcactgagcagaagctgagatttcagtcattttttcaccctgtgtgcggcatgccccattgttcttgtgtttgctaattttgtgactcggaggagtatctttttttttttgttttcaattttatcttaagttaaatcataaattcatatattgtctcgctggattgtgaattacctcgtacatagagatgatgtatttgtaattttgttttacatgtgaggctgaaaatgcctgagactgattttgcaacaggcagactggatgacagaagtgtttaagggctagattgatgcaaaataaactttttcaaaatttggcaatgacaaaatttttgtaagttaacattatcaaatttcagtagaatagattaaatgtgttattgtcaaaattctgtaggcattaccaacgtttggtaacaaactaaatacatccatatatttgtcattttttttgaaaaaatgatatggttcaaaacgacgtccatcttacttcctccgtttcacaatgtaagtcattctagcatttcccacattatgacttatgttgtgcaacggaggaagtaacaggctataagttgaagttggctatagagcgtgccttgccaaccatacaagactagatcagagtttgttgctggggctcgtttggttaagggcccttttgaaacgcaggataggaaaaacacagaaataggaaaaacgtaggaattgaagtggcgtgttttcctaatcctacaggaatggaaaacacaggaaatatgaagagggtccctttgatagcaccataggaaacaaacaaagcaaaggatagttttcaagaggttgaacctcttgcttattttcctatgaaattgagctatatgaatacaatcctaaggaaaatttcctatactttcctatgaatcaaagggtttcataggaaaaaattcttagaaaattaaatcctccaaaatttctatgcaaatcctccaattgaagggagccctaaaaggaaattttggtttggtttgttgtgtggatgatgatatcttctagaagaatctggacacgtaggctggctggctggatggatggatggatcggatcgccggtgcgtgtggtgccgggcggttggcaacctggcacgtcactcattcgtgctgagccctcacatgtagccgcgatttctctctccaagcatgggagaagaaattgtttttcttttccttctaaaacagttcatgatgacccctttttaaacgaaaaggttttacaaattctcatagaaatcagttaaattcttaaaattcttcaaaaccgtttgaattaagcaggtagtgggaaaaaaatctgtgtagcgatcaaaagtgattcatagaaaaaaaaacttgtcattgatggttttaaaaagccctctttgtttcgttatatttgaagatgttggctagttcaaaccaacgtcaaatattataagggagtgttgtaaattttaaattttggttgttgccaataagttaacaaaaagataaatgtgttcctagctagcgcacaagagcataacaagaattctactctttgtgtccttttctcagtagcaacgaccgtgtattcgtgtgcgtcaacaagaattatctgaattgaactctacttccattcttctgtacttcaaccttttctgaaaaaaaaaactcaagtgatttttattacactatgcatgtatgatgagcttttttttaccaaagagataactaacctagaagtatgagcacagcagttgtaccgtaaattactttacttgaaccggaatatgcgcctactttctctcgatcgtcgatcgtcagcttttgcttttcctagacggagagacctattttcgttcggtgcgaaaaatcctactattatttgattggttggccgaattattaataggaaaatcctttgtttacaacggctctacatgacactgtgtaaatttatcgaagttaaattaaaattcaaaagtttagagacggttaaattaagcttcataatccttggatagttttgagttttgacaccacaaaaatccacacaaacgttttagataaaccagaaaaaaaaatcctacaagaccatgtctctatttagaccctcgtcatgccttcatcgaaacataaccatgtaggctaactctatttgtggcaccaaatataattaattcttttacggtacaaattatatgtatttacactatagttacatgtaaattttaatacttatattatacttatattatagttagtcttgtaaaaaccaatcaattatgtgctcgaaagagaagataggagagtttcaaaacatacataaaagtgatcacacgggggaaaccaagctgaaatcaaattaaagaatatggtgctatatttttaccgtgactatatccaaaagcatttaaatctattactactccctccatccaaaagttttatacatattctatttgtttagtttttctaaataaaatagacatatttatagactttaagtacataagactgaaatgaagagattgtcttttctttttacaatactagattaaattgttgatcggaacccaagcaacatttttaatgcccattggttacatacatagtatagctcttgatctttgttagagcaaggataatagtgggctatataaaccaactataagctaatgtgaaagaggtaaagaaaaatgatgggtgttggctctaatgcaaaagctagttctacacatgctccaaaatatcacattaaaattatagcgagagaaaaaaataaagtgaaacttatagttaatctattatgcatgatagctctaatatgaactaataaccaatagttagctttacttacaatcccattgtttcgcttattcatatgcttattcgaatcacttatttgcaaatataaatcatttatgagtaaaagttttatttgtgtgttcttaacaattcaaaaccaaatgttgtaaaataaactacgatgagaaaacaaaaagatcaaattcaaaatcaagttctaaaattaaaattttggcttataaccataagtataagcataacctaaacaataagtcccttattaaacttgctcttatatgcatgataactttttttcttagtcttaatgaatggcaatagaaatacttaagttctaaacttttggatggagagagtaagagcttcatcggttgatctaataagctaaagaaaaaaaccaaagtttgaattttcgaacttaattttaaagttgatcttaaaatattttcaacgtaattcctttttagctacaaacaaatatatcaaagtttcacctatgaattaatttgtatttctcaataaaccgtttaaaattattagagaaaatgtggataatcgatgaggctttaggctgcgttcggaacggagcagcgattagcacgtgattaattaagtatttgctaatttttttcaaaaatagattaatatgattttttaagcaactttcgtatagaaattttttgtaaaaaaatataccgtttagtagtttaaaaagggtgcgagtgtgggggcgcagccttaatactttatagagtccatagaaagagacctgatcgtacatggctccttttttttttttggataaatcacgcagctaatttttctttttcttttttaccagtagtaggagtgtaggacacttcatatcgttgtgctagtatccggcgccgcttccgttcatctgcgcctatttattgcggcctcttcttcctcctctcctcgcctcgcctcgctcttccactgttcatctgcgccacgacacgacacgacacgacacgagacgagagaggagtcggcaatggcggaggggtcgcggtcgccgctgaggtcgttcgtggaggtggcgccggggtcgcacttccccatccagaacctccccttcggggtcttccgccgcaggggctcgccggagccggagccgccgcgcccggccgtcgccatcggggacttcgcgctcgacctcgccgccgtctccgacgcgggcctcttccacgggcccctcctctccgcctccccctgcttccgccaggtccgcaccctgcctaccttacctaccttaccttacctactcgtcttgtgttgcggttgatctgctggtggtgagctaagcttagcagcaatttgcgcggcgcggagattggagatttgggtggttgattccactgtgatttttggtggttacaagtagtagtaatttttagatttgtttcgtgtgcatgcaggaaacgctcaacatgttcctggggatggggcgtccggcctggaaggaggcgcgcgccacgctgcagaagatcctctcaggtttcacactttagctgctcacttcaaattcccaatatcttgtagtagtctactatgctgttagtaatgcacgatgagtagcgcggcttctgccccccaaattctgatgctgatgagtaattctacctgtagttgtgttgttagtactatgttgtgccaatgtatcatgatgcaagaaagtatcgattaaccgcctatgttcaaaactgaaagtatcgattaaccgcctatgttcaaaactatccaagaattatgagatcctgaggtagacttacacttttttttaatgggttctctaatctttgcagctgatgagccggttttgcgtgacaacgaggccttgaagaagaagtgccttgttcccatggtgagcttgatcaactactcttttctttgttacgagaaacaggatgaccatttatgaaatcactaacttctctgtttttatcatttagagcgacacagagatgcttctgccaatcacggtaggagactacaccgacttcttttgttctgtgcaccatgcaaggaattgtgggttcatcttccgtgggccacagaccccagtcaacccaaattggtaatgtattttcttgaccatgccttgtgctgagacttgagacttgggttttgacataaacactaatctgcaatgtatgtttgcttcatcaggtttcagcttccagtaggttatcatggtcgtgcatcctctgtgattgtatctggaacagacatcattcgacccaagtacgcatcccatagattcggatagttatcaaattcctgtcagattacgagatagttttattactattgtttgaatgattgaatatattagtgttattggatagcgggtagctgtttctagttttacataacctctgaagtctgaagtgtctattttgcttaattattgctctcaatgccctctttcaaataattcactatattcgatgatgtttgctgcattcaactttttgttgcatgcagtgatgtattgtagatggatacatatgtgtagtatattacattttatttttgtcataatatccaattgatatgtcaataatgtcctctttctctgccttttagagggcaaggccatccaacaggagattctcgaccttattttggtccttctaagaagcttgattttgaacttgagatggttagtttcttacaaacctcttgactcacagtatttggtattcttgaactgttattgacatacctgttgcatgtttgttaaatttgagctgttggttgtcattgtggtataaaatctggccgtatgtaattagttatagatattttcatttcccctggatcaaatatatcataacgctttgttggcttgttgctttcaggcagccattgttggaccagggaatgaattgggaaaacctatcgatattaatgatgctgaagaacatatctttggcctaatgataatgaatgattggagtggtaggtattcttttcagttttcgttcagatcagttgcatactttggttaaactgagttttgtataatattgcagccagagatatccaagcttgggaaactatacctcttggacctttccttgggaaaagtttcagtaagacacctgatgccttttcagttatacttatgccatgttcactaatacaccactctctgttgaaaagtttcctgcacatttattgcttagtttttacaaatgctcatgatcatatttctactgtggcctcgacaattacttgagtggattcttccatgatttccgcaatggactatgcttttatctttcgtcaatgtaacatgtttccttcctactttgtgatttttaggtaccacagtatcaccctggatcgttactatggatgccctaaagcctttcacctgtgaagctcctaagcaggtgagcatgtcttagtattatagtatatagttaaccatattttccttgagaatcatcattttattgttctatggataaattaaattgctttgcgtggcaggaacctgaacctttgccttacttagctgaaaagaaccacgtaaactacgatattcctcttgaggtaggattttctcatggcatttcttcttttatatttttatattaatagatatttgattaaaacataaactgatgattattactgcatttcattttctgtaaggtctggattaagcccaaggagcaaagtgaaccatcaatggttgcaaagagtaacttcaagcatctgtaaggatgcttcctgttttccgattgccgtttcattaccatatgtatttgttagctttgtccttactgtaactattttttcccaggtattggactttaacacagcaactagcacaccacactgttaatggatgcaatctgagaccaggggatatgtttgcaactggcacactaagcggacctgtatggaataaccatttcaaatatcaccataaacataccaatctagaagttatcgtgcatgtttacaactaaacatctgccttctttcaggagacagaatctttgggatgtttgctggagctaacatggaatgggcagaaggagatatcagttggaaactcgacccgcaagttcctagaagatggggatgaggtcatcttgacagcttgttgcaaggtacagcaatctcataagtcttgatcaaaccaaatttagagctcttttcgtctaaaacaaatatctttgaagattccatgctctatcttgatgccatccatctacatgtttttacagggtgaaggctacaatgtcggattcggaacctgcactgggaaggttctgcctgcacttccatgatccaacatatagaggatagcctgctttcatctcatcagtgtgtcaataatctctgaagaaagcatgcaatgaggcaatgtatctagctagttacatctatattttagtgcttagtgatggtaaaaatactaataaggtatgcttccctgagctttacagaagggatgtaattaatgttctccagttacaataagaacttatttgaagtcgtcattgtctcagtgattttggcatgcaatgctggatgtgaaaatcgatgtaatgttggtcgcatgatcgaacggttcagaacgttgaggccaaaattttggtttggattttggaggtgagctggtgaaaccactcgtgcatgctgcatgtattgcagggctatgctagtacgtggtagcaagctatctggtaaaagcaaaagtaaaaacacaacaaaatgttttactgggtgcaaatcagggttcgacttaccgtcggtaaccgcgcggttactaggtttaccgcgggtgtatggtaatataaataccgcggtaaccttcttaaattcaaataaatttaaaaaataatttgaatttttgataaattttgcatggtttttcacggttaactgtggttaccgcgcggtaaccccggccccggcggtttgggaaaccctggtgcaaatcaccttttgtacgcacgaatctcatagcaattcctcttgtttgccgattgaagaaagccttgtatggtctcaaacaagcaccgagaacgttgatttgcaaaattcaagatggccatgatgaattaagctagatttagacagagctcatgtgatcattctttgtttgttccttatacggcttatggtatggttatttttatattttgtacgaatcagatcagtttccatccgaatcagaatcagaaaaagaaaaacatatattccaaacaaataagaatcaaacaaaaaaataattgaactgaagagattaaactacgacaactaaacggataacaattaattaattaatcaattaacgagtaaactaaatgaaatgaaatcaggacaagaatcatatattccaaacgaagaagaagcaaacataaaaataaatagaagaaaataattaaaaaaatccgaagagggagagagaggaaaataattagatgaagaatacaagtgaggggaatgtagcggagggaacgatgattaacttacaactatataatcagacgacaattactccccctatctccatttcatattataagttgtttgactttttctagtcaatttttatttagtttaaacaaatttataaaaaaaatatagcaacatataaaatattaaattagtctaattaaatccaatatgaaatatattctgataatatgttcttttcatattgaaaatactactatattttttaaaaaactttggtcaaactttgaaaaaattggctttaaaaaaaaacaaatgactttgtaatatgaaacggaagagtagtataataagatgaaaatcagacgcaggcgagctccttggcgacgttgctggacttgccggcgacgttcttgcagacggagagggtggtgttcccttggccggcgtacttgaggtcgacgttgtgcagctggatgccctggcacggcaggttgttggcgcagttgagcgtgacggcctcgggcgtcgccgacgtgccgacgatgttcttgaagacgatgtcggtgacggcgaccttggacgtgccggacgcggagcagatgttgttggggcagtacttctggtcgatgatgatcgggtagctcacgttgtccatggtgatgccgtcgtacaggaacttggtcgccctcagctgcgacttggagtcctcgtacgacttgatccggaggccgttcgtggtgccctttatcgtgcagttggtgacgatgatgtcctccacgtccttctcgtccttgtacctgcagagatggccaaccacacacaacagaagttaatattatcgggttctatacatacaaattatctactaagtagttattaactatctctggttttttaatagatgatgtcattgacttttagacacatattgatcatttgttttattaaaaaaattatgcaattgcataagatgcttaaagtactattttagtgataaaacaacttagaacaaaataaatatgaattacgtattttttaataagacgaatagttaaatagatattcaaaatactacgaatgatgctacagtaacccacatgtgctaatgacagattaattaggctcagaagattcgtctcgcggtttccaggcgagttatgaaattagttttttcattcgtatccggtcaaacgtctgatgtgacattaaaaaattttcttttcacgatctaaacaggtgctagctagcttagctatagggaaggaaaggggcagttgtatgtatgtatgtatgtaccggccgaggctgccgacggagatgccgtgaccggggccacagcggacgccgttgacgcggaccatcttggtgccggggccgatggagatgcagtcgtcgccggcggcgatggtggtggagctgatggtgatgttggtggagtcgccgacgtggatgccgtccgtgtttgggctgtcccccggcgacgtgatggtcaccttgtcgatcaccacgttcttgctctcgtatatgttgaggtggaagaacttgctgttcttcagcgttatccccctcactgtcacgttcgtcgagtagtcgatcaccaagctctgcatccatccattgttttaattaattgcccattattagtcatacagagaagcaagaagataacaatacaaattactatcacagcattggttattttgcccatgtcaattaattataaatggactgtgatactcaatagtgtttgctggttaaaagaccagcttaggctatattcagatgtggaggttggaaactccaccttcccaaaggcaaaatggagtgatctattagcatttgattaattaaacgttagctaaaataaactttaaaaatatattaatataatttttttaaaaaaacaactattttatattttttataaaaaaacacaacgtttaacagtttgtaaagcgtgcgcatgaaaaacgagagagtataagatttattcgaaactaattaattcgatgttataggtgttacttttttgtatatacaaatttagctgaatttaaataagtttgaatagaaaaatagaactactttatgatatgaaacggaggaggaggtagctatagagagagacgatgggggtgtgggttgcttacattggggaggatcttgcagttgtagttcttgttgcactggttgtgggtccagacgagggggccctggccgtcgatgatgccgtggccgttgatggcgaagttgtcgacgtgctccacctcgatccagttggtcttgtaggcgttgaggtcgccggtgccgaggaggttgccgtcgaggcggaggatgatgctgctggtgcacggccccttgaggttgagcgcgccggtgaggtagttccccggcgggatcacgatcttctgcgtccccgtcgcgttgcacgcgttcttccacgcctgcagcacgaacgccgtgctgtcgctcgtcccgtcgcccttcgcccccagctgcgcgatgt

SEQ ID NO: 30618 - DNA, 12265 bp, Oryza sativa
atgtcgaggaggggcgcgccgccggattatatataccgcgggaaggggagcttaactatgtttagacacggcgagcggacgacgacgcgggtgtcgcgcgcgcgggttttttctgctatttttggcgcgaaccaacgggacgcgcggctgctgctgctgcttcttcctcctcgtcgttgcctaccgatcattttccttccgttcccgtcctgacatctcgacgaattttcacatgattttagagcagaaagtttttgattggaaaagactatacctactacgtttttcttactgaactcttattagcattgatgtgtcatgctattaatatatcctagattttttataatcccatatagttaaatcaatcggttgagataattgagggttgagatcattgagggtaagagtttagtaagaaaattttaattggtgtagcagtgctcttttgaatttattgtttgaaatagcgcgtatcgacgaacatattcctacaaatttgagatgaaatgttataggattttcagaggattcagttcggtttccgcaagataagcatgcagtgttccaaaggataactaaagagtagattacttttgcaatgagtttacagttcaactagttactaactagtccaatgctacaacgtcgcaatggtcacttgccagaaaatacaacaactgttctccactgtttaaacacaatttcacatctatatatcactggatagcaattaagctccccaaattattattgaatcaatcagaagtacccaaaaaaaaacagagaatcccaaaacatgactactgtacagaaatcagtcaggagggccactgcaaacaaggcgtttgcttcatgctcagtttcagtcagcacagcaagaccgacgcttcttcagtcttcacaccaaatccgggtcattcttgggtccagcagccacctcctcgacgtgcaatggcttcttgtagagctggagcagcagcgacgagcagacgacgctcaccgacgaggccgccatgcaagctccggcgagccatggcggcagccggatgccggtgaacgggaacaggacgcccgcggcgaccggcatgcccaggacgttgtagcccagagcccagacgtagttgagccggattcttgagagggtcttcctggagagatcgatggcagtgatcacatcctcgaggctgctcctcatcaggacaatgtcggcagcttcgatggcgacgtcggttccagccccaatcgccaggcctacgtctgcagcggctagagccggcgagtcgtttatcccgtcgccgaccatggccaccgtcaaccctttcatctgtgaacaaatgatgtgatgtaagttggaataatggtggtaaaatctgtgatctattccaactttgtttttgctgcaaggagaaaagattgcacctgcaagtccttgatcttttcggctttaccaactggatcgatctcggcaaatactgtgccgatcccgacctctttagctatggatttagctgtagcccaattgtcgcccgtcaccatgatactcgagatacccattgagctgaggtatgaaatggcacggcctgcctcaggtttcagaggatctgacacagaaagagctccgcagatggttctgtcgatagcaacaagcacacaggtcctagcaagctcttctgtttcagacatgtgtccctctacttcagaacttattggaacttcaaattcttgcataagccttttgtttccaaccagcaccagcttgccttcaacattggcactcacccctgcccctggatgcacctcaaagtccttggactccattatatggtcactgtgagatccatattgttccctgagcttctttgtgtactctacaatagcctttgatagaggatgctcactgttcgcctgacaaagttagaaaaaagttaaggttagatgacatgagacagcaaactaggaacatcacacgacattcaacaaaaattattagcatttgcatctaagaagccaacctctgcaccagcagccaaatcacacagctctagtagcggtatcttggagaacacctttgtttgaacaacagaaggtttaccgacagtcagcgttccagttttatcaaatatgatagctttaacctgcacataaagaaatacaaggaatagtttagtgtcacaatataaaaaaaatagaatacatttgatgtgagaaaaaataatacatgacatagaaatcatctcagttaccttgtgagctttctcaagtgcattgccacccttaataagaacaccttgagaagcaccttttccagtggcaaccataacagcagtcggggtagccagtccaagagcacacgggcatgcaacaacaagaacagatattccaaactgcagagcaagctcaaagctatccattgcctttggaatccattctcgagggtatatgtcgaattgcccagctacgaaccagccaagccatgtaagaaatgcagccaccacaaccttaaaatgagagggaccaatatgagatgaagaaagagacgatctcacagaaagtatgcatgagaagcatcaaaagtagttaggaaacatttgcaagtatcaatcagggtaacatttctcataagtaaccagctgtttacagaggaggtgaacttggtaaggagtagagttaaaactgctactccactaaattgaatataatttgctctacgattctacagtagaagctggggtaggttcaagaaagtttccagatgaatgctgactaagtctagggtagaaataccaagaaattattagtgcgataactagtgaccagtacaggtaaagtttccagtgcagttgactatgtgtctactgtctaggataaatacctcgattacctccgtagccagttgttattaaccagtagctaggcaggtagaatatagcaatgttgcaattttgtaaacgctggtgggaaatagcacgaagggaatttgcaggagaaaacaagcgaacctaccgttgggacaaaaaaccgtgaaatcctatctgccaacttctgaactggagcccttgcaagttgagcagcttcaactaactgaactatctgtgacaaagctgtttctgacccaacatgagtgaccttaacaattatacaaccattgtcatttacagtaccaccaataacctgttaaaaacaagtcaattgaaccatcaggatactagttcataacaagagcaaatacaatcaggatccaaaaaataccaaccttgtctcctggtttctttgcaatgggccttgcttcaccagttatcatactttcattcacatgactttggcctttgatgacaacaccatcaacagggactttttccccagggacaatcttaatgacatcatttctctgaagtaactgagtgctgatctccgtttctgaaatggcatttccatctttgtccaaagtaagaagacaagctgtttctggtgcaagttcagtcaacttcgacaaagcatctgatgtctttcctttggccaccacctccagatatttccccagcaatataaaagatatcaacatagcactagtttcgaagaaatcctgtccttcaaatgactctgatgttagtgccttcagaactatatacacagaatagaagtatgcagcatttgtccccaaagcaacaagcacgtccatgttcgagtatcctcgttttagcgcatgataagctccaacataaaatctgtcagtaaaataacacatagtgaataaccacacatgatttatagtgcatgtgtgcaatgaaggaaacaaacgaaggcaacattatatttaggctaaatacaataaacaaaagacttgagataaggaacatgaaacaacatcaagaagaagctgttcgagagatgggattgtacctccaaccaataatgaactgaactggagaacacagcaaccaccgtaatagcatacctatcgtcatgttattgcatactttgtaaaacagccaatccccaaaaggagaaatcattggcagaaccatggagaacatgaatacaggcacagaaaacaggcaactccaaagaaattgattcctgtaattcctaatttcatgatggcgctctgcctctctttgctttggtggtgaatacaagctagcattgaagtatttagggggctgtgcagcatcctgaatgcactgaataagtaatcgtgggccagtgacatcaggatcatatgcaactattattgtctgtcccgctgtgtcacattccacgttattcacaccttcgacagattccagtcttgactgaatgagtttgatgtcttctggggaactcacaccctctagttttaggtggactttgttcacatcatccccggaactaatgagatcagctccaaatccagcatcttcaatagcctcaattataagatcacgacttgtgatatttggatcaaaatggactttagcttcctctagggcaagtcccactgcagctttcttcactccaggtaccatctgaagtgctcgctccacagattccgagcagcttgtacatgccattccttttatctggagtctgcatacagcaatttcctgttcttgaagttcatcgacctcgaaattgaggccttcgatagcttcttttatggttcttgcctggaagaataagaatccaaactgagaacagatggaaaataatgccaaaccgtaaaatatcctgtcattacttcatgagtgcaacttgaaatatacatgagtttagtgaactgaaagcatgtccatgcagacaaaagttaccagttggtgcactcattagtgactatacagcctaactggcaattgcatgatggcaactgtatacaaagaacatgagactacatgagcctgaacttgacatcacaggctatatggtcactaactgtcaagtaccagttaccaatttttagaaccttgataaatactgattcgaaccaaactgctagtaaaaatttctgagtaagaggtaaaaaagatcatatgattgcgaagtaattcaatattccaggcctggagaacatgaactcgatgaggtataaaggtcatcatatgattgcacagtcattgtcaagggtttggcccacgctgacaaaaaagattgttaagatagtcactggttcgtagtacttactcgtggaccttatatgaatgaccaatataaagctgaaatcaaaattttcatgtatcctaattacctaaatcatgacatctacaggataaaattcagctcctggaattcaaaaccaccatattgctggaattaaattcatgcagagttgcagacatatactcctagtcaaatagagaactggcccacaataacttgaataaggacaatatagatatgcattgaatcctaaatcctattttgccccatgatgagaaacacccaaaattgtccctcccatgctggggaaatctagtgcagttgagaacaagaccgtcagctcaaggcaatcttacatcggcttcctctggtctgtactggacaacagcttggccctgaagcggcgaaaccgagacgctctcgactcccttgaggccagccaccaccgtctctatcgacacggcgcacgaagcacacgagatcccccggacattgaacatgaccttcctcgtcttcctctccttccgcggcgacgccccggcgggagaagcaccggagccgcctccatctgcctgaagaagtggatctttgagatggttctctccattctgctccatccctgtcccaggaacaaccaaaaaccaacataaatttagatggtcatatgtccatgctatattttacagccaattggtaagatataataatagcttctcataatccagcacaaacttctgtactgcaagtacaacttgaactatgaattatgaactcggtacagataattatgaactcagtacagataattatgaactcagtacagatgtaaactccttaaaaatccccaaaagtatagtcctggtaagcactaacaggtgcagcctcccccccaaattgttagtaaaataacattaaatcaaactgtttggatctttttggtacattctaagttcagtgatagcgttgaagcaaattgtttaaccaccacttgcattaagcccgagaaaaaaaaatcccacaaatccaactccaccgcgccaacgacaaccaacgaactgtccatttgacaaaagaggaacaagaaaaaaaagaggcggcgcccgcagcaactccgcctactacgcgtttatctccacgaacccaaacaaggccccgggtatttgggggaaacagaaacaaaaaaaaaatcaaaatcaaaatccatccggaatccgggcgaagataaaaacacggaacgccaaaggcggcgagaccaaacgcgccgtccgtcaagagggagcgtcagagcggcggcttacctcggccgccggtgatcaccgcggcggcggcggcggcggagggtttagtagaggcggtggaggcgaggcgaggcgaggcgaggcggcgaggcggcgaggaggagggaggcgtgaagcaggccgcggccgcgggggaggtcacgttgggatttgatttatatttggtggggtttggaattcgggtggaatttgggtgggaaatggcgtggattcggcggcttttcgctttggccctcgctcgaattttatatcgttttcggtgggatttgtttttttagtttgagtttggtttggatttgggctctatcgccatttgtcggggtggcgccgatgcgcgctcgctttctccgctccatgtttatcgttttcgttgcttcgttgttttgccctcgttttttgaaatttctcatataagcccctaaacaatgcatattagtatgtcttagtttagtgttccaaaatataagtatttctgttatttaaaatttgtatcatagtataagcatttctagtgtacttatttcaacgcgtaaaaatccatacgttttttagccaatcagtccgtgagaagaatttgatcactgggatctgaaacgtgattttttttcttaatcttaatatttacgtaccaaacaaacttgaaataaattaatatgatattttagagtaactttcatattgaaagctttttacgaaacacaccgtttagcaatttgaaaagagtgtcacacatatccaaattttgatccacttttttcagtacagaaacgaacgggaccaagtcttacattttgaaatggataggagataaataaaaatatattgagtatttttaaatatattttgtaatcggctcagttaatgcgcattgctcccactgatttggcacgtcaacatacaccatggctcgacccacctgaccaaaatttcatgtagattgaaaacgaatgaaggtgcttaacaaaagctcatgcctttatctcctcttatgcagtgacctatataagtagcctagttggtgtggtgctctcaataatatgcattcgtatgccttatgtaaaaggaaaggttatggtggtacaaatttggataggatgtctctagatgcttatagatgatgggcaatctcaagaagattcccccatatccctgcccacaaatttggctggccttttctggctcatatttcgtatgtattacctccgtcctaaattagttatcactctaactttttttttatcattcgtcttatttaaaaaaatattataaatataaaaaaagataagttatacttaaagtgcttttgataataaagccaaaaaataaataataatttcgtaattttttgaataagacgaataatcaaaagttacaaacaaaaacttaaagggctggttttgtttgaggcctaaattagacttaccaatatttggcaatttcaatagtgtttagtgtctatttggtttgaagccaaattttggcatgcctaataaaataggccatttcaatagtgaacttaggctatttttacttcaatccaaacataattttaccttaccaaaattagtcatgccaaaacttaccagaatttggcattgacaaaatttggtaaggcctatttaggccacaaaccaaaccaacccaaagcgacgagtattttgggacgaaggtagtattcaaaacacatatattccgaataaaaatagatggacagcattggacatttggtgttgactttagcactgtgagaaaatgacaactcagaccagggtttcaaaatgcgaacgatagtcgaaaggcatatccctatcaaatttatcagtaaccgtgataattaaacggttgccgacgaacggcggtgaatctatatttattttgagcttggtttaaacttgatttaggcacgttcgtttgagccgttcagctcgcacgcgaaatgagacggggtgattagcaagggtaacaattataatttttaaaatatatactccctccgtcccaaatataagtatttttagttatgaatctggctaaatgtgtgaccagattcatagccaaaagttgttatattttaggatagagataatacattatactatatttatttcacaaaacggtacgttaagttcggttgacttcgtcaatcccaaaggatttatcagcccagtattcgaagatgtttatagaggtagggattacatgcgtgcgttcataggggtgagtgtgcgtgtattgtgagtgtatgtgttgtactatataatttttttttaaaaaaacaccgtttcgagttgctgaaaagaactcggtcttagtcttattgcctgttgggtactgaattactaggatttagcaattttctcgttttccatgagcactcttcctgaagttctagccagtgtattcttttcaagaactttttatataaatgttttctttctaaaagaataaacttattttttgaatttgtaatatttcacctattctaaaatatatatagcaacctagtatcgttatatcggattgaacccacgccacttattttgtgtccaatccgagacctatatttttagatgaagggagcagctaataatcccttcgtttcattttataagtcgctttgacatttataagtcaaaacttcttaaaagtttgactaagtttataaaaaaatagaagcactttatagtactaaattagttttattacatctaatatagaaacaattttctttgttctgttaaaattaatattatatttttcttaaatttagttaaacctaaaaacttttgacttagaaaaaaatgaaacagtttattgtatgaaacggaggttgtactactcaattaatcattcgttaatgatttatttgtttcacgtgtagctaaaaggctacccctccgttgtagaataagtcttgggatgaaaatgttattattttttcctacaaacttagtcaaacttgaagcagagtcaaaacgttttataacccgaaacaaaggcagtagcaattgtgaaagcagggaacaaatgcacttggactctaagagtagataaagttgagaatagttgtattgggttttaataaagtagggtattatggttgttttcctttgagtaagttgggaatccttttcctcgaccttaaaatggagcggtagattagtacgtgaataattaagtattagcttaaaaacttaacaatggattaatataatttataaaattattttttcaatatttttttaagaaaacatgctatcatctagtgttttgtaaaatatgtgcatgaaaaataagagagtagaagttactaagggaaaaaagaaaacactatttcagaatggaggtgcaacaaaaacggggcacagtaagtgatggagctagaaagatttttgagtgcggacaaaactacattataactaattaaatttctataacaatatataagtaatttgttatagaaatttcatcataaatttatttataacaatatagaagtttaatgaaattttcgtcggtgagccgcccggggtagccgagcagtggctccttcctgggtgcggtgcaggaggagtaggaccgcgcgcgtgcgcgggtgtggccgtgtgggggaactgacgatgatcgtgcagttgcagtagcgcgagcgcgagcgcgacgttttcctccggtgttttggtccccgctccgctccgctcgccgcgggcgcccgcccatgccatgagtcccgcggctccagcgaaaagggggagtacccccccgctgtggtttttctgtcgctttgcatgcactgcacgggcagtcgggcacggcgatgtgcgcgccaccaaaaaccccaaaaggcggcgcgcctcccgatgcccaccgcaaagcaaagcagagcagagcatattcggacggatcgatggatccccctgctgcttgctcgctcgctcgctcaccctgctgaccatatgcgtgaatgtgatgaaaaaaagggttcatcccaggaactcgcgctgcaacatgtgaatcttgaggattagagtaataacattagtatagctaactattagccctaaataatctctagtcaacttaataatcaatttatacaatagttacatgttacactattaatacatggtcccacctgtcatacacacactgtatcttagagtccgtgctacagctgttctctctcgtctatcatcttcttaaaatatgtttatagctgatttataacctgctattgtacctgatcttactatttcatctgttctaaaatgtaaacatttttaaaatagacacgtatatgaaaaaagtagatacaaatgattagagaagggttgtgattgataaagaagagaaagtaggtgaagagaacggttgtgattggttgagagaaaatggtaggtaaaaaaatagcttcattttggaacaagtcactgtgctaaaatagctatattttaggacggaggtaatatttggttacgaagaattttagtcaacgtaaatagacaaaaaaatagaaatcagggttaaaaaaggtttgaaaagtttttttcgagaacgcgtaaaaatattgcacatcagtagaagaaatagacttctaggtgaaaaaaacggtttggaaagtctccgcctgtcagaacttttctagaaatggaaatcatcggtcggaattttcttgaaaattatgacctttacagcatttgtgtactttgttaggttatgttatcttcacatgtatggtcgtgtttaaagtatacgaacacatatttgaagtattaaatatagactaataacaaaataaattgcagattccgcctataaactacgagatgaatttattaagcctaactaatccgtcattagtaaatgtttactgtagcattacatcgtcaaatcattacgtaattaggctaaaaagattcgtctcgcaatttacatgcaaactgtacaattgtttttttttccatatttaatattttatgcatgtgtctaaatatttgatgtgacgtaacttttggaagtttaaagggaactaaacgctgtctatgttaatatgtacgtgcagaaactcgaccaaacatttgaacttgtgatcgtgaacacatgtatgtacagcaaaggccaccaaacaatctccatcaacataggcacgagggtttgatttatgtcttctcaaggaaaggccatcaagaactgtcaggctttcatgctgaagtgtcctccacagtttgcaataaacagtatcaaagggatcattttcagcaaacaacttccaagcactagggtcataattcctagtcatactccactgaactatttgctttctttttcccttcacctttatccatggctttataggataggggcaaaaccaacaaagctgaagcaaaagccccaatgtcatatccccatcatatgcaaagctgttggcttaactgatcctgaggccatccacaatgggtgccctcgactagggatagcaacggggacccataacccgcgacccgataggtttttactctattaggagtcaaatgtattccaaatattgcacccatgggtctcttatcgggctaaaacgtcacccatcgggtgggccgggtcctggaacgttctccatccacccgaacccattaacccgtgggttaaaaatacccatatgcctcagcccagaaaatacaagcagcccaaggcccaacaacaaatctaagcatctaagtctaagtgtctaaccctagatataaaaacccatttcctctccctcttactgattcacttctcctccctccccggtactgtgttgctgtaggtggccgccgccacaaaccctagggcta

SEQ ID NO: 30619 - DNA, 970 bp, Oryza sativa
tcaattctatataaccaattttgccttgaagatatgtgtgcaaaagaagatcaagctgaagggaaagactttgacacaatctgctctaaggttttcctcagcagattctaaaaatattacagtggagaactatacatttgatcaagatgtagctagaagagaattgtgtgatatgatagtgctgcatgagtaccccttaagtatggttgatcatgttggctttaggagatttgtagctgcatttcagccactattcaaatttgggactaggaacacaataaggtatgacagcatggctggaatttgttgatttcggagcataaatttctgtgattttttttatttctgttaataattcatttctgtggtttttttatttgatttcagagcagaaattatggaccaatatgagtttgagaggaagaaagccattcaatacatggctggaattcaatctagggtggctatcactactgacttgtggacttcgagcaatcagaagagaggttatatggctatcacagcccactttgttgatgaatcttggaaacttagaagtattattatgaggtattttcttgtgactgacagccactaacatgtacttcattttttatggttagaattaaatctgaatacatacatggtttatatgtatgtaggttcatctatgttcctgcgctagaccgctatatgaccaatatgagtttgagaggaagaaggccagtagggactgagctagaccactatttggatgatgatttggttgacatccacacaaaaagttttgatgttttagattggtggaaggtggctggaattcggttccctgttttgaggaggatagcacgagatatatatgcaattcctgttagcacagttgcttcagaatcagcttttagcactagtgggagagtcctagtgagcatcgcagtcgactcacttcgaagttgttggaagctctaatctg

SEQ ID NO: 30620 - DNA, 738 bp, Oryza sativa
  unsure (1)..(738): unsure at all n locations
gtttacctccctcatcaagttcaagatgcccgttggttgccataggtgtcttgatgggtttcgcatcctccaagccaaacctcttaagtagatccttgatgtacttggtttggctcacgaacgtcccatccttgagttgcttgatttgaagtccaaggaagaagctcacctctccaatcatggacatctcaaattccctcgacatcatatcaccaaattcttgcaaaatacctcattagtagaaccgaatatgatgtcatcaacataaatttggcacacaaagaaatcatcatcaatgatttttgtaaaaagggtggtgtcaacttttccaattttgaaatcctttgacaaaagaaaatatctcaatctttcataccaagccctaggagcttgttttaaaccataaagagcttttgagagtttgtaaacatggttaggatatttagaatcttcaaaaccgggaggttgttcaacaaagacaagttcagcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttttgtgaaaccttgtgccaccaaccttgccttgtttctcaccaccaannnnnnnnnnnnnnnnnnnnnnnnnnnnnnnnnnnnnnnnnnnnnnnnnnnnnnnnnnnn

SEQ ID NO: 30621 - DNA, 1298 bp, Oryza sativa
gaatgaaatatggactgaggcgacgtagacgctgtgccataataaaaataaatttcaaatttcagtgctgaagttactggaagattgtcgtttacattgcaagtcacctatggcactgcttatcaaaagcataaaagaatgatgacgagtagagagttcagcacgtagaaacacaatagcggtcaagataaatcatctagaaatatagaaatccaactgccatatctgccacaatagctaataataccaatagaaaaaaaaataaaagagtgtggatacaaacattttcaagtatcatctgcgatgcatctaaaatgtctgagatgcttccaatccctccaccgattgagactccctgatacaactccaatcagacaccgcaattcagaaacacataaaaaaaatatatagttcataccaacagcagtttgtaccgttctttccttcttctcatcttctgaaggcaaccaatttgcatctcttaaagcctcatcagctgcacatagagcataggctataaatccggatatagatttattgtcctggaaacaagaaggtcaatcaacagttcaaacatcaaagcatgatacagagtttaaccatatgagctattcagcaccgccattacatgtttacagccatgcaaacaacattctgtcagaatattttggctcctagtaggagaaggaaaaaaatggcagaagtaattctatctacacattttgttccaaactaggacgtgcatatttctataagtatgcaatgaaaatatgagtgggagcacaaattaacaaaaaaaaaaaaggaaaggaaaacattgagaaatcaagacacttgtcactcctggtggcactcaagataaggtcattgccattgtacagcctaccaggaacaacattagtttttgtattatgatgatctatcacattactagcagaaaaatcgtgttggataaagaattatagataacctcaaataggaaaagtggtgctagaggtagtatgggcaatcaatatctatgtacatattggccatgaaatgcggttaaacttatcatcgccacaaaatggggtgaaattatgatgtaaggacagagcaaaagttgcattcctatatatttgcaagacctaaacgttctccaattttagcatccaacaaggcctgaacaaatcactccactcctcagtgcttgaatcccaatgcagcacagaaagcaatctactgcaccaatccaatctcgcattaacaactagtagaagcacattaacaaagcattggaattattagggctaatgaag

SEQ ID NO: 30622 - DNA, 727 bp, Oryza sativa
  unsure (1)..(727): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagagagaaacacacttgttcttcatctacccttctcctctctctctctctcatctggttctagctagtactagctgctgcatcttctactgctgttcttagaagaagaagaagaagaagaagaagaagaagaagaagaagaaagaagctgctcctactaggctactagctaagctaggcttaggcatgtgcgtgcgtgcgtttgatgctactctgtggcagagcagacgatgatccgccatgtccggatgccgcccacgctgacgcccacgacatgctcggctcatcaccagctcgcgatcgaggcggcggcgacgacgccgaggcctccgagcagccgcagccgcagccgcagccgccattgtcgccgcgcgcggggggcggcgaggcgagggggctcgtgctcgcgtgcgccgacctcgtccaccggggggacctcgacggggcgcgccgcgtcgccgaggccgtgctcgccgccgccgacccacgcggcgaggctggcgaccgcctcgcccaccacttcggccgcgcgctcctcgctctccgcggaggaggcaagggtggtcatggcggcgtcgtcggtggcgtggtgccgtcgtcggcggcgt

SEQ ID NO: 30623 - DNA, 459 bp, Oryza sativa
gtgcatcagtaaaatcaactcatctatggtaaattctgcagatgaaaaaatggagaaatgggagaaagaaattcaacaaggaagaaccaaggagcgaccaaagaggccaggctggatgaaattcattgttgtaagatgtgccgtaagtaacccgggccacctattatgcttatcaattactatttgtaactccattattaaatcgtcagttacaatttacaaaggaggatgacaacaagactaaaataggttctctgtttattctgttcttgcctcgctgttccaccaatgatcaattcggatttcaaccgcaccccggccagaaaatcatactactctttagagtagtgttggttaaatgttaccttgaattgataagtaatcatatgctttcctagaacacctaacggtgattcgtttattgtggcatccacttatcatgtaaaaaaagacatccac

SEQ ID NO: 30624 - DNA, 668 bp, Oryza sativa
tgttcatccatctagtgtgtagagggttgataagccaagagtcaagtgcattgcttccatttggagagctagtgtggcacttgattgatcatctccacgccgggtcattgcttgttactcttggaggttgccgcctcctatacggcttgtggaggagttgcccggtgacctttccgagaagattgtagaggaggcccggcgccggtttgtgagtggtttggaattcaccaccttcggagtgaaggaagaactaccctagtgatcgaggcttgggtagtcctctccgtgggccagctcccgccttgcccaccccttgatgaagggggtgtgcggtggcttcgtggttgagcggtggagttgagctcgcctcaacggggagtaggaaaccggcgagtttccgaacctcggtgaaaaatctcgtctccttgtctcatttgatcgtcgcatttacatttgtgcaaatttacttttctagaaacaaactagatatcatatcaccctaggattgctaaacattgacataggagtgtgatttactttcttagagatatagttgagccacaatcaccctaggtttgcaaaacataacttagttgcttagttagagttgaccctcaccaagcctagcgacttaggttagttttgattaggtgtcatttagttttaaa

SEQ ID NO: 30625 - DNA, 776 bp, Oryza sativa
  unsure (1)..(776): unsure at all n locations
tccatgtttgggatacaaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctctgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggaacgcgccgggatttggcgttggcggcgtctcgtcgaatnnnnnnnnnnnnnnnnnnnnnnnnnnnnnnnnnnnnnnnnnnnnnnnnnnnnn

SEQ ID NO: 30626 - DNA, 787 bp, Oryza sativa
  unsure (1)..(787): unsure at all n locations
agtcagcattcatctggaaactttcttgaacctaccccagcttctactgtagaatcgtagagcaaattatattcaatttagtggagtagcagttttaactctactccttaccaagttcacctcctctgtaaacagctggttacttatgagaaatgttaccctgattgatacttgcaaatgtttcctaactacttttgatgcttctcatgcatactttctgtgagatcgtctctttcttcatctcatattggtccctctcattttaaggttgtggtggctgcatttcttacatggcttggctggttcgtagctgggcaattcgacatataccctcgagaatggattccaaaggcaatggatagctttgagcttgctctgcagtttggaatatctgttcttgttgttgcatgcccgtgtgctcttggactggctaccccgactgctgttatggttgccactggaaaaggtgcttctcaaggtgttcttattaagggtggcaatgcacttgagaaagctcacaaggtaactgagatgatttctatgtcatgtattattttttctcacatcaaatgtattctattttttttatattgtgacactaaactattccttgtatttctttatgtgcaggttaaagctatcatatttgataaaactggaacgctgactgtcggtaaaccttctgttgttcaaacaaaggtgttctccaagataccgctactagagctgtgtnnnnnnnnnnnnnnnnnnnnnnnnnnnnnnnnnnnnnnnnnnnnnnnnnnnnnnn

SEQ ID NO: 30627 - DNA, 1235 bp, Oryza sativa
tgtacttgtatgccattgaattggctggactgttgctcaattgagactggatcactggaggatttatgtattgtacgatggatggatgtattttggagtggacagcatgcttgctattaaacttaatgggttatattatatcactgttccaattatcacttgatttgctgattgtgcaatgtggctgcatggtttgtttatgtgcttttcaatcctaatttgtaaaaatctctggctgctatgttgctgccctgctgtctgactggatgcattggtgtgctcaatttgatactctaatgggtatgggtacccaatgggtacccgtcacccatgcgggtgtgggtatgggggaatttttcacccgtgagcgggtgtgggtattggagcgggcgtatttcatttcaatgggtgtgggtatggggtgggtgaacccaatgggtacgcacccgttgccatccctaccctcgacccgtgccctcgcaaacggccgtttgcctcccatccccttttcagcgtgagtcgtctcccaggctaggaacgtggcgccaagcagaggaacgcgggtctttgcaaggagcgaccacttttcgcagagacacaaccctcgtccctgggaggagacccactgcaggctcctgtctcctcgccgctccccccaaatccccctcctacccttgcctctctcccacggcgccgcccgctcgtcgatccgctccaccagccgccatcgtgacggcgaggaggagctcggcggccttgaagaggagaagggcgagccagacatcggcgaggcgacccgcgaggcggcgctgggcgggggtgccgagggcggcggagtcatcggcgaggtgacctgtgaggcggcacggggcggcggagtctggggttggcgacggcgacggctggagggagagaggggagcgggaggagggcgaccgggcgctgacctcgccagcaagccaccgccgttgctgcccgaggctagatccggaaagcccatgccggatctggccaccccgccgccactccgatggcgatgaccctcgacggcgacggccccgcggcagagggaaggggatctggcaaccgacgtcgtcggccactccgcgcacccgtcgtcgtcggccaccctgtaggatcgagatgtcgactagagggggggtgaataggcgatttaaaactaattgacacctaatcaaacctaacctaaaaaaataggcttggtgagggtcaac

SEQ ID NO: 30628 - DNA, 10630 bp, Oryza sativa
  unsure (1)..(10630): unsure at all n locations
nnnnnnnnnnnnnnnnnnnnnnnnnnnnnnnnntgaatcaaccgaatgcataagatggtcacaagtatatcaatgtcacaccaaccatccatcatagcacaagttcacatcaagaccacataaagtgctcacaaataaatgtaggctattacaagaccatgaagggtccaaatgacatagagagtttaacaaaacgacaaagaacacacaatatagagtaatagcccatacccatacaaaatatagtccaaacctccttaacctattaaatatgaggtgactaacctcactactactagtcccaacccacaaaacataaaacacacttttctcccccttttggcatcaagcaccaaaaaggtcttcactcttgcggaggagaaggaggacgcgccgaagtggaaggatgagaagcatcacggcgacgatgatagccaaaagcttgggtactctccaaggtttggactcaagaatccaatacacccaccctagtatgcaatcttcccaccgaagtattcaagttgccaacatcggtgcgcaagccacgaacatcttcatgcaatgcttcatgcccggtggataagcgttgaatgctttcacttagggtattaatagccccaaggaccgggttgaagaattcattgggttgcattccaaagtaggcatattgtggatggaaaaaagcacttggatcagacccatgaggaggagggggggctgcacttgagcttgcaccttgatcaaatgttggttggcgcacacgaggagctttaggggaggagagttggagacgaggcttgtactccttatgttcttttaaattgtgaccaatttgtcccaacttgctttgaatcaacctcattatgtagggagcataatagattccttgtccaatagtcccctttgagatggcaatctccttcatcataaggttgataacatcaaaccgacgaccatccaaaatggcatcaatgacatgccaagcaactccgcgtatgtcatcattgttgccgcatcttgggaggatggtggcccttactatgtggttgatcacacttgggagagccctctaacccgccacctttccatatgtgtgccttcccccgtcttcataaatctgagaaaagtgatcaatggggaaggggttgtgggtgtgctcatcatgaaggtcatccccattgttgaagcgaatgtgcaagagctccttgaattcacggcggttgatagagcattgaagggtccccgacatccacttcattgcatcacaatcgccggacacccatacggtggcatagaattgccggatgagatcttcatcaaaagattgcttcatggtgacaattctatcaatcccaacggtccagaacatctcttgcaaatcttcaaactccggtgtctcaccaatgtgcctccaagaaatccacttgtgttcggcgaaggctttgttggcatacacttgttcatacacggacttttggaactgggtatgaaatcttggatcattacaatcgttaggcctccggaattgatcatgatgacggaggatagtgtattgttgagcattcctcaaattaaacacaaattggatggtggaatcgagaggactcccatcatcacttgcctcatcatcttcaccattgccactcccattgtcatcaccatcatcacttacttccatctcatcaccctcaacattttccatattgtcatcatcactttgaacatactcatctccgcttgattcctcattctcattgacgggattgggcatgggctcacgacgaccatggcgagtgcggggaggcatagctgaaaaacaaggagcaaaggatggataagcaacaattttagaagccacatagtgaagaggaaggaatgggggtgctgcctgtcaggggcggtcagaccgggggccagggactgtcagaccgccggcgtcaagtcagtcaaaccgacggcccctagccggtcagaccgcctgccctaggccggtcagaccgccgctttggtgccggtcagaccgcctgccgatcagaccgccactgacaggagcacaaccaaatccttccaacaatcacacaaatgagtctaaaatattgctagaacaatattgcacaagtttggaacttgaacatcaaagggtatggcctatttcatcaagattggaataatgggggaaactacccaaaaccctagagattgaaatagaccgatttgagataatgcgcaagagggagagtgatttaccggttgaaggagttgaatcacaccaagaaactacccactattggtgcaaatcgaagaacacctcgtgcttcacctagggttccatgccatggatcaaaaacttcaacaaaaacacaaaccaatccatggaatagagagaggaagcggaggagaatcacttacggtgtaaccggagagaaatccacggtcagaccgagggaatttggtagagggaggtgactagggtttgggaaaagagagaggaggtgttttttcgagttggggaagaagaaagctgaatgggaggagatggagtcaggtaggggaagaagagagaagaaaaagaaagattcctgggcccactatccctggccggtcagaccggctattatcggccggtcagacctcaagggtgcggccggtcagaccgggcccaagtggccggtcagaccgccgccatcaggccgatcagaccgtgcatatagcaccggtcagaccgcctggcccccagccgactgtgcatagcccttgcacagttcggctacccccacacaataaaattcaataaaaaaattgatttttggagcaattttgaaatgtgtgagttaaaatattgccaaccattcataacatttgaaaattatgaagatttgcaacaaaactcacttgagcgctaggaggtgaccttttatggtctataggggtttttgggcgaatttgattttcaaataacttttgaatgatttggtttttgaaataggtttgaacaccaaaaacatttcaaaacttctcctctaccaactttgttttgaaactttcctcaaattccttctcaatctcattttggggataaatctcattttatccaaaactaagaatctagtttcttcaaaagagggccaaaatggcattttcattcaaaaatcatttttcttgcaatgtgaggcttggaaaacatatagggaaccttttaaaacattttccaagagatagttttcaaaatgcatcgattttgcagaagttttgacttatgttgacttggtcattttgaaaacactactagcacttttagttgatttgctcacatataaaaggaagtggaacacatgcaagagtgcaagactcctccttaatgtgacatgctccattttcgcaatgaagaaccaaatgacaataaatccaaagcataagaacaaataggagcaaatatacaatatgcaaaagaagcaaccatggtgcaccatctcaagccatattagagaagtctatgacatttaactcattcctcaacttgcaaaagcgggtttcatcaagaggcttggtaaaaatgtcggctagttgatcctcggttcttatgtggctaatgactatgtcacacttggcaacatgatctcttaagaagtgatggcgtatgtcaatatgcttggttctagaatgttagactgggttattggctatctttatggcactatcattgtcacataggagtgaggttttggtgaaagatatgccatagtccaacaaggtttgtttcatccaaagcaattgggcacaacaactacctgccgaaacatattccgcctcggcggtggagagggctacggagttttgtttcttggatgaccatgacacaagggatctaccaagcatttggcaactaccggatgtgctctttctatccactttgcaaccggcataatccgaatcggaatagccagcaagcttaaatttagcaccttttgggtaccacaagccaatagtagaggaatactttaaatatcttagaatccttttcacggccactaagtgacactccttaggagcggcttgaaaccgtgcacacgtgcaaacactaaacatgatatccggcctagatgcggtaaggtaaagcaagctaccaatcatagaacgataaagctttaaatctaccggtttacctccctcatcaaggtcgagatgcccgttggttgccataggtgtcttgatgggcttcgcatcctccaagccaaacctcttgagtagatccttgatgtacttggtttggctcacgaacgtcccatccttgagttgcttgatttgaagtccaaggaagaagctcaactctccaatcatggacatctcaaattccctcgacatcatatcaccaaatttcttgcaaaatacctcattagtagaaccgaatatgatgtcatcaacataaatttggcacacaaagaaatcatcatcaatgatttttgtaaaaagggtggtgtcaacttttccaattttgaaatcctttgacaaaagaaaatatctcaatctttcataccaagccctaggagcttgttttaaaccataaagagcttttgagagtttgtaaacatggttaggatatttagaatcttcaaaaccgggaggttgttcaacaaagacaagttcagcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttttgtgaaaccttgtgccaccaaccttgccttgtttctcaccaccaacccgttctcatcttgtttgttcctaaatacccactttgtccctatgacattgtggtctctaggtctttcaaccaaagtccacaccttgtttcttgcaaagttgttgagctcttcatgcatagcattcatccaatccggatcacaaagagcttcatctacatgttttggctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggatcttgtaccttctcctcctccacttcaacttgagcttgacttggcatagcggaagtagatggctcatcttgagtggaggtggatggcttgtcttccacttcaataggcttgacatctccaattgacatattcttcatggttctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcggtaaatataacacttgcaaccaaaaacttgaaaataggcaacatttggcttccttccaacaattagctcatagaaagtctttttcaagagaatatgcaaataaagcctattggttgcatggcaagcggtgtttatggcttccgccccaaaagaatcggaaacaccatattcatcaagcatagtccttgccatctcaatcaatgtacgatttttcctctccactacaccattttgttgaggtgagtaggtagcggaaagttcgtgtttaatgccaagatcatcacaatagtcctcgatattggtattcttaaactcggaaccattgtcacttctaattttcacaagagtgcaactaaattcattttgggccctttttgcaaactttttgaaaagctcggcaacaatagacttatcatacaaaaagaacacccaagtatagcgagaataatcatcaacaatcacaagacaatgattattaccaccaatgctcttataggttgttgggccaaacaaatccatatgcacgagctccaatggtctagatgtggacatgatactcttagtagcaacttgcttgccgacttgacaagcactacaaagcttatctttctcaaacttcacatctttcaagcccacaactagatcacgttttgaaagtttgctcaattgattcatgccaacatgggctagccttctatgccaaaggcaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagccaagatcacaaatttgagcaaccgaaagcaaattaaaatttagagatttacaaagagagacattgtcaattgacaaatcattggagatagcaattttacctaacctaattacctttcctttgctattgtctccaaatgtcactttctcttgttcattccctcctacttcaaatgtggtgaacatagccctatcaccagtcatgtgttgagtgcatccactatcaagcacccaatggctcccaccggtgtggtagttcacctacaaaagaagatcaagctcttttaggtacccaaacttgtttgggtccttgaaggttagagaccaaagctttgggcacccaaatggcattctttttaccaccgagtataggggaacccacatatctagcaacaatgctaccatcatgagccttcctaatcatataatgagaatcaaacatgcatgtcttaggaggcttaccaccggggcaatcattcaccaaatgcccaacctcacgacacttggagcaatacttaccattgctcttgacaaaacgagtggcacggttagaaggtttcttacccttctttggaatgaatccaagtccctccttgttaaggatgcaccgttgctcactcaaaatcttgtcaagagtgttcttacccttgaagcacctctccaagctcttgttgagcttagccacttgctccttaagctcattgttctcaacaacaagtgaggcatcacagatagaaatacaagagctagagctagacatatccacaagatcatcacaagagatagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcactataagcatggagctcctcaaacatactcacaagctcatcataggaaacatcatcacaatcatcatcactctcattatcactaagagatgttaccttagaggagccctttgccatgagacaaagtggagcgaagagtgatagagcctccttgatggcaacaacggccatcttcttctttttggagcttgcatcatcaccaccttcttcctcggacccggatgaggcggagctctcctcatttgagtcccattccccgatgaaggcctcaatcttcttgccttccttcttgagcttcttcatgagcttgtagcctccactcttcttcttgcatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaagggcaatctcttcctccaagtcctcattggcttcattcaccttgcccttgcccttatcttcaacttcggcttggagagcaatgcacttcttggaaggtgaggcttcctccatctccttcttcttcaacttgtacatgtcattggtgttgatcttccccaagaggcttgcgggtgtcatcattgacatgtcggagttgatgagcatggtgacaagggtctcatacttctccggtagagccctaagcatcttttgggcaacctcaagatcggtgtagtttgtcccaagccccttgagatcattcacaatgacattgagccttccatacatgtcattcacactctcatgaggcaacatggagaatgtctcatattggatcttgaggaaatgaagcttggcatccttatactcactcgtgccctcatggatctccgccaacttgttccaaatctcatatgcggtctcaaggttgctcactctatcaaactcctcttggctcaaagagttgaacaaagcattcatggcttgggcattgagttggaggttgcggtgatcaatctccgtcaagggcttgccggtgatagcaaaacctacatcaacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctctgatacaacttgtaggatcgagatgtcgactagagtgtggtgaataggcgatttaaaactaaatgacacctaatcaaaactaacctaagtcgctaggcttggtgagggtcaactctaactaagcaactaagttatgttttgcaaacctagggtgattgtggctcaactatatctctaagaaagtaaatcacactcctatgtcaatgtttagcaatcctagggtgatatgatatctagtttgtttctagaaaagtaaatttgcacaaatgtaaatgcgacgatcaaatgagacaaggagacgagatttttcaccgaggttcggaaactcgccggtttcctactccccgttgaggcgagctcaactccaccgctcaaccacgaagccaccgcacacccccttcatcaaggggtgggcaaggcgggagctggcccacggagaggactacccaagcctcgatcactagggtagttcttccttcactccgaaggtggtgaattccaaaccactcacaaaccggcgccgggcttcctctacaatcttctcggaaaggtcacagggcaactcctccacaagccgtataggaggcggcaacctccaagagtaacaagcaatgacccggcgtggagatgatcaatcaagtgccacactagctctacaaatggaagcaatgcacttgactcttggctaatcaaccctctaacacactagatggatgaacacaaagctcaagtgggtgtgagagaggtgcaagggatgtatgcaattgaattgggtgccaagagagtccccttgctgctggtgggggagtatttatactcccacccaccaaaactagccgttgggggcgaaatctcccaactttgtgctttgctggtctgaccggaggtatgtggccggtcagaccgtgctactctgcaacggctagaaaactagccgttgaagtgctgtcagagggccccatcggcctggccggtcagaccagagttgagtgggcggtcagaccggcctcggctcggtcagaccgactacggctcggtctgaccgactacggctcgtcggctctgtttcggccatcccgagcagcatcatctcggcatccagggggccggtctgatcgggcaagtgccgccggtcagaccgggcttatgcgccggtcagaccgcccgcttggggtccagacggccggtcagaccgccaagtggcctatgtggccggtctgaccgccccctggtcaggccgaacccagtgaatttgcaagtgaatgtgcgtgtgatgaaaaagagagcacaaatgaaaatgcaatgacctaatgtggtaattcaatcatctctttgctaggtaattacccctcttaatagtacggcgaaactagaaaataaactagcaattttgatcgccctacacctcgatcaattctaaattaaagcactagttttaccgtcttctttctctttgctttgcgccgtcaattttaatccatcgataatcatccatgcgcacatataacgtggacctgacttaaaatgtatagctcaaagacaacggttagtccacaattagcgcttgtcattaattaccaaaattaacaccgggggcctagatgcttcaatctccccctttttggtaattgatgacgaacaccacaaatatatataatcaaacatagagcacatggacatatattgcattgacaagcaaaagctccccctaaacatatggataacaaacacaaatagcaaatatggagccaatgcacatttcaatttcacaattcaacatagcacaacacatatgcaaattataatgtgaacttcacatatgaatcaaccgaatgcataagatggtcacaagtatatcaatgtcacaccaaccatccatcatagcacaagttcacatcaagaccacataaagtgctcacaaataaatgtaggctattacaagaccatgaagggtccaaatg

SEQ ID NO: 30629 - DNA, 17567 bp, Oryza sativa
tgctttgcgccgtcaatgttaatccattgataatcatccatgcgcacatatgacgtggacctaacttaaaatgtatagctcaaagacaacggttagtccacaattagcgcttgtcattaattaccaaaattaacaccgggggtctagatgcttcacaccccgcacgcccatcgccgtcggccaccgcacacgcccgtcgccgtcttccacctcgcgcggcgctcgccgttcgccaccgccgttcgcgcctcgttcgaccaagagagagagagggagagatcggaagaggaggagacggtgggcggaggagacgagaaaatgctagaaagaggagaggaagaggttgctgggctagtgggctgatgaggggtatgggtgaaatttttgtactgggctaccttgggccaggacacccactgtgggatgtagtaccctcaccgggttgcttcagattttaaggagttcatccaggggcaccctccattgcgaaccaagtttctctacgagtgtcctcagttagtgaggacactctaggagtgtctcacattgtggatgccctgactgatcccatctgaaagttctcttattttgtgaaaggaaaaccaattcccatgtaccatgttcgaggcatttcaaaccgtgtaattttacgaggatttgtgtcaaaaatgaagggttctaggaaaaccattcacatgagaatatgatactgtggttgcacaaacgaatttcctactttttcctagcttttgacgcaaatatgcttcaaatcgttgtcgatatgtcatgcagtcatttttcctattgtcaaaccaacacgattcgttcaaaaactttttgtcaaatcaacacataccagtccaaacacaagctttgaattcgccgtggctctttgtcgttcgtgccgtaacaaccacggtgaatttgacatgttttaacttgtaatttgtgcgaatgtctacattgggaaaatactatataccaataccgaagattgagagcaagtataatctttgcattcctttcagaaaagtataatctttgcaatttgtgaagaaaaagaaaacagtactctatgacggtcaatatttttccccaaaagctagcatgcatcatgaaagacagaaagggacaatggaatgatatggacaaagggttaatttatgaagaaaaagaaaaacggtaccgtgcaagttctaatatcatgctggccactatgggttcaaaattcaaacgcagtaatttttttaaaaaaatcaaatgcagttgattttttttccatgtcctgaaaaacaaaaccaaaaaagttagagcggtacccaaattctgaaggaatcccgatagtacaatatgggcttcatcccattatttgggcctaaaattctccgtaacttctatctgtattgggcttcagttgagatttgagaatttcattcctttttgggccgaaaccttgcaaaattgcaatttcggaagcgtacggcgatgtggaggaataagttcactttagatcccttaacttgacagcgaattcgattgtcaccctttaaccgcaataccagatacaacaaatccctcaactgttaaaaccggtgcaatatagatcccacgatggtttggatggtggttttagcttacgtggtgtctacgtgactaatttgactcggtacatgcacatgacgtggcatagactcggtcttcagagttcagactatgtcttgtactcgcaggcttgcccattctgccgccgccacccaatgtcatcgaccatcctctcgtcgacaagatggcccaagaccctcaccaccgaccacctccaccgcctggtccgcgcagagtgtgacccacgttggaccctggcgctcttcgacgcggacatcgccaggccctcgtctgtgtccctgcccgatgattccacgaccaccgttgccgccgccgcgcttgtcctccagtcgtgcgacacctaggtcttcaagagagatgaagagaagatggggacagatgagagagaagaggaggggagtgagaatgacatgtgagattcacctaggtctcaccattatttatttattttttttgtgtagctgatatgtgggctcacgaattttattattttccaaatcaaattgccacataagcgccacgtcaatcccacgtgggacgaagactagtcaaattagccacgtatgtgctacgttagccaaaaaccggggacaatactaccgagggaccttgtttgtactgcttttgtaagttgggaacctattgtatttggtttttcggtttaaggacgaaaataagatttagtgtcaaattaacgcctggtttagtttccccaaattttttttctaaagacatcacatcgaatctttaaacacatgtatggagcattaaatatagattaaaaaaactagttgcacagttggggagaaaatcacgagacgagtcttttgtacctaattagtcataagtgctacagtaacccactctgctaatgacggattaattaggcacaaaagattcgtctcgcggtttccaggcgagttataaaattaaaattttcattcgtgtctaaaaacccttttcgatatcttctcaaacatctgatgtgacacgcagaaattttcttttcacgaactaaacaatgaccttattccccacgtggatcatggcgtgacagcgtgagagggtacttctcatctctacctctaatactcgccgttggatgtaatccccgaaaccatccaacggatcagatccacgtatccgccatcagaacgaaattcgagacgatccgacggccctcatcatccgagaggaggacgagaggccaacgcggatgacgtcaccaccattcccttctccctcttccgccgccgcctcctcctcctccagcatagcccatggcgggggaaaccctctcctcgtcgccgcggaaaccctaaaccctagctcgatttcagcgccgccgccgacgccatggggacgcgccgagacgtgcgcttcgtctccttcggtgtgaagctcccctgcgccgacgcggctccggcgccagcgccagcgccgacgctgctctccgcggcgctcccgttcgcgcgcatcggccgcgccatcgatggcgtggtgcgccacgtggccaggtcgctgcccaggctacccgtggcgagggccaaaaccggggcggggacggcgagcggcgcccatcgcgctgccgcggaggcaaaaggacggcggagggggtggagggggaaaggagcgggtgctgatcagcaaggtggcggtgagggggaaggacggggagcccctggagcggcccgagctggaggcggcccgcgcggcggcgctccgggcgtgccgccccaacgcggcgctcacggtgcgggaggtgcaggaggacgtgcaccgcgtcgtcgagagcggcctcttccgctcctgcatgcccgtcgccgtcgacacccgtgacggcattcgtctcgtctttgaggtcaggattattattattattattattattatttgctcgttccccattttctcttcgtcagctaaccttggaactgattattgcacattttgggcttggtttaggtggagccgaaccaggacttccatgggttggtctgtgagggtgccaacatgctgccatctaagttcctagaggacgcatttcatgatcgccatggtaagaacttgtccaccttcattctcggtagcctgctgtggtggatgaagtgaaatgtggtatagattatcataattgaggatatgtgcctgtcagggtaaaaagctacatttgtttcatttactcatacatcatatcaaaagcttaaagcaatgcaaatcgttgttctcctattgtaaaatctgggtaaagagccatcaaagtatagcggtggtcagtatcctatatctttgacatagcgtatgcatttgtctagaatgaatttgggtattgaattccagaactccactggattaaaatgtgctgctttgcagctcttattgttggttcattttgaccctatagacaaaaatgcttttctacatcctacgaaatctcatagttgtaccatttctctatggagaaagaatgcgcaattcatttcctctttgtaatcctaatgtaccttttctagcttgtcgcattttcttttgagacctacttgagttttcatattacactatgcagggaaaataatcaatataagacatttggatcaagtgatcaagtctgttaatggatggtatcaggaacgtggtctaactggcttggtaagtggcaaatcagtgaatataaaactcatcttctacttttgtatgctatttggttctatatcacattttgtttaaaaggtttgagcattgctgtaatcaggcttctggtgcccatttgatttacagtacattctttgtaactacaaacttttagatgcatacaacaacagcagtcgatttgttgctatccagattgtctaacctgcactatttgcatatatattgctgatgtcaaataggtgggcatacaccatggtaatcctctgttatttgttaaattcttagtcctaacaggattagaaatatgatgtgtggttaatgctgaagttagcaacctatcgataagttgagctctggcattcattattgtagggcaaaacacatcagacttttacagttttaacaagaaaaacaaggtattttgtttactactgataaatcaataaagccccttgatttggtatcaggtttcatatgctgagattctttctggaggaattctgaggctacaagtttctgaagctgaggttaataatatcaatattcgctttctggatagaagaacgtgagaaccatagcctgatttattgagattcgcttcacttgttactgttttatttctatgcgatattctgatctttcttatcttccacctctttctatttctctccatcaccagtggtgaaccaactgttgggaagacgcaaccagagacaatactccgtcaccttaccaccaagaagggtcaggtcagatcattgaaatcacttttctccatttgtgtttacctactttaggaacactattccactacaatgatatttacaaatttcacatcagttgtgttctcaatgtagaagttttcttgtgatatgattttaagaactagttccatttcatacctactttaaaagcactatgtcactgttgatgatattcacaaatattcatatcagttatatctagaacatacgagttttcatgagatatgacttcaagaaccatttccatttcatactgaactgtgcactaggcattgaagcattgctttggtgtgcttctgaaattgcaatgcaaatgccataattacaaaacttaatttttataccgatgttagagtgtactcattaaattctttgaacatttatgtataatatttgcctatacatataattttgcacaaattctgtattctgcaaaaaaaaggaaagaaagaaagaaaggggtagtcatgcaatctgaagcagaagtattttgctaatgaaaatacagactaattctctgataagagtgatactgtattatctgtctaaacttgtgatgatgaaaataggcttacaatagagcacaagtgaaaagggatgttgaaacaatccttactatgggaatcatggaggatgttactataattccacagccagttggaggtaatgttaatttgttagttcagtctgtttcggaaagctggtatttgcacttattagcacatgttttcttacttatgatcttctgcagattctaataaagttgatcttgtcatgaatcttgttgaacgaccttcgggtggtttttctgctggtggtggcatttcaagtgggtgagtacaaggcttgctgagcgaacttaattgaatgaaatatcaaatctttgctttcataaaaataatttccttatccataaggttctgataatgttaaacttactgtacctcaaagaccatatgcaaaatatatgcaaatttgcatccaaatgttgttttaacatctattttatcatgatggcatgctgtgttttctgcaggataacaaatggaccactttctgggcttattggcaggttggtagattcttccactctttttatttttatgccttcggctattctgattttgtttatcgtactgttcttaccacatgccaatatgatcttgtttctgctggaagaccagaatatagctgttttttctatgcaacaatgttgggattgttgtttgttagaaaccagacttcttaaacttctaggaagcatcctggattatcagctgtgaagaattagatattgcttcaaatgtatcagttaatatccttacagaagttgtcctcaaactggagttgcacatctaattcttgtctcgcactggaataaacagttttgcatattctcatcgaaatgtttttgggaggaacaagaagctgaatctctcactggagagggggcaaatagattctatatttcgattaaactatactgatccttggattgatggtgacaataagaggacctccagaactatcatggttcaggtaattatgattaagacaattccgtcttcaacgctccatagttacttatggctgacaatcatcgttatgttcttataattattttctttgccagaactctaggactcccggaacacttatccatggtggggaccatcctgaccatgggcccattacaattggacgagttactgctggcattgaatacagtcgaccattcagacctaaatggagtggcacacttggattaatatttcaggtacaactagtgaatgaagtcgcatgttcgcgcgactataaccttcctatctattaaccgttattgtaattaacaataatttttccaccattcagttaaatcaataattagatgttaatttcttttctatatattgttttgattgctgctgactgatttacagtgttatatgtagaatattttttccctcttctaaaattatttaattggtcatctagtctaaggaccgtttgggttgatttgccaagccaagccagccctagacctgtttgggaggccaacatgagattacaatgagaggcaatgagtggctcaaactcttccttctctgtgtattttaccacttctagaagattcctcgtttcaatggctaggatttttccttgctattttgtcattttgtgaatccaacggccattttttgacagatgatgtggctaattctggttgctttttgagttttacttttcacatagaatagatttgccatagtaatcaagtagccctttctccgtacttattggccatgagagaagacccagactagacaatcttgtgacattaatactaccttaggttaaaggataaaaaaggatactctacccccgttcttaaatatagatgacgtcgtcaaacctcaatatcttaaatcattaatatatgctaaaatattatgatttattaattataaaaatagcaccaatagatttatcatgaaaattcctttcatgcagttatgtttttaatattgtttgtaaatacataattagaagaagtaataatggtacatgtccatatccaaagcatcaagcaaaaaagaagagatgtagtacatgagcacagtttgtaccgccagtaatggtgtaaccgtgtaagaagcaagtgactaagtttgttgatttggttcctgctataaatctgtccctttggggaccttcattctactgattactgacactctatgcagcatgctggtgctcgtgatgacaaaggcaatcctatcatcagagatttctataacagccaattaactgccaggtcttggatctcgatgcttcatttaccttaactttgcgccataaataattttatgttcaatctaccatgaattcaattgtcaaatcatgttaacatatggaatctgatgttcttgtcatgacaatgcagcggaaatgcttatgatgatacactactagctaagcttgaaagtgtctacacagactctggagatcgtagctcaacaatggttagcatttttcctactccactgcttattttctaatttttgttgtcaaaatctcttatcacctactgttcttactgcttccagttcgttttcaacattgagcaaggtcttcctattcttcctgagtggctcagttttaacagagtgacagcgcgtttgaggcagggctatgaaattggccctgctcgacttcttctaaggtatgttttagtgcatatcatatgccatgtatggatcttggaacataaatatgagtttgccctaaaggtttccagtagcaaattgcccaggttgtattactcattccataaatcactctttctatgtgctgtagtgcttctggaggtcatgtagagggaaacttttcgcctcatgaagcatttgcaattggtgggacaaatagtgtaagaggatatgaagaaggtgctgttggttctggccgctcatatgctgttggtagtggagaagtctcttgccgcatggtaggctttgtcactttttatggaatgttctgtctttagtagaaggggcttaacctgaatcatcagtacagtaaaatatatacttacatacacaactacttgttttcccccataaatacctagttgataacatggatatgcatacataaaagaaaactaaaaatagtagtatttgagattaaaattattttgcaacttaagatgaagttatatttgttggactggatgtatttaagaatatagttaacttggtgaggacactatgtgatgcacagaatggcaaatagttgtatctataccaaatatttcatgagttgtatcactctaataatatttttttcctttgctttagacgggtatggtgaagagtatattaatttctatacgaaaattgttctgtcatgatgacaagtgcatattatgacctgatgcatgatggtcaaacttctattcatcatcttgattacttacagtgctttttctgtgtgtagtttgggccattggaaggtgtggtgtttggtgactatggtagtgatcttagttctggtcccaaagttcctggtaagccatgttctgctcgcattttacatgttcggaagttttgtggtccacttgtgtacctgttggtcctaaagcagcacagtcctgtcgactagtagtcagtagatgttctctactttgttaagccttgtataggtgtgaaaataaaaacaatccttataattgggaaagttaatgtcttttgcatttattaatgaggtttagtgccctgaaacaattttgacatggttccatatttacagtgatagcatctcttttatgctaaacccaaatctcatttaggccacctttggttattggttgtttaggtgacccagccggagctcgtgggaagccaggaagtggttacggttacggtgttggcgtccgtgtggactccccactgggacctttgcgtcttgagtatgctttcaatgataaacaagcaaggcgatttcattttggggttggctacagaaattaaccagagtatcattgtgtttgtcggcgtgatccttcatttgattagctgctgttaggagatagtaccattacttccatttctttgcggtatcaatatgtgaaagccttttgcaaagcaaattttgtctgtcccaattcccttattgtaacatatttgtacatttttttcaatcctccctcttctcatgtagatgttcttgaaactgaggagaaaatgatcccaccaggtaattactcatgacttatggttgggtgaagttccctgggataatttaaacaagttttgtcgttgtcgtaggacaaaattttggatttgtatcaatgtcaccatttgtattgtaatgttagctggagaaatctgagcctctgctattcagcttaaacaaaagctatcataatctgtctgatgacattgcaagttcgctccaaacaaaagctgccactttgagtctgtccaggaccaaagccacgtccgcacgcatgggcctgtattatgtgtcatgagaagttgcagcatgcatcggatttcctcagatctcaagatgaatgaaagcttcccaaaccaataaaaagctggactgaagagcactcacggaatcttccatccatgcaatggggacatgctagcaggtacgcacaatcagtgtctcatcctgtcattttccagctacaagttatccttttatcttaagatatactcaatacaatttcccgagctgaaaatttcaagaaaataattttctctcttgctgtctttggtaattttcattcttcttacagctacaacttacaatgttgataaaagttcaaaagattgtttgccttcaaagaaacatctgtgctgttttgggttcaggacttggttattgctactctgcttcatgccatccatgtgctactgcaaaatgctaccagtgtattagcatctcgatacatgtaatcatgcatatgtccagcatataatggattgacaattcttcaagacctacacctgcacaccattctgtcggcattattttttccatctctagaacttgcagtagcccaggcgcccagctgtccttctgcacactagtagatcagatgactcacctgattaaattagtttgctactgaatttgttcatttggtcccagtttacccctaccttcctgccatagagtttggtttttaatcaaacaagtcatcttgcaatgcattgcctgcatgctgcaggttagtcatcattgcacaggcaaccatcagcaggctgtcccatgctgataatcaaatacccaggagaccaatctttctgggattcatgcatgcatgatatggcctgcagatataagctgacaagccagatgcagccaacgattgacagtgtgtaatcagtctattatgggaggagaccaacctgagcttatcatctccagtttttcagtggaccgatcaatcggcgattttcgcgtttgtgatcatgaggtttcctgcagattaatctcccctggatgcatctggggacaacatggatggatgcttctgctgctcagctgctgtctattcatggtattctctcttgccttcttgcagcggttttcagaggtcactccagtatccttcgttaattcgtaggaactagggaaatcaaatcttagtacaccgtaatgctatgtttccaactaaaagaattggattattgcaccaaatatgggaactaactagctaggagtgcctcatgattactgaaaaacccaagccacattcttacagaacactttataatgtcaataattacacttcattttgcctgcctagctaggtagctagatggcatccaagaaaatcgaattgaaagaaaaaaaatagcaagatgccaaagttgtactactacatgattaatgcaaaacaaggtcacaacaccaacttttccatgattaattcaaaatcaagatgatcacaacaccagcttttccaagccactgttgcacttatctgtccatcagggacagaaagcatcaccctctccacatcaccagtgcacgaaccatgatcttccatagattggcatatcaaaaggcaaaagctagaagccagtagtagtgtaccaccaccaccggtgtgtgtgggtatcttgtagtacttggtgtgagcgtgatatgatgcagcattgcagcttatctagctcagcgtagcctcctagaaaaggaaacgggaaagcagcctctcatccagatcgaagctctcgctatcaatcctgggtatctttgtgtactacgctagctgtggcgtgtgtgttcatgcatcatgtgatataacagtgtagtaccatttgtggtctactcctccttcttactcttactccctctgtccatataaaatcaaaccctcctcttttttactcttactccctctgtcccttataaaatcaaatcctagcatcccaatgtaacattagtggagagtgaaaatgaccaaaatacctcttattattaaaaaaaatagtaatgatgatatgtaggtaaagaatgttgaaggaataaaacttctcattttacttgctgggagtaggtagaatggtagaagttggtttttttttggacaaaattcaaactccagaagttgagtttttttggacggagagagtaaaatataagagattttaaatatatgtaatatatcatagtactatgatcatgtgttcagattcaaagtatgtaatatatcatagtactatgatcatgtgttcagattcaaagtactacaagtactgaatgtgttgtattcttcaaaatcccttgtattatgggagggagggaatacaatgcatgcacacacattgtagtagtactgtatgctagaattcttgtgcatgcgtgcatgtggtcgatcgaaatgtgtgtgattcgttgaggacttagcgagggggaggatgcgatggagacagtgcttagctagctgctagcggctcatgtactgctggtccctgcattatcatcatcgtgaattcgcttgtgttgccatcgtacgttttctctcggatcggtcaagcatgcacagttcagtcacagcgcctttccagtggcgggagctagaaacacttggggctgtttggttgtatatatgctttagtttaccaacttttagagctaaggtgcggtgtggtatgtcataatttgtttggctgaaaaaaactcttagccacatatatagtggtagatcaaaaaagttttagagcatggggaaaaaatattgtatcaagtgtttgcaatgaaaattttgcttctataaattgaaaattaaaacatttaaatttcattgtgcggccacccgaccagcccggtcatcgggtggtggagtggatccacccctggccacatgttaagcaaacctgattgccaaaggtttggtatgaaccaaacacctgataaaagttatttatcggtatttttaaaatgcttttttgctaaagcatagttgtgcaaattttcaaagtgtcatgtcccttcattcgatccaaaatccctcaaaactcgaaagtaagattaacattaggcatagttggaagatttttgaattacccttacctaactcttgtttaatttaagacggacttcattcccccaacacacgttctctcacaattagagaaggacccacaggtgacggtgtctttgtctcgttggaatccctctcctcttcgtccccggtggttgccggtgaaaggattggggggagggggggtccgggggagtgctcaagctcgtcccatagtcgggtaaattatgttacagatcctttgtccccctcccccacctttcttgtaaagattaaaggagatgtcgacttctgtctcctttgtcctggcggtgtcatgccatggatggatctgctagacttggtctcggaagatgccgtctagctagcaaccgtcaggcttagaaccgatgctttggttatcaacatctgtaacatgtagtccttcaaatccacaagcaataaaaggttacgccggccattcttcaattttccaatgagcagacctgcaagggttggcgctcttccctgtggactttggtggtggatctcaaagcgatgattgtggttttcttgtttggccatgaaagcttcaacctccatcatggaggccttgattgggtttgcttcttgactatgccctttgcagtctgccatggtttcatcaccatcaccgtagacactggatggaacaatggaacatcagctcggtggaaggagttgaaggacctgatcacattttacttttctttagaggactttttttacatgtttcaaaatgttctatgaggggccttgtgtactcccaattgtgttttaataaactaccctgaggttgttgcctcagtttattttttaaaaaatcaagttcctatttaattagtatttagggcttagaacgtagaaatttttaagattttcatagaactagtttaatacatgcaaaagaaaaattccaaagaggtcttatagtagtttttaattttgaagtgaaatggttcaattccaacatacaataatttagattttagaagacttcatgcattccaacctttatattttgctaaaatctcgttttcgaaccaataattgagtggatttggtcgaaccaataattaattgtaagacaggtttgtattttgcatgtgccaaaatttgaggtttagtgaatcatgcctgatgatgctgcggtagacgcgtagagatatgagtactttatgtaccacatgtgtattatttggcattggagtaagatttttcacagttcatttgaacatgtgtcgaaggaggaaacctgacgaatatatatatatacattggtgtgtgggactttcatgtaattgagaagttgttaaggttttattcgcaattcctacatattaatttccttgattcaattcaaaacaaaagctaaaagatgtaaccatgcatctctcaattggtgaccacgatctcgatcatcttgaaacattcatgatcggtgactaggatcgatgatcatcgatctgtccctctgctacctagtacgtgctgttactgtatctaaatttatggctctcactattgatctattccatccataccttgaaccctaagtgctgtcagttgggggttgcaaagcttgcgacgacccctacagtaattaattggggaattaattaagctggggagaaagcagcacaggacaatgaatgctgctactatttggcatttcattttcaattaatcaatcaagccgtgtccagttgaacattgagctatactgctagctatgcaaaaacagtgggccctggctgcaggtccattttgttgtgtggcttgtatggtttgactggtgaatatatacagcttaggaatttacaaaactgtacttctggcagataattatttgtcagagaaagtagatatgtgcatgtgagctgttcaagatatataaaaaatgaattttctcacatgtatatatgtaggtgatgattgattaattagctgaagtttgaactgtggcttataccaattttgaattgttgaacttaatttaggttttctatatattcattcttaacttttggatagtaagaaattaattctaaaagtattaattaccctaaaaaattactccatccattcttaaataaagcatttctttatactccctcattccatttatatatgacattggttagtaaaaatttaaactaaccaaagtttcatataaatggaagaagggagtatgttctttaacaaagattaaggataaggaaaaaaatatttcatctcaatcacttcatttgccaaatattgaatggctatgataattccatcgtaagcatatgattgtcgcttaaaatgcttagtttcctgtggattgtaatcggtgtcatagaaacacggaggggttatgtgctattttctttatctatactccttaattagtggtggtggtaaatggtgaatctaccattatttgtactaccaactcgatacatttttggggataaagaataatgtggggtctagtataagggcttacacgtcaatcaaccttatcaccaactctttatttttttctttaagaaggaaaaaggattgtgggggctagtgggcccagagagatcacatttaagtaacaaatatatatatatatataaactaaaagataatatttatacaaattaatggtactgacgggttaatgatatttttttaataaaatcctgttacatatggttgtaattgtacaggtaatattatatatatatatatatatatatatatatatatatatatatatatatatatatatatatataaatggtagcatatgtaataccttcaaagaatcatgtctactatctttacattaaatgtaattctttatattttaactttatgctaaccgtacatattgtcgtcactacatatatacgcaaccatgcatgcaggacgtacaaggaaatgaagaagatatataatagtcgtactagctgtttacatacatctgaaaaatattactctataatccatttcaaaatattaggacacaactattttttttctatgttttataatacaagacgtgcatatatgcatatacatatagttaactagcttccctcgtttaaattggtttgtttaaatcctccacccttatctctaactttattaggtgtgtacataatttatttattagggtgatccaaataaaaaggtgataataattatttcttggtatcagttgcgtctttatattttagaacgaacgaaagtatatatattctcaccatttagattattaaaagtgacatcgttcgattcgtcctacaaataatgtcaagctccattttctggaggccgtacgtgaaattaatccaacccacatcttataaaaatcaaacgatatccacaataccccttcgtcatcgtcgtccccagctagctatatcccctgcagcatcacatcatctgcaaaattcttcatgcaccctagctactaccttagctcgcattgatccatccatccatccatccatggaggactacgcccaaaccaacctgatctcgagaggccatggccatcatcatcaacccgagctcatgaaggaattccctttcctcagcctcatttcatctacctcttcttgcatcagcagcagtggtcagcagcagcagcagcagcaagatgatgatggccatggcggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccaggtatttatacgtgcaaaaaacacatatatacttaaataatggagtatatgacaagtgtgttttaaattcctactccgatccccatttgatctatatggtcataaaaagatataccaataaatttctagcaattgagcatatttatgagttatgatcagctatcttatgaaactcccaacaatcgatgaagtttatcattagtcattataatgtgtcttagtgaatgtgcatgctcttgcttacgtcgtggtgtgtttgtgtaattaatgcttgtcatagtggagagtgaattttaaactcgagagacgtcccctcgttgcacttaaatagttataaaaaaataagatgatatattaacatgtgatatatcacttcataaatatgtaacttaaaatttaacttgtacgtgtaaaaaaaaa

SEQ ID NO: 30630 - DNA, 9032 bp, Oryza sativa
tgcaattaagagaagatgaacaatgggcagctggctgaaaattaagaatgaaaaattgcgttgcgtggtgagtgcagatgcacatgtgggggcacgggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggggcccgcgacttcgcctgcccccgctgcgccaagcgcttcgccgtccgcggcgactggcgcacccacgagaagaactgcggccgcctctggcgctgcgcctgcggcgcccacttccgacacaagcgctccctcaacgaccacgcacgggcctttggcgccgcccacgcccacgccggcgccggcgccggccccgaagacgacggccgtgcccccgccgccgccgccggtgtgctgcgatcaccttaatttatatatatgtgagtgcgaaattaattagctgattattggttagtttcaggttatttttttagtagaaaattaatttgtttgtgatcgatcatatatatatgtgaaggactctcttaattgtttttttgtttggtttgatttgatttgatgtgtattgcatgcaatttgcagtttgggtgtgagatcttaattatattaattaaacactatatatatacagtgtgcttatggtaaatgcatgggttttgaactgaggttagatttattaattcgaactatgtttgacattgctatgactatagtgattattgcatattgtgaaataattcaaacttagctaattaaagttgagatgctttttttgaagttttagatccacaagaaataatagcattgcgaaattttatttagcttatggtagacatcggtagctagtcgtgcaaactttggaatattggttgtaagtaaacgccggaattaatcaatgaattccattacctcgaatttgcttctctgtaacaattcgttccatttgttatggcttgtatatattcaatagtacttaataactcgcaagacacttgttaaataaaataacaacactagctggttcttggttttgcataatttctagaaaattactgaggagatgtgaaaaagggacttgtagaatgtaccgttatcacgattcatgtctaacaaaataatccactaggccataaaacattttttaatcgaacacaacaaccaagcttaccagcgagggacgtcaatggtaggaacataaaaatccaaatttttttaataagaaaatatcctaaaacccgaagaagttgctccggtcaaactgcccgttgagcgtcgttctgaccacctgatactggtggtttgaccgacggtatgccaccggtgaccagtctaaccgcctccctatcgtctgcctgatctcctattgttgtttcctcttgacttgatgccattggtccaaccaccaagatgccttcggtcacaccgtcgtggtctgactgtcgttcctctactggcctgaccatcataatagagagaacataaatcagaaaaattctttgaatgtagatcaactttattgcttctaattgtgtttataaagtgcaacaaaaacgctcctctctcaactttcgactaaactcaaatctaggttaaaccctaacttttctcatgacaattctctatttatatcctgagatgactgcacaaaagccacaaatccaacatgagtaagtagtcctaatccattcggaaactcacctgtacaagtatccaactcaatatcctttacaaatttaaacttcaaacttttcaaacttggactccattcaaaattaactatgctttccatatgcatacaacacctcttgtatgacatacaaaatcttcatcaccacatgcattgtcctctaggattagtaccccacaagatctcctgatcatctagacaaaacttctctcaagttgactccctatccatcatcggcaatactctcctgagatctcaagacacacttacatatgaataaataagaaaccatattcaagcattagttcttttccaacttgactcaatattatcacacaacagtatatataacatacgtatagaaatcatctggaagccataagcaagaagcaatcattgttaatcaaaaaatcaactccaaaccaactccaaacaggagctagtcaatcaaaccgtctggttggccggtttgaccgccaccatgcctacagtttgaccggtgcctactgtctggtcccatacagagacaaaatcacttcgccaataaatcaccatatatcaaaaccaatacaaataaaatctcatgtcaattgttcatcacaataacaatcaaaacattgattttaccgttttggatgtgtaaggcacactagaacttttaaaattttgaatgtcaatatcttttttaatatttagatcgggtgtatgaaaaacaaacatatcaaatacatatttttctcacagtatcaaatttttgtcgggttttacggatatactaaaaatactccaaatcgttaggcctgtccaaagcaacatattttcttgactagagcatatgcatcttataagaactagacgagaaatgttattgttatatatagttttgttaggtctcagttgcttgaaattttcttattttccaataatcttaattcgcatagcatatataagtttgctggaactttaagctagcttgctttatgttatactacattgttatgggttaatctagatgtgtttctttaatatatattcttctctgtttttttccttttttgatttcaagttaaaagagcatctaataaacatgtgaattgttggatattgatgttgtggttgatatatatcatgatagataaaaagtggtcattcgacgagtggtgagttaaagcaaaaaaaaaaaaacctaggatttaactctaacctgtgcatctggttatccctgggcaatctaaccctggttaacaaaaaaaaaagttagtacagttggttttaaattcttacacgacatgatacatgggttgcacagtaatgtggttgctgttgatgcagttgtgtgattgttcgtgtcggcggttcaacaggtctgagaaaattgctgctgatcaagggaaatctttttgtgtggccctagagtgaaaaatgacatttattatcttcgtaatcaataagatgccgccgaattttgtaaatttatttttagaaaagtatggaaatgtaacagcatggagaaatacttatattagtttaatactttcaaactactccctctatcccaaaatatagctacttctgatagtacatattttagactagtcaaaagttaaaactaaaacaatcaggattatgatatattaccatcaaggtttctggaactatataattcactcatgtctggccaaaggttcaaaccaaagacagttcttgacagtgaaaacgaagcatttttatttttatttttctcacagtgccttcaaccaatgtacactggtcaagttaaaggactgatctgatcagtctgctagttcaagttgtgtcctattcctccccaacaagcggaggttacattctgattctgggtggtgttttgccacccatcccagactgttcatcttcactgtaaaatggtcaaatacaatgaccagctgtgatagcatacacatggccaacgcgcgaatctaagtcacaaatccttgtttccgtttgataaatggcgaaccatatatccccacatccctgcctggcagtgctcagaaagttaacatctctcctaagttctccgcttcagttcagaggatagtgtgacaagcttgtatggatagtcatgtgctacaagctcacttcctttggcaggctgatctccaagaaatacaagctgacaatgcaaaaaccagagattagttgtgtaagaatagcatatgtaccgctccaaggcaatgtgacggtatgctgcggtataagattgactagctgttcagtgtcaaggtcaataagttaatcagtctattcatttgatatattttaattttgatgatgagtttatgacaatgatgttttagcaattcagcacttgcgagcattaagttacttatattccagggtagaagtgcatcaaaaaatataaaggaaaatctttactgaatgcaaatccacattagtcacaatggatgatctgaaacatattaggagtactttatttgaaacatcaacaaaccttgcagacatgaaggccatgccaacaaagactgctttgacagcctgtttttgaccagcatagtcaaatgctagaggtaacatttcatgcaaagtgaggaaggccataaccccaccaactgcagaaaggcacatgggaggtcaacaaaatgcagaatactgataccagtttttctttttattaacagactgacctgaaccaagtaggccttcaagaacttcaggatttaagctgctcggaaacaagtaagctgaagcaatcacatttgcatcagccttcagcactcaatggatatacaccagaagaaaaatattacagagaagtgcatatgacatagcataccaacaatgatcactcctagtggctcagcgaaaccagagagggttgcaactttaaatgcttgccatttgctttgacatgtgaaaaaaggaacaagatataattactgtggtagaagaaagtgttacaaaattacaagagaactatcagaaacatgctattattgcaaattgaaaaggttaagcatcatttgccttttcgctaaagcaaaaccattagaaattattaatgctctgtaatcctccaagtgcaacaggtggaatgtagtactagcagataagagtggttcgccaatgactagttctcaaatcttacacacctatcctcaattcatgacttcaactagtacactctttttttaccagtaactagtacactctttttttaccagtaactagtacactcttttgtctatagaaaatctcaaagccataacatatattctttaatgaactcatttctgaaggctactgtgaaccatataacttaattcagttcctctctacatgggtaaaataggtacctgttggtagcaaaatagagtggtagagctacagcaaccccctgagaaggtgaaaaaaaaaacaactaattagggcttcagataaatactacagtaaatgaaccaagttctgtagaagttaaaagaagttgtccaagactctatcctgccacactcaacaatgattcagatacagctacattgacttgttgagatctagaaaatgtcataaatgttgcagcttaagggcatatataattaaccaaacttgagatttttttttccttgtcatgatttagtttgccataacgttggcgattcatattaaactgataaatgaaataccagatattttctaagaggcaaactttagatggcattcaaatctttctgcaagcacatacaacaagctagggtatcctaattagcaatatgcaacatcaaactgtagttaagaattctcatggaccagaaatgctgataagttgatttatctacctctggtatattgtgtaaagcaatagcaatagccaagttcagtcccacacgaaggccctgcagtttttcatcataacaaaacacattcagggcaagctaacaaatatccaacatgatatctattgggacacagaatgatattaaatacaactagcaactaggccaagccaactactcaaatacagtaactattggaacaccaaaactatgttatatagtgttatagaccagagctagtaaaggctttgaaaggtggttggtcccaagtaacttctattagatgaaaaaaatgcaagttacagatcccttcaacagatgaatgatgccactatattggaatgatgaatatacaaaagcaataccttcatggatcccaaaaatactgccatcccctccggaaagttatgcaagctgattcctgcaggctcataataagtatcaaatcagattgttgtagtatctcaaggaacaaggaagcaaagccacacaacatatatcaagaaacagtttgaataatggcctggtgtaagttcaataggaatgcatgtctggttgtatgcttagtgatacagaagtcttattttcttaccaacagcagtaatgatcccactgaataatacttgccgacgatgttttttcatcatatctttacccgaaccatcatcgtcagtctgctttcctcaaaccaaacatagagaactaaattctgttcagccttggtatttgaaaacagactaatatgattgtgaaaacattattaaggctgcttatttcaacctgcttcttgcctgcatcagctgttggcacaacagttggctctggaataaacttgacaaccaaaccaaagaaaagaactccagcaaaaaactgcaaaatattattattagttaacaatggttgctgcttattgtatgagatagatcggcattacattggcatggatactataagtataggcaaagcatgactgacccaaaggttgcccttcaagaaaccaatagaattcaatgcattgtgtgccaaatctagaaaggaaatgctcaacataagtccagcggcaaaaccctgtattcagtaacagcaagagatcaatctaccaagaaccaatagcaaaaccagaacttgcttaaaagatagtgaagttgctccattactatagagaacaaagcttatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggagatgggggaagggaagcttttgctgcggcggcgtctcacggcgtgcgtacgtcagcagtttgatgagagagagagtacggcgtcttttgctaatcacatgcttatgtgctttgggtttgggttagtcaatagataggggaattttgtcttggtaattttttttttcttctgttcttttttttgttgtctttgtcagggcatattggcaacttgtgttcttggaattttgtattttttaaaaaaatatatatatcgcgaatttgatatcgtggatcgtgcagattcgacggtcgagatctaactggatgagcagatatagcaggtcgaatttagatttggttgagatgaagttaagccaccaaaaacaaaagaaaaagtcattaccatgtgattgattagttgagttttaatattctaaatcaacttctatatgttacgtccgtcccataatataagcgattctggaggaatatattttctagtattacgaatctgaaccgtctcttagtctagattcgtagtattatgaagtgtcacatctctttatgattttagtaatgtgacgcggataacatgatgtagattttttaaggagaaacaatgtactatactccattcgaactggtaatacttatcattttgaagcagagtaaagtcaaaccttcaaatctttgactataaataatttataaaatatttatcttagaaatatgaaaactatatgtatatattagttttaaaaatgtacttcaataaaattatatatttgtgatatttctatatatattataatagaaaatagtggtcaaatatgttttcttagactatatttttaaaacgacaaatattatcaactcggagggagtagtaatatcaatattatttatcagtttcataaaagctaactgaaacaatgtagttgggctaatacaatagccagccacatgaatcatgccatccacccacctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaaacaaattaagcaacatgatatatatatatatatatatata

SEQ ID NO: 30631 - DNA, 9034 bp, Oryza sativa
  unsure (1)..(9034): unsure at all n locations
nnnnnnnnnnnnnnnnnnnnnnnnnnnnnnnnnnnnnnnnnnnnnnnnnnnnnnnttcaaataccattcgaacccccccccccccccttctcaaaaatatgatttctagcctatctcgaaatcacagaaaatttcgcaaaaaccaaccagtttttatcaagattgttcatgcgaattttattcgagcttcccaaaccattcagttttatgaatagttccgtttgaaatttcatcagaatttagtgaaaatagtgctgtgcctcacaattcaaccccaaaacgagattgcaaacccgcctctcgtccctgttgatgatgcattcttgtttatatcgtttacaggcgtaaaaactcaagacagctactggattaacttatacagaaactagatcacaagttcacatccaggaaacatttaagattttgattatacacatatgcagtgatgctaaagatcggccccagtttcagcaaaagagcaggaagttcagattccagcctgaacttgcaccacaacagaagcagccaatctcacatagatactagggatcagaatatcagacaatctgatctgtcaaagataggcctggttaacaaactcgatgaaacagaattgcacaagccacaagggaggctgcaaggcgaatcatttgcggttcttggaacgctttttctcgagcctctgacgagcttgctcaaactcctcttccgtgggctccgagctgctgctcccctttgggtcacatttggacatgatggatgagagcaccgagtcgaaccggtccttccgctgcgccctgcgctgtgagatcgcgaggatcagatcgttctcctcgctcttcttcttgttcttcctgtgacgaggtttgaggcaaatgcagtagtgagcaactgatggtagacaacatctcggaaggcggattacttgggagataagagaatgagagcttacttcactcttctctctaatgggtttgtgggaggttcaatctcggagatcttcttggcccatttatcatatgcttttgttgacttcagctcacctacaaaagggaaggaaatggaaaggagtttaaccattagagaagtttcagggaatagattgagttagcatgataagctaaacactttgccagcgcttcattgtagaaaaggaatagaaaaaggtattcaatattatatgataaaattatatggcaacagcatataatcatttaccttcagcaattgcctcatcaattatatctttaaagcgatgggaatcaagctttggatctgagcaaatcattgaacaaaaaagcctgcatacaagggcaccaaattaaaatagaaatggaacccaattattcacttgcaattcattgccttctgtatagaaaattaatcaacactaaattttgtaagccacctgttcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgtctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatccccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatcttcagaatgaagaaaggaaacatcaaatgagttacttgtgttataaagaaagacaaaactgaagcataacaattgtttctgattgcatatgtactttaggttcctttctacagcttcgcttaaaaataaataatttaggccgattccactgagctagctgcacctgcaccacagacaactgctgcaggaagccagcaatgccctttgctaggggtcactgctagggaggtagcagcacaataagtctcattggttgcccatattctctaataagccatataaaaattaatttataggtaaaacttttatatatttgttcatagcaacttaaaatccaacactaaaagaaactacattgaaaatatcttaaaatcaagttcgaaaattcaaattttggcttttgctttggcttattaggccaaccgatggggctcttaagttgcaggcttgcagctagctcagcctataggagccactgtttctggttgcaatcttatgatttgtggcctttttaaagtcaattacatgaatttccatgaactctttcagctcttctttggcacttcattaagcttaggtttcagcaacatttccttcagtctagaatttttttaaaacgcgctaaacagtctagtagtgtgcgccaattaattacaatttttcagcacagatcaagacaaaaaaaaaatactgatgtctgaacagctgggacatatataaggtttattgaattaagttatgcaagtaaggtaatgctattgtacttgcttttaaaactaatagtggtatagcttgagatcaaccgccaatcacaacctcttgtacctcttggctcttgcacactttacccagtcattggtgttttctgattgatcagatgatatgagaaaccctttttatttgacaatataaatttttaacgagacaagctagcaaggattgaactatgtcctcaatgtatgtgcatagtagagagttagaggccctatcacacccagccacgtaactgtttgattgtttgacatttactccagattccagaacatgataaaaattagatttaaacatcagttgaccttcataaattctgtggcagtaatacttaagaggaacaggtatagctcaaaggcaagaatgccataccatcaaagagcaattggcaggaaggccagcaagatttaaagaagattaagtcactataaaatccttggagaggtactactactgcgaagcccaaaactagagctgaaagttaaggccaaaccaataagcactctcccatatcagtcataaggcttcacaagtgaaatgtgagccttcaagcaactgcctccatgtttgggatacaaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctttgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggttcgcgccgggatttggcgttggcggcgtctcgtcgaatgaaccacccgccatggggatggagggttcgatggaaaatgcttgtacaccggaggtgagagatcacttcacggtgcagttgtaaagagcgtgtggtttccattttaaaatctcgtgtttaatttttgacatgtttatcaattcattttacaaaaaaaagtttagaggggtatctctcccttcaaatctcgtttttatacaatggatgtgtagtagagaggagagatcagccacacgagcatacataattttgcaaaattcctttagcatgtgtgctgggtagaatcggtacaatttgggtagatagaatttgtctttaaaactagggctcgaataaatgtctaagtttatttagggcacatacatagttaaaagaaatatatgcgatgtggcataagattggctagagatctccaacaccatcatatatgttacaagaaagcttggtacggttcgaccgggtagtatatcaaatgttacatactaaaccgagttttgtcctaaagaaaatgataattataacggatgagtaatgagttagagctcctccacagtagacgaagatgggaaataacatgaggaatttggttaagacagtactccctccatcccataatataagggattttgatattttgtgtgcactgttcaaccactcgtcttatttaaaaaaaattgtgcaaatataaaaacgaaaagttatacttaaaatactttggataataaagtaagtcacaaataaaataaataataattctaaatttttttaaataagacgaatggtcaaacagtacaggcaaaaagttaaaatccttatattagggacggagggagtacaatgttgtaggaatcttctttttctctacgtattaaagcttgttagttaggttttatcaacaactcaaacaataccttataaatagtttacttatgaaatttagacctaagagatcaatatcatctgctcaattgagatcccctgcagagcatgtgcggtacttcaggctgacatgtgggcccgagggctgtgggcccacatgtcagcctgcagtactgcagacgacttgtgtccatcatctgctctatactctatgctatttaaacaaaatatgtagagctaggtaacaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatcttacaagcgttggttaagaaaaagacaaggagaaagtacatatgctgacatgtgagtctctttccatgtgtcagtggctcaattacacaacagttaagtcagatgatcccttttcattggagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagccttccccacccacgccggcgtcgtccccttccccgtccccgtccccagcttagctggcgtcgtccccgtccacagccacgccatcgagccgtgctgtgtatatgcaacggagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattctggcgaaaccccatcctgacgatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgcccaaggagatgatcatgaaggaggagcaggcnnnnnnnnnnnnnnnnnnnnnnnnnnnnnnnnnnnnnnn

SEQ ID NO: 30632 - DNA, 758 bp, Oryza sativa
atttcataactcgcctggaaaccgcgagacgaatcttctgagcctaattaatctgtcattagcacatgtgggttactgtagcatcattcgtagtattttgaatatctatttaactattcgtcttattaaaaaatacgtaattcatatttattttgttctaagttgttttatcactaaaatagtactttaagcatcttatgcaattgcataatttttttaataaaacaaatgatcaatatgtgtctaaaagtcaatgacatcatctattaaaaaaccagagatagttaataactacttagtagataatttgtatgtatagaacccgataatattaacttctgttgtgtgtggttggccatctctgcaggtacaaggacgagaaggacgtggaggacatcatcgtcaccaactgcacgataaagggcaccacgaacggcctccggatcaagtcgtacgaggactccaagtcgcagctgagggcgaccaagttcctgtacgacggcatcaccatggacaacgtgagctacccgatcatcatcgaccagaagtactgccccaacaacatctgctccgcgtccggcacgtccaaggtcgccgtcaccgacatcgtcttcaagaacatcgtcggcacgtcggcgacgcccgaggccgtcacgctcaactgcgccaacaacctgccgtgccagggcatccagctgcacaacgtggaacttaagtacgcctgccaaggaacaccaccctttcgtttgcaagaacgt

SEQ ID NO: 30633 - DNA, 667 bp, Oryza sativa
  unsure (1)..(667): unsure at all n locations
nnnnnnnnnnnnnnnnnnnnnnnnnnnnnnnnnnnncttgtttagattattgcaatatctttacttttaatggctaatgcgctttggggaagaaaagctagaaagtagattcctggtaatcaaccacaagaaactgttttgttcaaactcaagccatcctattagtaattttgtttcttttgaaccatataatttgaacttttcaaatcttgctagttgatcctttcatgtacgtcttttctatagtgcagtagcacagtaatgtgacacagctttcactttgcagagaatggaagaagcagattccaagcggtcatcaagaaaccctacccctgttctgtctatccttgcaaaggacattggtgacctagcaattaaggagaaaaatttgtacagcccaattttaaagacatggcatccccttgcttcaggcgttgctgttgccacccttcattcttgctttggaaatgagctgaaacagttcatagctggacttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30634 - DNA, 2563 bp, Oryza sativa
gcttgttaatatggtatgatgtttgacacttgagtttctgagaactgtctgatatagatgcgtatttatgtaatgacagagttaacttatgctatgaaataaaatagtggatgctaatttttgtaacctacccttttggaaacaagagaatacgcaaggttagttttcagagaccgtaggaagccccaatcagttctgaagcagggagtgtccacctccttaataggatttgacattggtctgttactacttggtacttctaacagagacaaaatggcctactcctaatggttcttacattgtacagagctcatgaaacacatctgacatttaattcactaaagacgatgattcattggtgttgctgtatgatgcttgtgctgtcatactttggctctcacttgggttttgccaaggctgaggtctgacaaaaatggttgcagtggtgtatgcccctcaagcaggctcactactttggacatctttggtctcggtgctggtgctgcattggttcagaagagggcaacattcatcatgaggtgcacaagtctggatctaccagctctaggagatttccttactcatgtacaacacaagcctgcaacacatctgggagagaacatcatactgctactaaggtatgttccatgtgaacataccagaatttccatccttcctgtgaaatattttagtcaagaattgaggttgacagggtatctgctttggagttgtttagccttcctgtgaatttccatccaattccaaagcagtagtaattactcagctcctcctctttgtttttgtaataggcaaaatgcttgcgtatcattgtatcaaggaagaagtagaaaaatgcaagcgcatacaagagggagggagtgtcagcctccacgagctgacaacttccaggaaaagagaaggcttagaagaaaacaaccaggattacacaccggaaggatgacctgaaaagctaaacaccagagtttaacctcctcggaaacttgagaacttctgcccaggttcttaactgctggttgaagacgtgattgttccattcggattcccattccttccagatcatccaggcgaccaagattatcaaagtgttaagatactcagctcctcctggtccgattgtttgtgctgtgctaggatcctctcgatctttggcaggggatcttctcttggctagcttcttcaaacctctgacattccaccacttaaggtactgatccattcctctcttactaataacctaaaaaaattatttttttttcattttgtcggcagtcaagtttttctttgcttagttcttttatagggaaaatcttttaattgtgtttatttaattttccacttgatctaataataagcagttttgctataatcgtatcgacatattttctagtcaatcagtctattttctaatcgtcaacactgagtagtagttataatagtagttttctcctgaagagctcttgcgtgtagcagtgtgcaactgcaactctgcaaccaaacagtcaattgaattttttcatcttgcatcacggccctcacttttcctattgaacaaatggagagaacttgtgcctgtactgctgcatatctgtatgctgcctctagtactagtttatactttactgattactttgagtaagattatatggtaattacaccataattatgctgtaactttggtgtaaattttatagatgtcgactgtaataaatttaaatttgtttgagacacattcatatgaattcccataaaatttaaattattaatattacagattccaaagcatactgttcatgcaaaaattaagtttctcaagaaatatcactaatttgagtagcatttgtgctaaacattgtagttagagaaatttgactcttttgtatagttggaattatatcgcatcatgtatagatgcatccacaatgaaaatcttgatactgattttaacataccattatttcctcttaccagttccatgcctcattacagcgtaatctccccgattgtctctctttgtgaacatgttgtggaagccaatcaggaagcacatttactactgcctcaatcctgaaagtaatgttcataatcttatgatcgctgctgatgatctgagggacaccattgatactatcgaggagagaattctggtgggtgaatgtgagggaaagaaaccaaaggcacaggcaacaagctggatacgtagtgctcaatcagttaaagatgaatcagacaagataaaaaatggctatgaggcaaggagaatacatgcgttgggttgttcctggaactttttcttcaactacagtgtaagcaattctgccaccaaaatgcatgctaatgctgatgagatcaagaagagagctcctgagaatgatggtatgttcagctccctgcctctggttggcagagatatgcctctgccaccctacattgtggggcaagatgagtacaaggataagattgttggttccattaagcagggcaccacaggcaccattgggatatgtggcatggcagggtctggcaaaactactctcctcaaaca

SEQ ID NO: 30635 - DNA, 16140 bp, Oryza sativa
  unsure (1)..(16140): unsure at all n locations
tcttgcacaacaaaaatgtcacattccctaattcgtgctataggcctcacgtgtgaactctcagcatgagacagcccagtcagatatgcatgttaactagttcgggtcctttggagtcgcttgatctctcacaactctggatctgtagtgcattaatattgaaccacttccatctgatattggagcattactgaacttgcagcaccttgatctttcatacacaccaatccaatcactcccagtgaggttcagattattgaagaaactgaggtacctatatttaaggtatacacgcaaactccaaacagtcccagatggcaccatatcggcactaagtatgctgagggtgctggatatacacggcagtgtttttttcacaaaggtgaaagcacggtcatatcttgaggaactggagagcttgaccagtttgcagcttctcagggtcacagtggttgatttccagtcgctcaggaggatcttcaatttgtccagagtctccctgcgagacaggattgggacgcctccaagtttcgtcccaacttatcagcaaagcaagggcacaacatctagaagttctggctctgagctatatgaagagtttggagaagttgatgataggtggtgaaagtgaaaccagtgtggattattcagattggtgcttccaaaatctcgatgaattcagattgcatcacctcacaaaactgggaagcatcatgtggaaaggggtgatgccacatgcttgctttcctaaggttcgtacggtagatatcatcggctgccacagcatcaagacactcacttggatcaaccagcttccttgcctagaagaggtgtatttatacaactgcaactcactgttggaggtagtgagtgatgatgatgaggaagataccaccatgccatcggcaacagcttcatcatcatttcctcgcctcaggcacctcgggctaagtcatctcaaggatctttacaaaatatgtggtgatgggagacttggatttccatgcttgcagcggctgcttgtgtacgagtgccctatgctggcaagactgccattcgtgctatggaatggatctgctgtgtgcctctgattctcggtgaacaaaactggtggaacaacttaggttgggacgatgctggactgaaatctaattcagtccctttcttcagagaactacctccaggttttaaagggagtaacatggaagtttgggaggcaatgttccaagcgttgccttaatctcagcaaaggaaataataattggtcataaatctcaaagaagaagaaagctttggtcgcctgttgcatggtgttgagagtttcagttcttgaaagaaagaaaaaagcactacacacattttcctgtttataattggcagtgcgcatctcagttatgcctgtagtgttgaagtgttctcagaatctcagtacagtctttcgtgtagtgttgcttctctcttttgtgatgagtttattgtgcttgtgctagcatttttattaatacatgaccggactttgtcgtacctgtaaattgaaaaaccctatgggaattttttttttaccattctggagtcttagatgggtaagtagcaagggtttggtcattttgtgagaggggtggtgtcatgagagggatcgagcaacattgttgagtccgggcgactaatagtcaatcaaatttttttatgaaaattgatggttattgtctacgttaccctgatacggctgggaaggagcgtatccgtatcagatacgtaacaagatacggatacgtatcggatacgctccgatacgtatcctgtacgtatcctccatttttccgactttcaaaaaaataaaataattaggatacttttttgatacgcacatgatacgggataacaaccctagccgcctcccgtctttttgtgcacaacggcgccgtcgtcctcgacctctgcactgccgctgcgcaacaagggcatgatgccgctgcgcgctgtcgagcacggacgccaccggcgtgcgcctctaagcacggaatcgccaccgctgtcaagcgccgccgagaagggaatcgcgccgccgccgtcaagcgcagttgagaagggaatcgctgccgctgccaagcgcattcctgtggttgtgggcacagcaccatcgctgcacgggttggtggttcaactgttcaagtgaggtaggcgtgagtattgacagttgagttaaatcacttatttgatctgcaatgatttttttttgtccttattgttgttctcctttcttgttttcggaacaaacaactgccatattactatttcagagatccgatagattacgaaattggaaactcaagagtactagtgcatccaggatcttaatgttggcgataacatcatttctttttttattttggtagctgtagcccccgtaagtaagtgacttttagagatccagtaagtactggtatttttttttaaactaatccagtaagtactgggactgcagtacttgaaagctatgctcgatatatctgtgtattgcttccttcagttatctctgaattgttggcatgctcattattttgggcttaatcagttctgctattttctttcaggagttcattgatttttattatttatttatgatgtatatatagacgtatccccgtatccatgatttctaaaaatagccgtatcctggtatccccgtatcgcgtatccatatccgtatccacgtatccgggtaacataggttattgtagtggaggtggcagcggcccgggtggccgcttggcctgtttgcgagttggctctgctgttaattaaggctctgttctatttcttcaactcaaatttcaccttccttattttccgttagcatattttttaaactgttaaacggtggttttttctttaaaaaaaagtttctatataaaagttgttttaaaaaagtaaataaatccattttcaaacttataatagttaatacttaattaattatgtgctaataaagtttctcgttttgcgtgcaactaaaattatcgaacagggcctaagagtgattaaatggagctactaaacaatgccaaatactagttattattgttattgttttttggaatgtgcaaaagttccgtgcttctctgtattaagataggggaaacttcaacaatttacctaaaagaggtgttaaaaccaaaaaaacagaactatagaagaaagaagacgacagcactaggctacgcctcatggtgttaaaactacttctaatgcaagaaaccatctctacacaagaaccaataatgaaaataaggggataggtgtataaaagaagagagaagagacatgattggatgagaatttaatttaacgacaccatccattggatatatgatttctagacactacatagtgtccatatgatatggcaagtatagaaactactggatagtttctgggttggggatgactcttagagtgatttcgggtaggagactaaaaaataattgatggtttctccttgttggtcgcaaaaggcacaggatctagggtgtggtaatcccctcttgctcagtctatctatagtcacaatgtgcgaccaaccatgtaaagtagtatttgcatttgagcggtgcagagctcttctaggtcggtgcagctaggaaggattcccttcctaattaataagaggaaattgttggactgtcatgtagggatgaaaacggagcagatagtttctgtccgctcaaaacgaatacgaatacttttcggatcggataattctcagatagttcggatacggatacgaatacggatattttctcccggatatgaatacgaatatggtatcggggtttccgtcggataataatccgtaaacagtgctatttggatatccacataagccatgagacataccccatttatttataactctatgaccttgaatatacatttttagattttaatagtagttcatctcttaacattagtccacactattaatattatttaaatttttaaagatattcataaattatattatattttatataaaataagctaattatatatgttgatacttgtttctattagaagttgagttggttttcgtgttccgagaaaaaaatgtttccgtattcgtgttcgatcatattcgattcttattcgtattcgagataatccgtatttgtttccgcattcgagctatccgtattcgattccgtcaggcacacaagcttacacgtatatatgcatcccaaccccaaagctataccaaatagaacaaagaacactcatctcccttacatactcagcgagccataccatataccaaatagaacaagattattgacccatttttatttctcggagcaagattgatcgacggcacatggatctatctcgtaactaagctctccgctgagcgacatttaactatttgccacttttaagattagatatatagctaggtctcgctaccggtttgtccggtggcggtagtggttttctcattgcttggagccggagtgatcgggattccgaccttgtcacgcccctgcaggggcttgcgcttggcgacggtcaccagcagcgtcccgaaggtgagctcggcctcgaccttggccgtgtcgtacggcttgttcggcagcagcaggcgcacgtcgagggagttcgccggcgtcgacgtctcgtcgccggcgccgccgtagctgacgaggagcaccgtgtcgtgctcgatccgaaccttgagcttctccctgtctatctccccgacgtggaaccacagcttcacgtagtcgtcgtcctccgtgatcctccacctgttgcctgacgtcggtgggaacttggggtgcaccagggcttatatcacatatgatatatatgtgccacatatcacatggcatatgaaatataaatgcttattagacttgcattgcatatacaacagggaagaaaataatagaactgagagaaattttatggtccttgagaaaaggatagaacaacatcggcggaaaccatgttgttccggccttcatactcaactaaatcaacaggaaggcctttgtcctttattaccttgtataatttagtcataaaaatatattttacactaaaaattattttggtatctcgaggtaccaagttctacactagaaaaatttggtacctcccagcacttaaaggatggtaagattaccctaaaactaaacttaaacttcacagatatcgtactactaaagatgaaccaaatcgagaaataaaattcgtatgaaattagaataaagttaggagctgaatataatgaaaactaaaacatattacagtacactatgctgtctataaacttaaaaaaattgtacttattttgaaatttataccagcaaatactataatatgctttcggaatatttacaacagagactcaccaaagggtgcgatgccaaagggatgcccagtatcagcagggcttttcggagaattattagcacgcaccaaaagacgcggagacttcctttggagggccaatgccgctgctggcttgcttgcggatcgcagggctgcaccaaagggagctttcagtaccgaaggcgccgtctggctcatcaggaggttgaaagatgtaaccatggacattgctgctcagtttatgtactaaatctgttagttttggtgtgctagctagctacttccaagggtagcttatatagagatcaggaggaggagatatatacattctttaactttgcttcgccctgcagaatgcttggaataactgatcaaagaagttgctaatgagcagcttagctagctttttctaaaggaacaaattaacaaagatgatgctaaacttgatgcaggaagtgttatcattctcacaaaagcaccagagaaatgtgggcacacaatgcatgtcttctctgttcaggtacaaggcttaacttattcctgaaatctaaaacgttaaaaaaaaagagagtacacttcacaccccttaacctaaaaatatttccacttttctttttgtcatatctcaggtgcttccgtgaaaacgaaaacaccctccgacaacaagtttagcatcatgttcccagcattgcacctttacaaaagctgcatggcaactatttatattcttgcaagcatatagttcaattgtatgagaaatcaatggccatagtctaatattgaagataacattaaataattaaactagaagataccccgagcattgctacaataattcttagctcaacgaaaattgaaatgtatgctgccaaatgaaatttatttatacagttattatataatgcatacagccacacataggaacatgtaaatcaaacagaggcagcaagatatataataagagttctaagttttatttttttatgttaaaaccatcttcagtgagaaccatggcttgaaggtgaggttgtaagagcttgaaactctgatagttattgtttgataacatcttccttctgcaatgtgcttgtacatgtaataactacttctgaattcagtccagaagaatccttgaggtttgcgattgcattttactgcaaatcatcattttcccagaatgtatcctaatttttggcctaatttttcttctgatgattgatttaacctctgataaaaagatagaccttggttctatttcatctcttcaacaagtttagtaataagcataacggccctattgtttcgatggagagaagaacctataattagcttttcggaaaatttccaaacgaacaatgtcaacaaaatcttcatatttgcagtaaatatgcaatcgcaaacctcaagaattcttctggaccgaattcagatcagtagaaaaggaaaacaccctccgacaaacctctattctccttgaggtttgcgattgcatatttacatgtaataactacttatgcacatgatgtagaaaaggaagaaacatgaagagattcctagaatgggaagcttatagcaatgcgaatggctaaacagagataaatcatcataattcattacaattgaactataaattgaagatccatatttagtacagtttgaattaaagcattatatgtaatcttgagctatactctcaccctttccatgtcatacaacgtacagtcatgaaaaaaaccacgaataaatttgtcaatacacagattatatcgttatatatcacttcatttaacaaacatacttaaactagatctacaaaaaaaaatgctggtaacatcctaacaattacattctatatttttttgatattttaataaactttatatcaacatcttcttttgtataaaaaatatatattcatcaaagatccttgagtttttttttgtggggatcaaagatcctcgagtttaatcaaattcttagcaataaatcagttaagctatacagtacagtatactaattagtttataaaggatattatatcaattctacatccatcccatgcctatgaattcaatcaaacatgtaagtgttccatatactaagtgaccaacatcaacaaaataaaaggatgccaccgaccattgaaaggacaataggtgacttgagggcaagtggcaacgagcttacggctaggtaatagcgtggtgtcaaaccttttcaagctgtctttgtctttaccctaagcacataggacacaagcgaggagataatgatggtagattgcacacattctctaaagcataatgaactcgataacggttgacaaatactgtattttgataagatgtcatttagcaacaattaattagacaatagacaatgacaaaagtaccttgcaatttttagtaatggtgtgacgacttggtattcgatgagcttcattttggtgccattgagaagaataatgtgatctgttttgaattggtaggaaacacccaattgggcaaaccaaaatatttattttaaataggaaaggtgtttcatttagtttggtgaattcaggagatgtaaatcatataaaactcattgattagaactaacacgacaaaatgtaatgtccataattagaactcatacgacacaatgcattttagtctaaaatacttgaaattttataaacaatcaacacacactttaaatttatatagtcattgtgttattttagatgaatttgttcttctatagtagtgaacacgtgaaaaaagaaattactcccaataacgtattgacattttatattagctagctgcgcagttgcatggatgatttgtaagggctacacatctcatctagtgagtcggtgactgaagagtaaagaattgtttttttggcacgaacaaaagcactaataatatatgtttatgaggtttctctaattctcttcgatggcgctgatgtcaacaatcctcgttccatcttccgtaggagccttcttcttgatggtcacctctaaccacactttgtcatcgaccttcttggaccgccactccaccttcttctcatcatagcccggtgtcatcaagaggcgcacatcgagaaggctcggctgttgcttcttctgctgctcacgatccctcagcgagatggtgagcacgtcgccatgatcgatcgcaacctcgatggcgttgttcaccttagattcgtcgccgccaacaatctccgtgaccgggaattgcagcgtgacgctgtctcccgcctccacgatcatctcctgtcctcccatgtttcttccggccttctccttctgcctttcgctttcgcgagcgggatgcaccagagctttcattgatcatcatgcacgcaagaccgagaaaacgttgtcaggaactcatcagaatgctgtttttaggatcatgtacatagagtacacattgagaaaaacaagtctgaagtttaatgattgtaactctggacatttcttcgagcatacaatcatatgaaatcactcaccatccggggaaaagtttatggcagcagagattggggcaaatcgatgtcgaggcagcccatacttgtcaggagcagtagagaaagggagaagagcagctggtgtcgttagtcgtcgttgtcgtcgtcgcatgctgggagaagagaagctaacggctgctgctgctgcctcaaggcagctgatgtagcaagagattgcagcagctggttgcatttctccaagagaagcatcaaatgtaatgatcgttatgtgtttgcaggtggtagcttgcatgagatgacattcttgtgcatatatataggggtataaaaaccaaattaaagcttgaggatttacctttgcttgccccggttggcttggcgaataaagaggctgtgaagctcagctagcttttgtgaagttggttgcaatagcaaatggattgtttaccaaatgatgactaatcgtaggaatctgatttctttttttctttaaccaaagcacgtccagcatgcatgatttgatgttatttgatttttcagcaattctaaacaatagaatctcctaaatattcaagtaatatgaaatatattaaccatatttttttataatttggagaaaaacatgattgtatttgaactctatttgctatcgtgttaaaaaattggaaacgtttgaccttttcagataaaatatttgaattgttctctaattatttttaaaataatatataaattgactaaaaaagggtctgatcaccacgatatataaatgggtaaccagtgacaccatgacgtggacaaggctatcgatggacataacgggtcgacagtggaagtcaggaatgtagctaatttcgcttcgcgtcaaatggtttggaacaaagcaccaaaatattgcgggcacacctaatttcctcgctgacatgaatggaccattggcaaatttgcatgcggataaaaaggagaaaagaaccactttttcagtgaccagccaccattgtccagaagctcattcctcttctcatcccctccagcttcttccttctccctgccccaatattgcaactccaaatccaccacacttggtaggtctttcccctgatgccacatgcttgcttccctagggttcatgtggtagatatcatcggttgccttaagggtctcttatcccattatgggtggcgtagttccattagaattgctggttgaatcttgtgaaatcaaaggtgttttttattattattctgtgatgaacaattggcattggagattattggttttgatatttgannnnnnnnnnnnnnnnnnnnnnnnnnnnnnnnnnngatttcacaggtgatctacatgtactactggatttgtggtccggtcagaccgggcatgtgctgccagtcagaccagcttgtattgcccggtcagaccggcgcagcccgcggtctgaccggccgacgctgtgtcggtttcggtttcgggttgtttatttggatatctgtgattgtttcatatttatggcttctagattgatactatgcatatgtaatactgttgtttgctactaatgagtcaagttggagatagcttggtctcgaaatatggtttctttgtttgtttcatgtgtaggtgactcgatgcctcgggagagtatatttgcggtgatggaccgggagtcgacttggtgggaaggagatgtccgtggtggtcagatatcatgcgtgatacttaggctagagttcaatgcacgtggttggtgaagattccatatggcggatacgatggaggtattgtgtgcgtatgggatacggagtcgaatttggaaggagtccaaatttggtatgattggttatgtaaagtttgtttcttatacgaaaaggtttcctagggggattaggacttctagtatgagtttggttcatgcctttaggctgcctacctcatgtataaatagagagggagcgtgaggcttcccggtatcgcttttgagagcaattgagttgatagtttacttagggtttcgagtttagtcgagatttttgtaaggagtgctgttgttgcactttgtaaacacagagagaatcaataaagtcatcatccactttaagagttcttcgatttgtgttttctcgggtgtggcggtccaaccgacgagacaccggcggtcagaccggcgggcacacggtggtcagaccggcggcggcgacaggtgctggcgattgacctcggcggttcgaccggtgttacaacctcggtcagaccgacgtgttctaggcggtcagaccggcacgtctacttcggtcagaccgcgatccatcgaatttgagggtaacttttaattccgataaaagttttggtttttgggtataccaaccattcacccctctctggttggcttagttcttgtgtttcgatcctacaaatctatgttgtttaacgctagttaataataaaagggagttgggggtttgtctcattacctatcgtccctttttatttgttgaacaaacttatggttgtgtgctttagggcagaagccggagaaaaaaatatcatcagctgccacagcatcatgatactcacatggatcgatcagcttcctgtcctagaagaggtgtacttatacaaccgcaaccaatggtgaatccagaacaaaaattaccatgggtcatatacatatcatagcgtatataaaacgctaatttttaactattagagcctgtttgaatcataggaaggaaaaaaacaaagaaataggaaaacacatgattctgacatgaatataagtgttaacaagaggattgcaaaacacaagaatgattgtttgattggaccgtaggaaaaatacaggaatcggatgagagagatagagtcaaaggaaattttccaagagattggagctcttgctaagtttcctccaaaatccacatgcaatgagtcattacataagatttggaaaccttcaatcgtttgaatcaaagagccaaataggaaaatttcctataggatttgaatcctataaaattcctacataaattctttgattcaaaggggcccttaatgtagttaatataggctaaaataactaaatattgaaattctacttaattaaggtcctaggttaacataggtcactgccactgactgcaattcacttttggaggtagtgagtgatgatgaagaataaaaggtgtattgttgcccctctctctatgatgagtttgttgtactcgtgccatcatttttaagaatagttaatattgcaagacgatgtcccttgctagatcatatgcctttgatgttttatgagaggcgaattttatagctgtaatcaagcaagcactcactggtggggttatatcatgcatgatctgtcagcatggagatcgtttgtcactcaaagaaaacatcagatgttgtgtcacggtcatgggacacctgcatcaagaacacgatgaaccgaacggcttcttcctcctctggctctcttccttctctctgctattcctcctagctcaagctttcatttctctgatctcccggtcccctgctttccaccaccccaatctagcttctaatcccactctaaacccctgtttctcccaaattgtatccctgacactttgatatatggtgttggagacttggagttggatcatctcagttgtgcttgtgttgtcgggtggaaatcaagatgggtacgtaacaatatggtatgagagcaatcgatcccgggttttccggtgttaagatggtgtgggagagcaacttggtggtggtgtctttggaggagacgctgaccacctgttcggtgaaatgccggaggcgactcaggtgccacccttcgcgtctccgtgagccacattgtctacccagtgacttctgagatgctgcatctagtgtacaatacccatggagcagtttgatgctagttgtacgttcctagtccatccaataattggaaagccctggccatatataaaattcactatcctaaagatttaagcagagtgtccatcttaatagtaggatctgacactagtctggtatttacactgtacttctaaaagagacaaaatgacctactcctaatggttcttacatgtacagagctcatgaaacacttctgagttctgacatttaaactcacctaaggtctcaggctaccagcaatatctaaagatgatgactcattggtgttgctggatgatgcttgtgctgcagtcatgctttggctctgatcacttagtgtttgccagaagttcctgcgctgaccgcttgagctcaggctgtttgcagcaaggctgaggtctgacagaaatggttgaagtggtatgtgcccctcaagcaggctcaaaactttggtcatctttggtctcagtgttggtgctgcattggtgcacaggagggcaacattcagcatgaggagcgcctcttccgttgagtaatcggagcctaactctggatctaccagctccaggagatttcctcgctcatgtagaacacaagcctgcaactcatttaggagagaatacttttgaggtatgtacaatgtgaatgtagcatgaattgggaaatttaagaatttcggtttgatgaaaatactgtttgctttaacaactttctaattaaaatgcttgttgtgttatctttgaaataaacaatatgttggacaaaattaaaccagtaatggatgctgtttgtttcaaattagaaaaaaaatgccatcacattgataactaaagatctattcctttggttagattgttacataagtcaggtataatattagcggagtttggatggaattcatcaatgtccagaagaagtttaagagacaaaatgccggctaagattgagctaaattttagtgttcataataaggttcctataaatgtgcttccatggtcatgcacagaacattattgcgttaattggaaattgaccaatgtgccagtaactggtaactggttattctaagcatggtttaggaattacccaatcgagaagataaacaaaatcttcctttggcctgtagcttgtgttactttttccactaacaatttccaaagcaacaaccccaaaactgtaaacatcagctttgtctgtcaaataaccacgcattgcatactcaggagccatgtatccgctgcaggaagaataacaacaaaatgattgagtcaaatatctgctctgtagttgaatggaattatttggaaggggcatggagagaagaagtaatctccatcaatagttgttcatatggaaattgatttcagtagtaagaacattaattcctttgaattgttagtctacatatggtggcatctatttgttactgtttttgtgcaactacgtgccttgtaggatcctacattttatttcggttttttactatattagctaccctcagagtttccataaaccatacataaaggtcgcaatgttcatttttatctaagttctaactgtcatgtcatttaaagacttcctattgtagatcaatgagacttgggacacgatcgaaattaaatttggggggaaagggggtatggaaatcaaaaagaaaacttacatagtcccagctattcttgtacttatgtgtgtgtgatcatcatcgttaagctttgctagcccaaaatcggagatcttggcactcaagtctttgtcaagcagtatattgctagccttgatatctctgtgcacaatccttattgcagactcctcatgtagatatgctaaaccccttgctattcccaggcaaatcttacgtctcgtcggccaatccaagctcagcctgtattgttcgactgtacctaatcacagaaattgcacatgagttctaacatgaaataagttaagaggggaaaccaggaaattagaaagtaagattaccgaaaagagcacgcgctaggcagttgtttcccatgtattcataaacaagcaagagctggtttccttctgtacaacagccataaagcttgacaaggtttgggtgctggagtgcagatatcatgcctatctcattcacaaattctcgattcccttgtttagaccttgatgatagctgtttgacagcaataatggtgccatcagacaacagaccatgccagcagctcaaggatccatcataagaattgtgtacatttttagataatggatattcattaatccggaagaattgtgtacattgccttatcagactgccgagtttaagcatggagtcagtgatgatggctgaccttgtaaactgaaccaaaaccaccttcgccgatcttgttggccgcatcaaaattccttgttgccactttgatttgtctcaaggtaaaggatccagtttggaggtcaaaggctctgagatctaaagagaaagagacagggatgatttatctgttcccacataaatatataaatggtttgcaatgctagcctaactactttaactggcaattgtttgagaaatcaaagcatcctaggatgggttcgtctggtatagtgtaatctcttttttttttagataatggattttcattaatccggcctctatatccaccaaggatatacacagccaaaaggatacacgagcacttagactcacacctcaacaaggagaagaacacacaaccaaaaaagaaaagaaaatcaaacgacctcgacacatgcaatttagattgttggatctattgctagtattgctgaactgttggaacaagaaagatactccaatatgtggaagatagatgccactatgtcattcatgcaaattgaaataaattgagcaatcaagctctcatgtcacctttatgcattgagttctttctcctccatttaatccaataaatgccgacaaaaagtgctgcgcacattgctaaaattggcatggcaaccaggaatgctttagatatccttgaaagctttttgctacctccaatttgcggtggttcaacagccaaaggaacttcaaagtctgaataagcataatccaaaaccacaaggtcagtaaagaatataacatttttctttgaaaatcattatacaatcagtcagagttttgaagggcactgaatgtgttgttcaacgctgtaccattgctcatagtgattaatgaaacatgtcattcaaattcaatagattcaaatgtcaaaatgccatacttggtactactgatattgcagatatcagaggaccataatatcctctttttggaatgcctgttgtcccccttcctgcccaataaaaatgaatttccagtgtatgatttgtgacgtt

SEQ ID NO: 30636 - DNA, 343 bp, Oryza sativa
catataaaataccccaactgcctcgcttccccttcccctctggcttctaccagtactcttgcacgcacggccctaaccccgcctctgtaaattctttctctctctctcgcggcgcgtccgcctctagatttggcgacctccgccaccgccgccagatcggagcgcggcctcgccaccgccaggtgagcccggtgatccgatcctccccctcgtgttctcgttgttttttcccctcagattaagccgatccgtgtgtgcccgatctaccgcgccacgggagaatgggggcggggcggggtgttgcggtggcgcgatctggagtgtgtgtgttttttctttcagt

SEQ ID NO: 30637 - DNA, 1076 bp, Oryza sativa
ccactcaatatgtactgcgacaatgagccaacaatgtttatgctcacaacaataagtcgagtggtgctgccaaacacattgacattaagttttatgttgtgaaagagaaaatccaggatcagaccattagtctgagcatataagaacaaaggaaatgttagcagatctgtatacaaaaggcttaccgcccagtgtgttcagagaacacttaaccagcatgggttttataggaaagcttatgatccttggattacaaaagggcctagtgtttatttctagatgaggaggtgcattgtagtcgttgcgtttgatggttcaatagtgactatcggatgaagcgtgctctatgcatcaatctattgagaagtaaatgttaagtaagagaagtaagaaaggcggagatcaaaggggagaatgttagttgcgatctccgggggaatcgggaaaccgatttcccactccgtctacgcgccctgatcgggggcgccagccgatctattggtagtgggcccctctcacgcagcacaatataaagagggggtgccgctgggcgcgcgaacaaaacattcgctgcatacacggactccccacaaaccctagactcctaccaatctgggacgcgctgaagtgaggggaaatgccctcgttctcgctgccgctaccgccgtcgcctacaccgacatcgccgaccccggggacatctacgccgcgccgacaccgtcggcatgtccgagtctacctctaagggtgaaggtatgtgtcccacatctctctctctctctgtttactcccacaagcaatcaactataccgctatgagcttagacatcaacccctatgatgtgcacctagtgatcctacgatcctaacaatagcaacttcagctactcccttatctcaacaaatcacaactatcttccatttaatttcttttcacctacttccccatctcaacaaatgaaaaccatctcccatttaatttcacctactttcttaatcacagtgcaaaactccagaaatacttatattttgggatataggggatattcaacatggttcagacagaaaaggcccaca

SEQ ID NO: 30638 - DNA, 1238 bp, Oryza sativa
tgagtgtaggagttctctaccctgcttttcttgcttgcacaactagttattatgatatgaattttgcggtactcatgcctctcatgatcattttgcaatattcttacaggtcttgaattatctggatgataggtgcagagttcacaaggaaacaatcaatctctgcaaaagcgtactgcagcgtaaatccattgactggatttcagtgcagcgaaatgatatgtctaatccaatacatgatgtggatcttgtgatttctgttggtggtgatggcactcttctacgggctagccattttttgaatagctcaattcccgttttaggtgttaattcagaccctacttgtcctgatgaggttagttcttcagattattgtcaagaaccatatgatccatgtttgtcaagttgcttttggcatgcttccaagcagactgatgcttacctgtatgcttggttaggtttatatatagattattcctttgcaggttgatgaattaactgatgaatttgatgcaaggagaagcacaggacatctttgtgcagctacggctgcaaactttgagcaggtaactttccattgcaattttttttggagcaatccaattcttctattacaggaactcgtactaatctaaacattaattaatgatacattgaacatgacgattcccagatacttgatgcaacccttgatggtagtaggcaaccttcagagttgtcaaggatctcagtgaaactaaatggacttcagctaccaacttatgctctgaatgatatattggtctcacacccctgtccagcaagtgtatcacgattctcatttaggtattgccttcaattctttgcgttaattttttaatttttttaatcaattctgatgttattgccatctcaggaagagaagcaacactggagagagctcgcatttaattaattgcaggtcaagtggtctcagggttgcaacgcctgctggatcaactgctgctatgctatcggcaggaggattcgtgatgccaatatcaagccatgagcttcagtatatgataagggagcccatttctccaagggatgctgacaagccactgctgcatgggttagttaagcaaggtcaacacatacttgtcgtttggtacaatgaggaaggcgctgtttattttgatggttcacatgtaatgcattcaattcagcatggagatacactggagatctcctgggtaccgagctcgaattcgccctat

SEQ ID NO: 30639 - DNA, 675 bp, Oryza sativa
tggtgaaagtcggcataccgcaaggtggtcggcaatttggccctcaaaacaggcagatgatagtaataacatcacgtttgcaccaagtttggtatggtatggacgggcattgccagatgattgtgttgcaaaggttgaagtttaatgaagcatggagtctctttgaatcaaatgcgggtattagaataacctataacgtgcaagtcaagtgtcatgccgagagcatagtgaacaagtgtggaggccttccgcttgctcttaagattgttggtcaggctatggcatcaaaaggaactgaacatgaatgggaactagctgtgaatttgcttgaacaatcacaattccacaaggtcccggatgtagaaaatgatctatattctgtactgtacattagttatgacaacctgccagatgagaggacaaagcaatgctttcttttctttgccttcgccagctatggaactgtatgcacagagtcctacacgaagtttttggatgggccatggattactagatgaagatgatgatattggaaacagcaatttgagaggttactcagtcgttccttgtttaaaaagagcttgtctattagaaggacatcctctaggggagaagtatttgaggatgcatgactgcatccaagatctggccctttggattacagcaacaaaaagg

SEQ ID NO: 30640 - DNA, 13386 bp, Oryza sativa
tttaccccgccggagcagtgagaacatggggggaggcaccccacccggtactcgaaacggagagagagagagagagagagagagctgtgaccttgggattggatacacgcagcggcggcggcgggggcggaggcgaggaggcggcggcggcgagcgggcggggagggtagacgtcgaagggcttgacgaagaggagcacgcggcggagcgccattggagcccctcgtctcggcttccctgccttcttgtacccgcggttcgtcgcgttggcggcggcggcggcggcggcggcgccccccggcgtggcgtctgcgccgtcgggttgtgcggtctgtttctgacgacgacgaaatacgccttcgaatcaggaacacgtaaagcagatacggctaagatttgttttatcagaaaagcccctgcggtactaatttatcacacatggtgacgatgttagaccttcacagtgcatcgcccgtggcgttctgccccgaccggccacgttggagattccatgccacggatgcatctggtgcatccaacctgaagcccgcgtagccaaagttgggcacgcgttcttcatcagttttggtaggcatatgtcagagcgaggcgagaaacggggcgcacggcgcgttgggacagggcgtgaccccgtgcttcacccccaaaacaaagctggccggatttggcgacatcaacggcgtggcgtcggctgcctagggagaaaggaagatggcggtggtggtagaagaggagacggcggcggatctggctcctaatctcgttgttatccctgttccgcgccgtcaaccgtgtcgtcgtcctccgctccaaagccgcctcagtcagtccgaagcagcagcttgacggcggcctcctgagtccactccaccgccggtcactgcccacatgcaccgccagatccacattgtccgctccacgccggcgagcttcgcgcaaccccggcgaggcccagggcgaagcggcgacggagcaccggcctcggcttgctcctcactgccgccacctcgaggcctccgtcaccgaggccaccgtgcccgccatgggagagggagagagaaaggggaaagaaggagcgccaccactgaggccaccgtgcgccgccgccgccaccgtgtcttcttgcaaaccgcgccaccggtggaaggagaggaaggggcgggggagttgaggcgcatgggagcctactagtgaaggagagggagagaaaggggaagaatgagcggtggtggaagaggtttcggggtggagatgatgagattggaattttttgtggtggggcccgcatgagaaaaagtttggtggggtccacctaaagtcacgccgcagtgtggaggagtttcgcactgttctttcataaatagctgtttgggctcccgtgaaacgtgcggcgcattggggtatgagactctctcgtacccaaaacacatgttcatttctgcacaatggaatagcggcaaggtttccgagcctctaaagtctaaacggcgtggctttcagaaaaaaactttctatacataatttatttaataataggaaaaggtacgaattactcccctaaactatctgaatttcccccttccttccttccttcccccccccaacgaaccacgaaaccggacatcgtttaccctgaactttcaataccagacaaattaccccctctcgacccaatccagagcggttttgtcctacatggcatacacgtggcaatccagtcagcattttctttttttatagtggggccggcccacttgtcatatactctctctcgggccattgggcgtaagtcgagcggcggcgggcggtcggcgcgcacggtgccgcgtgggagctagtggtgggcggtggcgacgggacatggagcgaggggtggcggccaccacggcgggatgtgagcgaggtggcagcaaagacggcgggacgtgagcgaggcggcaggacgtggagcgaggcaacggcgccggcgagacgtggaccgaggcggcgttgacgggatgtggaacaaagcggcggtggcgacggcagcaggatcctccttccccaccatcgcggcggtgcggagctcggacacgccgacactgcggcggccgctcccttccccttccctgcgcagagccatcggcccccttccccttccccatctgccccgtcagccactcgagctaccacttttcatctggcagctgcccgagcgaccttcgtctctgccgccgcccgccggcacccaagcaagctccaccgtctcccaaccccgtctcttgtgcagggcagcggggcctcgaagacagcgagggggaagaaggatcccgctacccgtgcgcccgcaggacctcgtgcgccgcttccactgctgttgccacagcctcgtcccgccctgacgagagcgacaggggaggcgaagctcgcttgggcggcaaatggcgccgcgccgccaccgtcgtcccaccgctgtttcgccgtcggtcggagccacgctcactgccgctcaccacccaccacagagagaagaaagaggatagagtgatttaatatgacatgtgggccctatattttttaatttttctggctgattggattttcacgtcaacgccacgtgtataccacgtaggattaaaaccactttattcgtttgtaccttcaaatatttatatcaccaatcgtttatacttcctccgtttcatgatataagttattctaacattttccacattcatattgatgttagtgaatttagatagatatatatatgtctagattcgttagtattattatgaatgtgggaaatgctagaatgactttacattgtgaaatggagggagtatctatttagtattgagcctgttcggctggttgggttgtgggtgtggggtagtatttcactcacaaaatcagcagcagtgtgccgctgtagcctggctaccaaacaagcccattctgtttttactcagcacaaaacaacacatccacgttcgcaagcgtgatattcaatcaagtcatcgtcttctagatgatagtaataaatctgagttgaatttgacgcaacgatactgtatagctattcattaaagcaatgctaataatacaactgacttattggctatgagaattttttagcctttttttagcccacacatataatatttagctacttacaattaatactcacaaaatttcttggttcttgtgtccaagttgaccgtaagtttacagcccgcttctcctctctctcctctcttctatcctccacctcaacatttaaccgacttacaccctcctgttatacttgctcttagagttatagccaattgttggctctaaatcatctatagtcaacttaatagccaattcatataatagttacatataaacatatactacacaatcaatatctggtcccacctgttatacacatatgtgtcttagagtccatgctgcagctggctattaatctgtagtccgctactcttatatctcatcttttatctccttaaaatatgtttatatctggcttacagtctgctattgtgcctgctcttatctagcagttacatgctaacattaatgtatgtgtgatttcctttctgtgataatgttaacgaccaaatttgttgcactagagtagcagatctctcaggccagtgcgtgtttttcgcgtcaagagataccaggtgaaaccccactcgttgctgcgggagttcagtatgataacaataaataaaaataatatgtagcatagctaaacaatataaacttacataagcactggaaacaattgatgtaatatgacttaattagagaagagagaaataacattaaccaagtgatgatgaactacataggtacataagatattataagaaaataatgaagatatatattgaaatattatatgaattttgtgggatgatgatttaacatgctttcattttaaaagctctaaaatataataaattttaaattatagataatataacgtatttgcatgatattaaatgtattgattgttagtggatgatgatgtgtcaacttgttagtggatgataatgtggcatctttgcatgttaagctttaagagttagtgggttataactttatagtactattgggatgatgatttaacatgctttcattttaaaatatctaaaatataataaattttaaattatagataatatagcatgtttgcatgatattaaatgtattgattgttagtggatgatgatgtaacatctttgtatgttagtgtgttataactttactgtaagataggatttcagaagtatgatctaccgttttgaggttatctagtaaacctatttataaaaggaaaacaatgatatttttttcattattatgagtaagcatgctatgtaatagtgctactgtggatcactttggaaagcggtaagaattgaggtgttattgaattcaatgcaactaggataattaattattcccaacataactgaaatcaacaattttgccttcctttcaattaaaactaggaaggtagcccatgtgaatacgcgggcatgcgtcgtacactaagtttgagacacttgtaacacttgtaagagcgaaatattaaccgaagaacatctatcacgatttctccgtaaattgctttagtcggcattaattgtttttataatttttaacctattagctttatattgtatcatatttaagtaatactatctataaacaattatttataatctttttcatcatttgaaaagaaggtagacttattttctttagaaaacatgtcaacgaaaagtaagtgtaaagtaaaagtaaggcatttttttaattgcatatatattatcatggtttattcgagaatgaattgggtgggacatgaacctccactaaatgtatgggtttatatagcctaatatgatagatgtagtttgacagccagtccatctatgaacatttcatgtagagtgggtcagaggttccatgcaagctaacgtgaatacaataacgacaaaatataattgcgcaatagtacttttaaaatgtgatgtaccatgaatacacgctttcttttcttatataagatagatataacggttagaaataatagttccactggtttaaaagtcataggagtattccagaaatgtagcttaaatattatggttgttttaatatctaacattattacgaagtaaatgtagctcaactagttaggttctttgtggtggaacatgcccactcgggtgcaagtcctagacttgataaattctttcaatggtaggtgacgtacccgtcaactgtgaggtgcgtggcgactttgtcaatatcaaaatatgtcagtctaatctctcagaagtactcataggggtatatgcatgtgtgtggtggaacttgaccactcgggtacaagtcttagacttgacaaattctttcaatgataggcgacgtaacagtcgacaacgaggtgcgtggcaacttcgtaaatgtcaaaatatgtctacctaatctctcagaagtactcataggggtatatgcatgtatgcattaatagggggtgagtgtgtgcgtgctgtgagtttttgcgtttgtacttaggttctaaaaaatatcaaacattatttattgtttctcttttaatttaagagataaaacaatagggagtggacgacaatattgtgtacatgggagggtgaggaggtggtgaagattttatttttctatttttctaaatgatttaagtgaaagccggtgacagggtgtttcattttttctaagaatttctatggtttttcctgtttttttataggaggtgacacatggcaacttaagattttttttaaaaaaaaatagatctaatagttaaaaataataaatacgtcaatttaattactatttattacaattttatgacatattatacggtgatttatgagcgctctagagcgtgtttaatttatttttgttacgtacaatgaatgatttagtataacataataaatgatttagtataacataatacatatgtacaattaattttccgttgttatttagttgccatgttaacttctatgtagtaaaatatagttaatgtgatcttgatttatttatttataaataaataaaactataaatatttataaaaaacatacttttttttatacccggaaggtatggaataaaagtacaaagccgccggcaagtatatctatgtaccatatactaaaagatcattaaatattgtctaataaagtcattcaaatgttaccatagaatatattctagagcacttacgtagaagatcgtttggcactcttggattggattgtttggcactcttggattggattgtttcctttaactggcataactgcatttttcgatcaatcacaaataaagatataaaattataattgttgtggtagctagagtcaaaagctgaccttaaccaaatatgtcattttggatatgtattgggagtgaaaacataaagtaaacatcgattgtgccaatatagagcccgaggggcattgtatgtatgtacatacgtacaccatcgcccaacatccacccacctccgcctcattcatcccctctcccaatgtactgtctctcatgttttcatcatatattagtcaggaaccctaatttattataatgttttaaaataaatagctattttttatcgacttatgttgttggaccattattaactatattcgaacttcttaaataaatatgttattttttattacattctgactattttcatatcatttaaataattattagaaaatatgaaaaaaaaccaatgatatatactttacctgttgaaaatatttttggtgaattttctttacatctatgtaaaatgtaggatttattactattgaaataccaaccaaacagtttcgaaaaattccaaaatgatttgagaatgttaatatcacacaaattaaaatttaaattggatctacttaaaaaacacaactaaattacatggtttgcatttttacatagttcaaattaccgttgtatatttgttaagtaaaatttgataccataaagtatatagtttgatgcgggtttttttttgaaaaattgttatggagttaattaatacatgtcgatgtcatttgccgcaatgtattttaattacgtatttttattagtaagatgaataatcaaacatatgctcaaaagtcaatagcgaaaaagtaatataaaaatatttagggggtaccctaggtaaaaaaataaaagtggggtgaatgggaatagaaaaaagagtaaatttcacaaaactacacattttatggtccaagttaacaggatgccacgtcctcatcctaggtggaacaaccatgttatctcacaggtgaatccattcattgatagtgtggttttgtgaaactacactaccaaaatatatgtacttgagtgccaattgttaaagtgtgtgtggttttctgtaatttggtccacaaaacgtgcaaggagaggagaggaagggaggttttaatctaatctaatggtgcaaaataatggatccactagtttaaatgaaaattgagggctagatgtttcccgtctattaaaacgccacgtggcggtttaggagtgtttgtaggaagtttaacggactttagtatataataatagatagatttaactaaatttatttatatttgtgaagttataaattttattttttatattgtagaaatcatattttaaagaccattgatttttatggatgtatgttttttttgtctttttctatgacaaaatttctctcggtttagcgttaaccagcgatgaaccaatttgtgagaaggattgctacacgtgctgatgtgcatgcttgtttttcctcttaaacatgcatgtctttttcttccttcttataaagttttatctcaaattacttatccgatctataatccgattacaccattgtgttcgttacaattaaatcttcacaataagatcttacatgattatattacgatgaaaaaatatttatatttgtaaattacttttattatatgcataagttacttttatcatatatataagttacttttaagatttgactaagttaattcttagacatataaaagtaaattcaataaagtctaaaagtaatttacatatattataaaagtatcttaaaacaaaacggaaacatactattgcatttttcaagttgaaaggaaacactagatggagtacaaaacagctaccactagttgtgtagtcacgtccaatgaaaaaaagtcatgcattaaagttactttctttttgttataaatcacttctataatatatgtaaattacttttaagctttattgaatttacttttatatgtcgaagaagtaatttagtaaaatctaaaagtaatttacatatattataaaagtaatttataatttttcatcaaaatataatcatgtgagatcttcttataaagatttaattgttacgaacacaacggtgtaatcggatcgtagattggataaccagtttaatagaaaattttatttaaagtataggtagatagggtctctcatagatggggagtggtagctgatttagacaaaccagctatcactagctgtgtagtcacgtcatttttctatacatgtgcatttttttcttctacgaagaataggaaagctttatcattttgtttctagtcgcgtgggtttgtacgtacggaaagacaagaagtagtgcttgcatcgtgtagcgcttgtatgttataaacatgagaaaattattttttttaataataaatctaatctaatggtgtaaaataacggatccaccaatttaagtaaaaatcaacggtgagattatatagtgccatgtggcgacttaggagcatttgtaggggtacacgtggtggcttgagagcgtttgtaggaagtttaatagactttcagtatataatagatagatgggcatagtcttcaacttattacccaatgtgaacacctccaaacttatacaaacctgtgggctttggacatcaaaagatccaactatatccaccctgttagtgatctgtgttttctaatgcacttggatccgaagagacaaattaaacaccatgtgaacaacggacatacactatcccgctttaaatttgtttaactgcaacaattttacacgcggatgtgctctcttaattggatttcaatgagaatacgaatttgctgctagtctattacttcgagcgtatttatggatacgtaaagtttgttatctgtaattggaaaaaaaaaagcgtaggctagtgaaaaaaaatcatgttttaatgtaatccctccatcagtccactactggagaatgcatttattgggttagtcaaaatccacaatagtctcggcttgagcagtaaccgggagtaaagattcaaaagcccaagggtacttttggatctttagtccattggtaccaaccaggactaatgatcatttttagtcccggttcaaaaggttattagacgcgtgtcagttcctaaccatctttaatccctgttggtcaacattttaaaaaaattaaaaatagcgcatacttaactccttatgtttttttctctccctcagctttctccctctctccttatcttctgcctcaaccttctccatctctccttatcctttttctctcctcccctcttctcctgatccactcttccttgaccggggtggcggggggcggggggcggaaggcggcggccggcagcgctctcccctctcccggaggagaggcggcaagcagttgtgtcaggggaggcagcagcagcgagcgggaggcggcggccagcggccggtgtcgccctcccctctgccggaggggagccggcaggcggctgcgtcggggtgtgggaggcggaggtgtcgggggaggcgatggtggcgtgcggcggtaggcattgacgggcgggaggcagctgagttgccatcagcgtcgcgcccttgtcctcgccgggagggaggagcgccgggcccgggccagcgacagcgcggaggaacagagcggcgagcgcgaccggcaggagctctaaagaaagagatctctttctttttttgttattctcttctccgatgaacgcgtgtagttgtgaagaagtgtaactgtgaattagttttgaagaatatggatgattttgttgttattgttgttgtgaagtggtgtagctatgaattagttttgaagaacatggatgattttgttgttgaatttgttcattcgatctgtgatgatttgggtaatatgcaaatagcaaaaaaacaatgaaagaaaaagaaaaaaaaacctttagtcccgctaaagatggtggcgccactaacctagttatttcaaccatctttagtcccgagtttagggtcccgatttacaacccgggactaaagaaggttgcaaatcggaactaaagagggtttctccaccagtggtccatcctatatagagagagtccatttctagcctcttggtgggcagattagaggtaaagttaaaattcatgagaagatagcattataaattagtttgcggtggtggatactgaaaagataaacttcttaatttgtgagtcgagagagcatgtagaaaattattaagaagtatttttatttataaagcataatgtagaaattaatttattttataaagttttactgttataaattgaccaaatccattcttaaataattaagatcatctgcttctgaaaaagacatgaaataattagataacccccctctttctctctccatttgctgagaagctgtggacccccgtttttataataggaatcaatcgtgtaaacaataccatttccctggatcaagtagtctggtacacacgaattcatagctgaaataccaagtgcacatacacgagtgtctagtacgaattattacatcataagcccgcatgcatagtcttaaatcatcggaccgagcggtccggaatacattccaaaaatagaagtaggtaaggcagtggagttaaggcagcggcacgccattgccacaggcaacgaccgtaattaagacctactgagcgccatcgtcttcatcaccctcctggtaataggcatagggatcctccgaagcttcatctccggcctcttattaagtttgtatattgcaagggtgagtaccaaccatacttagcaagccaccatagcaataatgcatatcataggggtattcaaaggatggatacggttcttttgcgcaaagcaagttttgtaattcttttcacaagcctaagacctagcacagactgatcaaattttagtaccagtgttcatattaaacaatgacggttctgtccaccatccattgtgatcccaaggatagcttcccgccattgagtcgtcatggttttctgaggacgtccaccttcctgcctctcaagaagtggctccatcagtatagaaatcatcatgcaatatcccatcccacacaagttaagaatttagagtctagccaagtgtaatacatgtcccggtgctcaataaccgcgagcacggctattcgaatagatttggtttactcacactgcaggggatgtacactttacccacactccgcgactgcccaacacatgagcctcgtcccaacacatgagacgcgtcacggcaaagcttttcgataacctcgcattggcagtacccgctccatgaactttacatcctcatgcactctaggcgtacacggtttctagcagtgagaggagttctggcgcacccgggaaggaaagactcacacatgcattaagttataactaggtttaaattctcacatggcagtcctaccgatggcgacaccactgtagacacccgcctcgcggttctaccaatggctgccccaccgtagagcccctgtctcacacatcaagaaaccactatgcatggatactgcctccgctcagctatctattccgctaggtctatacccatacgagaagtgcggttgtacgagggtcatttcatgcttaacttcatggctcggtccttaattgaccggggacggtactagccttttccggataccacccaaatcctccgtccgccccagtcaaaaacagttgtttaattttatttctcctttcacaaattatgtcatcaacatcatggcaatgtggcgctcatgtctccacatgccgcatctcaattaccttcccaaaggtaattgcccaagcatatagcatttgataaatatgagtatgcatgattctagagtggcatctctaagcatttgtcatagttgactagggactcatacgtaatcatggttacaagggaataagggtaaacaataatcaaggtatggcatattcacaaataggatgttcatcattgcatacaattttatttgtaaacaaaataatttcgcaattgggatcaacatgttcaaagaatagtgatgatttgccttgctcaaattcttgcgggtcttggccttcacttggatccgcaattccctcgggctctatagttacgtgcgaaaattgatttgaattcggttagaattcaaataaaaatccaaataaatccaaatggaagtcgaatgcgaaagttgattcttttttattaactttactattcgcgaactagggcaaacccaatttcgatttatacatcctaaactatttttgcgggcataaatattttgttaccataagtttttaatttaatctacccgagcattatatccatataataggttagaaatttctatcgcgagctaaatatcggacaaaatcctaaaattatcttataatattgtatgatttaatttagtctatgactaaacgattaaatataatacacggctaaaattcctagtaattaaatccgaattcctactgtgaatcgatgactatagagattaccaaaaataatctataataatctataagaattcatctaattgtttagttattaattacatctaaattactaccaattttaatctaatccgatcaagaaacatatttctataattaacccagaattttgatcgaaatactattacactctaggaatttccaaaaataatctatgattaaccccgaccatttttatttcctaaatcctcctaatctctcccctaatttctcttctattttcaccttttattcttttcaattttcctctctttctctttctctcttttattttctttttctttctctttttctcttttcttttctttttctttctctttctctcctttcttttctttttccttctctttctctccctcccgggttctctccttctttctttcttctttctctccctcggcttctcccttgctctctctctcggctctctctctctctcttcctaccca

SEQ ID NO: 30641 - DNA, 24579 bp, Oryza sativa
tcgttgttttttttcccactcaaatttgcccgatccgtgtgtgtgcccgatctacccgaacggggggaatgaaggcccggcatgttgttccagtggcgcgatctgaagtgtgtgtgtgtgtgtgtgtgtgtgtgtgtgtgtgtgtgtgtgttttctcgatgtggtgtgtgtatttagtggggatgggggttgtgatctgatgcggttcggtttcgctgtttggggggaatgctcatcgagagggattgggttgatggtgtcaggtagatctggatcagcttagccgattgggttgtgtgcgtgctggaaatttaggtagggatgtgagctgcttgggttgtgtgcatgctggaaatataggtagggatgtgatctgcgaagcctcgtgaatcacacctgcgtttttggccgggttggtggtggagatgggcttggatcgcatgggtgctacctatgttgaattctgcgcgcccacgtgaaactttgattcgtacggtagttaattttcctttttcgttttgcttatagttcctgttccgttcgtgtgctgaccatgctacgatttaggcaagtttttttttgggtagcaactaattttgttgctggtgatgaagccttgtcagatgctgagcgatagtgcggagtatctgagttgtagtgattggatcatcggagttactgggcaaccgcaagggtcagcattccttggtgatagaatttgtgttgtatgcttttagacaaccgtatgtgtaatctgtatttctgttctcttgaatgagagaagggaagggaaggttattttcctttcagtagagtgaccagtgaatatgatggagtgaggagggaaatgtttacttatcgcgtcacggctatcttgtcccaattgtggttctttgtgagtcacagtgctagttttgtttattagggtgcagctatgctaccagataccagcaggacacaacataccacaataagctactttgtaaaatgcatcacattgaacacctaatgccatgccatccttatttgatgtgcttaatgttctaaaagtcagccctaggcatggcgtgctaggagctatgtgccatgtcgcagctgtgattttgcatttggtggtgcaccttccttgggggctctagtgctgatattttaattgtctttatttatgtgatatgtttgctaattgctaggaaacctcttgtcaagttgatcttaggcggggttaggtgtctgtaggtgctaaccttgctgaccacctagtcaccttattgaacattgtatgcgctatgatagccagcaatgttgtgactggcttgtgtgcacctgtggtttagtgtacacctcaccgccttggctgcacagcatgactcattagttatggtgcacatgccccaaaccgatgttcgtactttcctcacaggcctagatttgtgtgtggttatttggtttctgtttgtgtgatttgcatgcatgatttcagggagttacactcgggcagggatttggatgtgggatttaatgcctatttggtttgtgggtaggcgtaggccctctttgtttaggcttataagcctacttataagtcgaaaagtctaagtcaaaacaaacaagcagctttttcatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccgtagtgtgattgcataattccctaggtcatggtttaacttgaactttgtatcacagtgtggagatatattcgttttgatgtatagatcatgatatggtaatctgtgtgccttttctgtctgaaccatattgaatatcccctgtgtcccaaaatataagcatttctggagttctgcatggtgattaaggaagtaggtggaattaaatgggagatggttttcatttgttgagatgaggaccttgctgtcatcccagtctcagctggagaaattaaacggtagatggttgtgatttgttgagataagggagtagctgaagttgctatattttggcacggagggagttactaagtggagaaaagaggtatggacttggcttgcatataattgatttactagggtagtgttcttgttttcgtttccaggtaagtggggtcattctggcacataatgttttcagtgaattttgcctgatttcttatcatgtgtggtcacatttcttaattccgaaaaacatattataaccaattgcccttgcatatgatgaatatgatcttactggatgtgtgttcatttatgctgtgatgtttactgattccttttacatatctgaagggacatgggaatggaggttgttggaactgaggctgcaccagcagaggttaaagtaactgatggagaagtgaaccttttccaagagaatgaaagtaaagcaactgccaaggaacgtgaggaggcggttctttttggttcagataacagcacagctacagcaaatggagccgcaaatggcgctgattttgcacccccaaggatgcagaggaggactggcctgaagctaggaaaacacatagcttcttttttgtcaagatccgcttacttgatgacttttttctttttatgaacattgatcacgcggggaaggagttccagaagaagattcaagctcgttctcaaatttttgaggctataaaagccaagaaggtatggtcctagttcttacagttctagtacatataaatatggtcaatcttgtttaaattttatcctaaatcagcaagaagttatattccttacaacttgtttaaaacgactgtcatctgctattgatgctagagcctagaatatgttgccaatttgagcagactacgaaattttggtgatatgtctgattttggaacttaatctgcagaatgagcgcttcggtattatctcagagctgaagccattggctgctgagaacaagcaatacaacgaagccgtaagtgagaagttgaaggcgatagaacctcttagaaaccgtttaggaaagttccgcgatgaaaacaatgctatccgggcacagggtgcaggcatatgttcttcaattgaagagcttgagaaatcggtatggcagtacggttaacctatgataatttatttttctgttcttcagtccaatatttgattacatgtttgtgccttctccattgctttgtcctattagatcaagagattgaacgaccgcatatctcatgagagcatacccttggatgaggagaagcggttgatcaaacagattagagagcttgaaaagaccagaccgaaagtcatctccacttctgctaaccgagctcaaatccaagatacagtggtcgaaagagacgccatacaggatcaggttaaagtaagtatatacaactaaatatttgtttgtgcatttatcttcttgaaaaaaaaatagaattaataatggccaaacattgtttgcaactgttacttcagatcatcggggagggcattgatggagtaaagaaggagcgacaagcagtcaggtctaaaattaaggtcctggaggatgagctaaaggctattgacatggagatgggttcgcttcaagaagatttaactgctgccaatgccagaaaggacaaggcacatgaatcattggtccaattgagacatgcacgagatgcctatgtaagtcaatgtgtctttaatgtctttcatgcggggcatcatgttttctcttctaatactatctacctggtatgcctggactaagaaggagcaacacctaattttttaaagttacttcagttgtgttgcacacagtgttacgggacacacgggtccaaagtttttgacatatcaacttgtttctttttgccaacatgtctctgactcgactcgactggtggtgcatcttccagcagagtgtaactggtagtcaaggcagaaacgcattgctttgttggggaggggaaagaaaaggcattggggatagaataatcaataagtgtgaaaatgaagtctgtctaggttgtttttttttgtcagcggccaactttctatcctctctagagacttttttgtggataagtggatggaacagttataaatgtcctgggctcctggtatggataaacagactagataattttctgtgtgctagaaaagcctagaatgatgtaccccctttcgtcccaaaacagtcccaaaatatagctacttgtcaccacctactcccccatatcaaccaattccatctctcatttaatctctaccatccctcttctcaaccaagcacaaccacccccatttaatttcacttctctccttaatcatcgtgaaaattccagaaagtgcttatattttgggacaaggggagtagaacatatgctgcgtacaagagattttgtgaaatgcttaagtccttataacagaattaattatattaggtgaatccttgactatttagcatttgctaaatcagatacctgaaaatccatgacggatacggattcctatgtctatgtgccggtaacactggatttacagttctcagcaaatacatatatttgcatgtcttcacataacctcagttacacgtccttgagctgtaagacagattaatttttgttttccccccaagtttggtgcttttctatgtatatactgacactataattaccaatcgaatttccttcatgattcattgatacctctgcataagggtaacctgttaacatgtggtgatgaaacatgtttttagtaattaattgtctcatagttactactccctccattccaaattgatctacatatttcataggtacaccaagaccaataaaagctaataactctctcatactatatttactctagcaacaaactcgatgtatgcaccatccccactatctcctagccaatagcaaatcaagatattgcatgtgggttataaatacttgtgtgcatggatgtatgcatcaatgtccatttactccaatgcacaaataacgaatagacttaatttatgaacacaaatatgtagatcatttaggaataacctcaaaaaaactatatgtagatcaatttggaatggagggagtatatattagcatgcttaagctagctgcttttgactttgaggatgtggagttcatttgtctttctactgatacctcttatgctcccatgtttatctagaacgcatcattccatcaaaaccgccaacttctgagcaaagctagggatcttgcttctaggagtgagcttgcacaagtgcaagagctctacaagacacaggtgtgtgcgcctctggagcattgttttaataactgttcatcttttacgacttaacaaaaatgtcctaactaaacttctgttgtactctttataggttgacaaattcgtggcagaatggtgcaacagcaaggccttcagagaggactacgagaaaaggatcctctcctccctcaacagtcgacagcttagccgagatggccggatgaggaatcctgatgagaaacccatatttattgaaacagaggcagcagcaccacctgtagaacaagagcctatccaatcaaaaatgcctgcaaaacaagccaaggaagcgcctgctccccaagcagaggtttctcccaaagatgagtcccgcgtgaaagcaatagctaagccatctaaggctaaatcctctctggatgctgatgatgactatgaggccgagtctcccaaggagaagccaaagcctaaagaggttgatgtagctaagttgaaagagatcaagagacaggaggagatggagaagaatagacttgccctggaaaggaagaagaagctggccgagaagcaagcagcgaaggcagcagcccgtgcacaaaaggaggcagagaagaaactcaaggtagacaagtcgtcgtcatcatcatccctcttcctcgctgccacattgtaaccatgtttatctctctcgctttgccacattgtaaccacgtcaatgtacttattttcagagagaggagatgagggccaggaggagggctggggcagctgacaccgaggcgtccactgaatcggacaacaggtctgatggagcagcggaggcacaagcagaggacgactccgctcctgcttctgctccggtgatgagagaacagagggagagtgtccggtacagcagaaacgtcgtgaccaagagcaaggccccgctgccgaaggcgatcctgaggaggaagaaagcccagtcgtactggtcctgggctggccctgctgctgcagtggccgccgcgctcgtcgccctgcttgccgtgctaggctactaccagtactacctcccagcgagcgctagcaactgatggaaggaaagcaggcagcccccccttgagaattgcttacttgaacaattttgcaggtgagaaacagagtgcgtggtctgctgagacgtggactgaaagactggagatttgttcgttttcgttctgttagtttgatgatcggtggataagagtaaggaaaaaaaaaggatagaagttaattttggttgggacttagaatctcctatatactgcgagtgatctcatgtactcttaaactgaagcataggttgccgttctgaaataaacaatgccgcatgctttaggtttacttatctgttcctatgagccagatgaattgctgtgttgttccgttttgttccatgagcaatcgatgatcgtcatttgcatgctgcttgcggatgtgggcgagctaatgtcagtgtgtagcgtgggtttacaaatccccaaatctgtctgtatcgctctaaggccccgtttagttttccaaattttttccctaaaaccatcgtatcgaatctttagacatatgcatgaagcattaaatatagataaatgaaaaaactaattgcacagttaattagtccatgaagaaggaaatcgcgagacgaattttttgagtctaattagtctatgactagccataaatgctacagtaactcacatgtgctagtcctgcggtttccaggtgagttatattttttcattcgtgtccaaaaaacccttccgacatccggtcaaacatccgatatgacacataaaaattttcttttcatgaactaaacaggccctaaatcctgggcggggttcgcaaaattgtctcgtcacaaaaaccgcttcccagcagtttcatcgagaattgtgattgacaaaaaaaaaagttcgcataaattaacacttatgaaattataatggcatgattctaaatagttaaatagtaatgatatatttttaaaccgtaaaatttataatgacgtaaatccaactaaccctacaattgtacacccagcacttcagcacaagtctcttactttttggtgctcaaaagatttagtaaaattcaacaataacatggaataattttattttaagtttatatttcgggttgtttgtgtaaaggcaaagacccgtagattacgcatgtgcaaagattttatggaggttcaaacgctcctttagataaatagccttaagcctgttggtttgtatatattagttcaaaattcatgatatataaataaagccagctatatattgtgttgttacggagcgagttttcccattgacctaagggagtccttcaatagttgagcaaagaagttcaggtacgtgttttaatgcttcatggaagaaccaacaaggagatctagacatcacttctgattgggattaaggtaatgagccctatctgatgtcagtggggattgtttacagtaccgcagcaaacactgacgtatgggtctggacccatatgttagccaccgctactgcatcagcagtattgcagagaatttgcatcagcagtactgcatcagcagtattacagatgggggtgcacaaagccgggtcagtttacccaactaccttcctcctcttaactataacttatattcaatttatgtctctcgaaaatagatatgaacatacttttttaaaaaataatactacatattgtgaatttgtgatccttacctttacatttgagttatgacgaacaactttatcgattatataaaagaaaggatgacttcttatccaaacaaatcctatagtaatgtctttttaactttcagtgactaacatataaaccatcaaacgagtccatattaaaggataatactacgaagaattgtcatcccacatttttacactgccactatcagttaaaactgaaaaccagctcaccccaagctcaccaagaatcttcgagaaacttataaactccgccgaaaaatctcggacaaacccgcggcttcacacgcctccacgcacccaaaccccaccctagaatatcctctccttggccaccgcgccgccacatcagcctccccaatctccccgccccacgcgcgagcgccaatcgcgagccgcctttagatttcccaagataaggactcgatcccccctcacttcccgcgctatttaaactcccgcgccatctccaactcccaactcacactcgctcgctcatcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttcccaactaatggtctaggtacttatccgtggtgttattctgattagcggatttctcatctctattagatcggaaacaaatactccctcgatcccaaaatataaccatttctggctatgtatagtgtaaatatgtagtctaaattgtttatattgtggcatggaaggattaattagtgctttaaatttacgtatacaatagattgggtcgaatctacgaagataatggatcctctgatttagtgggttaaaatccaaagcgtttggtcttaaaaaaaaaatccgaagcgcacaataaaatgagtctgctgctacaatatacaacttgttcatattatagcatttcacagtaaaccacgagtggggctgctatacaacggaatcccgttctaataggatgatatcagttaggtatcagggtcctgatacctacctctgagatatcatgtcttgaaacctaaccggtatcaagtgatatctatcagatatcagacgatacttatcatgattcctactacgtattaggtgatacttatcaggtatcagatgatttccaccacatgtcgaatgatacttgcaaggtatcggatgatacctagctaccaaatatcaagtgattcctactaggtattaggagtcgagcactgatgcgtcatcggcagtggccccaccctccacaccccatgctggagcttgtcgccggcggtcgcatccttcgtagtccatgccccacgtcggaggtcatcgtcgggggctgcatcctctaacatccacgtgcctcatgtcaaagctcatcgccagcggccatgtcttccatattgagtaggtcctccactatccacgcgccacatcagagctcatcgccagctgctgccgcgagcacgtcctccaccgtccacgtcacaccggagctcgtcgccggtggctttgtcatcctcgctccacatttgtccgacaactgctccatcccggccgttgtcgcagcccatgtccaccggcttcgactccgcgttcgaccactccggcaacaactccatccctgccgcagctcatgtccgctggctcagactccatgtcggaccactctagctacagttccatccccgtcgtagcccacatccgccggctccatcttggcgcccggacattcaggcgacaactctgtctcggttgccgccatagcacatatccgctggctcttggcaacgtatacttattgtattgttgttcgatgaactactcgtgacaacaacaaactactgagttttgtaaaatctgctcaaacagtacataacacgatttaaggctatataaattttagcaaccgtcgatggttgacaactataaggtagaaacgttgatgacgtgcgcatcgtcacaccgtaccaaccgagccaacgctagagctaacagagggcagttgtcttcaccgtgaagagatcaccgaaaaccaggaaaaaaattaacgttattggcaatgcaaggaaaaaaaaaacaattttcttgtccgagctcgatctgccaccgcgttcttcactatcaccaaaaatcttgtaaaaaggttgttatcagtagaaaaaaaaattcttccgctgtccgagctcaacgtcgtcgtctctgccttcgccactggtcgctcgtacgggtggatgcattgcatggtggccacttgtacatgtcagtttcagcacacgcacccatgccaataatcccgacaattagcctctcaacgttcgaaaaccagccgagtcgagtcgagcccactttggcaccttgcttccaccacacacacacacacacacacaaacaaccaaacaaacccaaaaaaaaaaaacagagagagagagagagagagaccatggtaacacagccaaacaggccacgttactactagtagtaggtaccaaccggcccagcagaaatatctcccggaatccaccggcggagaacgtgacactccctcggcgtctactgaaattcaccgcgaaaaactaggcaaaaatccggtcgccgctcgctaggcgcttggctccggctctggcgccgatcgatcgagagctccgatcctagccaatgcgaggccacgtcagccgcctcatcattcacaaaaaaaaaaaaagaaaaaaaaagaaaagaagagtaaaccgtactttgcacaggcagattgtgtcttgtttcactttgcatcaggtttaccatataattttactttacatcaggctggattgaaataagttcataaaattgaaggaaaatcttgtgaaatccaaatgaaacctttttgaatttagatcgaagtttcattcaaatctcaaataaattatgtacgtttgatgatgtatcctagagtaaagttaaagtacgtgctaaacctggtgtaaagtgaaagatacaatccaccagacatagagtgcaatttactcaaaaaatatttcagcaaaacaaatattttttttataaaagtgtatttacataattggcaagggggatatcaagtaccagaagcacatatagtgtgatggtaaagcatgcacagttgcgagaatgagagggtgcatgactatgcccatcagtacttaaaatcctgatacgaacaaatattatgcccgtgctgcattaccacgcttttcatagaattttagtagtgaggtaagtaattgactcttatctcgctctctttaagcgtgcgttagaaaacatgctcagaagaactagagaagaagtgagaagaggatataaaaaagaaggatgaaatgtgggctgcagattgaacctgctcactacaacaagcagttttcctataggctcgttcctagtttgtactgcttccatcccataatttggacaggatatgtcacatcctattctaggttgctagggccaaagggagtagttacgagtaccagcttgcaatggagtttgtaaaagtttgtgcacaaacacttgtccagcttactgaaaaggcctgaaactattgcccatcgaacagagtaaacctgaaattcagtaacctcataattttcacaagttagttcagctagtcctcagttcacatactctattctgtagctcattgaacaatgctaaagattctgcccatagcttcttggccacttcaacgttgtatgacaactgagaagacgttatggtccttcctttccctccaaagaaatactttccagatgagtcctaaagcccaatgtaaaaattcatcccgaaggttaaccggagaatacagtacatcatgttgttatttataatgtaattgtttgctaggattgaacaggaagcttacaggtggtgccaaagcggcatcaaggacagcatcaactcccgtatcaggttgttgtaggagattcaggaggcgcagaacagaaagcgcaagccaagaaagacatggaggaagctcccgcattatgcctgtctgtactacacctggatccgcagccctgggagcatgaaatgtcatacttcatatgaatagtaagcaacttcaatttcgaactggtaaaataagttgcattctcataaaaaaaaataaagggttggcatgaatcacaatagttttgataaactgccaagagcgtaatgtttgtcagtggcattgagatgagccatcctaatctatccttgcacttgcacaggaaacctatgaagcaatcaagtatattcttcaatgatttcaatatagtttcagtagaggttgacttggtgactactggacagaagttcttgtaaaattttaatcatctaaatgaaaaaaaaaatcacttccatcagcaataatttggatttgttcaacaaagaaaatatgcaaaagaaaaaaaaatgcatgcaaccaaaatcgatggcacatacatgacggagacaccagaagataagtgaagttgtcgatgaagctcgtatgagaacatcagtaaacaaactggaataagagaaagtgagcccaaaggaaataaagttgcattaagcctattcaaaaataaaagtgacgtacatttggtatactcataagtagaagctaagagatagcttctcctcgctggccaatgaccaaaccttactccgctcaatcctttctcagacaagttaatttctgacactggagatgtgaaatttgcaaatattaaccaaaatataataaccaaaccacatgtctagttctcatggagaaagaaaggaagcagatataataatggtaggatctgtctgaaatgcaacttaatattttgatatatcatcaattttgagctactataagagcatatgccaaacgcaagcaatttgcaaacatatgtactgattcaaaagtgtggcagagaaacgtctgtccgacaagatttcaaaaaatgcaatttacagcaaacaagatctgcgtagcaagggaaaaataattggacaaattgatgccaattaatgtatatgcaattaaaattattttcaatctaatccagatacaattcacatagttttcttgctatttataatagaagacttgacacttaccacatctgtgtgtgaaagacgttagattaaccacccgagaaggtgttgagctgttcttgagcaatggtaacagaatgttggtcaggacaaatggaccaatgtagtttgcctgaatcattctggaaatcgtgtgtggtaagtttcactcaaacagtagattaaaaaatgtaataatgacataagtaaagcatgtataagaagaacattagaatttcttctgcaaaagtactttcaacataaacacctactcatcaagaccgtcctctgtaattcgatatgactttgctaggatcccagcgttattgaccaaaagctgaatagagtgctccatatttgagtccttgatccactgattcagtgaagtttcaaacttctttattgacttgtaggatgacaagtcgatttgaaatgcttcaagatgggcatcaggttgttgatcccgaatttgttgaacagtctgttttgcacacatcaccacaatgatgacaatgggtaaatgataagataagacatctagctaaaagctccaaataatacctcagataacaattgtgaagaacgcccagctgacacaaaatagaatgcatatagtgttttagtccaataataccaagcgaccaacaaggttgaatcaattcaacaacaaaatcaaggaatactttctactccaaaactatagcaattggcaagtaggaaacaagtcaatatgaaatgaagtaacatctacaattgtagatgcaaaagaagaccaactaaccataggacaagtaatgaacattttaccaaaagattgcatacacatttgcgtattcaacaaatgaaaagacgcactacttttggattggaaaggacctaattaatgaagaacaagagcataagcttctacaggttcaatacttcacgaaatcaagcaacagcaaggaaattagtgctacaacaaccccatgatttggaccgttggcaatgctcgagtcaacaaccaaagatgcacacagggtgttcgatgaaatgcccacacaagcaccgaaaaagaaacaggcgacccaccgaggatgacgtggtacccctcccgcgccagcgccgccgccgtcgttttgcccagccccgacgtcgtctgcacacgcatacacacacacacaccccacccaccatgagctgagcacatcacaagacggggagactcgaaagagagagagaagcgactccatctgcaagcaagcaagcaagaaagagcggaggcgagagccatcggttaccccagtaatcacgcagacggggcggcggcggcggcgacgagcggcgtcgtcgtcgggctcgggcataggtcggaggcgagggacgggggcgccgcggcggaggaagaagaggaggatgtaggagtagaggagggagacggtccacaggacggccattcgccagaactcccgcgagcacaccatgcggagcgcttcgcggtccatggccgccggcggcggctgctcggcgagttgtcaagttgccaccgggaaagaggggccacaacggacggttcggattaggggagaaaattgagattgtgccgtcttcaaaagggtttcgctttcgctcaaatgccatgctgaaaataggattagttaattaaaatgccacttttaactgaaggttgcacgctataatattcaaactgacaaaaatattctgttgctatcttttttccgcctttatcgtcgacgacgcactgccgcaagctgatggggccgccttcgtctccaccttcaccactcccaaggcgcatagctaccgctccctacggcaggggaaccggatccgtccaccggcctcagccgcctccgccttcactaagcccaccaccaccgccgttcgggaagaaaagggaagaaagaagatggtagctggcatgtaagtcccacatttttttttctaacgacctagctatgggatctaaattgcatagtttgtatagctacgggtgaagatttatggaatcaaggatacgggtgaacttatttcaagtagctaatacgtgatggtttgatgggctttccatggctggtagtacttcggctgtttttaatgggcttttgacatttaaaagctagtggactgcctccctttgctcaatacttcaggggcccgcgagtgaagatgccaccctagccctggccccgcacgatccgcggatagatatttggccccggccccatagggggtggggaacttcggatccgacagggtaattgccatccctaggcgagatctgacggtagagaaagttggacttaagaaattaataggacacaactacgaaactactagtcgttggtttgttttagagcagtgaccacaccatctcaagtataaatccccttttagcttaaaagaaatacaattgtgcatatcttttgttaaccttttcaatgacttaaatcttttaaatcacatattatttttaagatatatttgcatccgtgtactccactcaaaatatttgacaaaagagatccatgttgaatatattcaaacatcttattaatttaaaagcattttatttaaattgtagaagtaacttagctatgcaatagaagtaactcgctatagcattagaagtaattacattatgagtgagtgaaattagaagttatgtggagtaaattcaaaagcaaagtttagagaagatttttaagtaaatacatttatcaaagtaaattcaataaatcctgaaagtaattcacataaatcataaaagtaacttagtaaaaaatggaagtaagttgttatgaaattagaattaaatccgttgtagggaaaaaattatgatctatccagaaatcataattagcacaaattatagaattgactaaaaacaataataataagtgtaatcaactcaaagcattataaatatattagaagtaatttaatcaaatctaaaagtaatttttatatatgataaaagtaacttacgtatataataaaagtaattcataacataaatgttttttcatcatgatataatcatataagaccttcttataaagatttaattacaatgaacgtaatgttgtagctggatcatagatcaaataaataatttaagagaattttctaagaagaaaaaaagcacgcataacctaatagaaaaaaaaacttgcatgtctgtagacgtgtagtagtacttctctcacatatggctggcgtcgctcgttaagcctaaatcgagaggcccctcgaagtagattttgtgaaattaataaccatgtgtttggtttggaatgggataagttaggtcatcataggttgcccatatttcctaataagacaaaaacggtttattaggaaataaaaattaatttgcagttaaaacttttatgtgtttttagtgataagtcaatgctgaaaaagaagctatgtgataatatcctaaaatcaacttgaaattaaatttgaaattcaaattttgccttttttttttcctttggtttattagagcaaccaatggggtatttaggtaaggatgaatttttttatggcgtttgattcgggacagataaggtgggatgatcactaaaaggaaaatattattccctcaaaatctaggttagctccatacgactaatcaatttaacacacttgctctttatcattagcatacaaaccacacccttttacagcatttcttaagaaatatgacaattttatctctcatgccaaaaaacacatgaatactacgatctttctctacctctcactgtgggatttttcttctttctttttttgttgccgatacttttattttattattgtcctttttgggttgttgtggataggaaaaagagaaagatgaggtggattcgcgaaagggcctgtagcctagtggttacaagagcctcagtaacacctgaggtcctgggttcaacttcccatgggagtgaattttccaggatttaacggcgttgtgctttcagtagtaggcgacgtacccgtcgacagcgagcggtagggtttacgtgcgtgtgttcacaggggtgagtgcgcgtgcgttgtactgtgtaattcgtgtaattcttaaaaaagaaagatgaggtggattcatcattttataggccacatttcctacccatttgtacagtttctcttccttttttcttgttggccacatttcctaaggagatactccctccgtttcacaatgcaagtcattctaatattttctatatccatattgatgttaatgaatcttttagatgttaatgaatctttcattagaatgacttgcattgtgaaacggatgaagtatcaggaggaagaaaaaaaatcctctttattcaggaggaagaaaaagaaaatcctccttgtaataagataaccaattcatgaactataaacctcccgtgcgaatgtcagagcttgttgatatgcatttgtcttcgcaaacacaaaaagaacatgacagctaaaaagcatatacgaacagtttgttccatctaaataataactaatgtacaaaacagctccttctatcgcccctgtttagaacaaagaaatgaaaaacacgagaatatggaaaaaaaatattgtaaagtgaaaaactatggaattcaaaactaacacaaaaacaggagatgtaggaaaatcccacggggaaacataactataggattttttttataaaattattttttggtagcatcatagaaaaagcataggaattaatagtcaaaaggaaaagaaaacatgaggtctagcctcatgttaattctccaaaatcagtatgaaatgagcaattcaatataaatgtaaaaaggattttgtagaaattattcctttgttccaaaggacaatgtaggaatatatttttttcaatggatttcaaatccctcaataatttctccagttttcttttgttccaacggagatcacatgaaaaacctaggagatcaacaaagtgacaggggtttcctttcgctcactccatagagtggaggattagcttcctttcccaaggaattcaacatcttccatttgtactgacttccaaacaagcttctagggaaaaaattccaaaggaatgcaaacctccagaattcctccaaatgtaccttgttccaaacgggaatgggtgatttcataacgcagatgaaaataacaagaatcattttactccagccgagaagataatgtaggacatggccgagcaaaaatgttccccacgaaaataacacgaatgcaggaaccagatgccttgcataatgatatactcaagtccaacgcagcaagtcacaccagtacaaaacttattcacaagatgggtatatctgttgcaaactacagctactggaaaaatacacacatgcagcggcaaaggtcagcaaaagaactggattagggtaaaacatataatcataataataaacaaatcgacctgtaagtaatcccccccccccaaaaaaaaaaggaaaaaagaaaaagaaaagagtaccagcatatttcttggcgccactgaacagcatgtgatagaagggccaagttgctgaattgaactcccccgttcaaatcaatcgcctcagataaggcaaactccgcagtggtagctttacaatggtagtgttcctcaaaggaggatgtgacaaaatcattccaaatcctgacttcctcagtgggtttcatgattttgtttccagaaaatgtacatcgagttcatcagatcttcttgggaagattataggttttctttaggaacttggtagccgtctcatcataacggtagcacagaactcgcaggactgtgttgggttcgttcgggctccagtgccctgttgttggtggcaatggtaacctattcttggctccagatcgattagactcagccatcatgcgtttgaatcggtcaataaggctctcggagtctgttcgtaggaggggtaggacattcttgacctgggaggatgccttatcgaccaattcctctggcaaaccatcaccatctgctaaaaacaggtctttaagggccttgaagtcatcctctattatctgggagtcttgacgggtgaaagcacgcaaaggcccaccagcaagaagcaccagcaagaacccatcaaaagtggctttcatcaatgcggttatagcacggttccgcactttgttatgcaccataccagatatggtctctagtatagggtcgagttctctcaacaatatctcgatcctacttgatgcaatgtcaccaatataaaggatatcccagagaacgtgccccaaatcatagaatgtcaccttatatgcagttgtctcacataactgctgaatgccctcttgacaggctgtctgacaaagctcaaatttgatgtccaatccatcggtaacatctgcctgagctgactcgacattccgcaagcctgtttttatcttcttctctaagttctcgagttcacctcgcacgaattgaagcgtattcaagcgtacacagagttgaggaagggctaagggatcagcgccattggttgttccattttgtgatcctcggtactgtggattctgtggcttttcctttttcttgaacaatatattcgatcctacctcgcatcgtgtcaacggaggtagttggggcataaaagaattccttgttcctgtaattaatgcatgtttaaaatatgaacatttgtaccctgcatctgaacaccatgttatagaaaaatgtgccatgagctcagtacttaccacagccagattttgctttagacacaaaaagctgtaggcttctatcaagtccaaacatcaggtcaggaagaagaactggatgcattggaatgggcaattggaaaaatgcatctaatgtttcaccaaccatccgaagcatctccacacaagagggagcaatattctctctgttggcagctggattccaagtctgcatgaaagacattgacagacttagtggaattttagaacaggaaaatcaagctaagttaattcaaacacaatatgtcaagaacaagttggactcatcattcaagaagaatattcaggacaattacatctcacaagttgactgagccaatctaacatttggtttacacatagcatgcatctggatgtgactcaactagctataattttttttccattctgaaaaactggtgtgatgtcaaaattttgactgcaaatcaaacaaatgcggcaattttggcagccatagttgggataagatgagagaatgaacatatatcagagcccagattggagattgcagtcatcaatgacacatggatatggacggttcaggaaaaatagcagataatgtttacaagtgttatgcatctacatgcacagagtaatttagtcttatcgtaataaaaatcacaacaacatgcatcatcagttactaaattaagatagtttctgtttataccaaaagaaaaaaatatgtactgtgaaataaagtaagagcacctcttgtttcaaagtccgatcaacccatcccttgagcctgtctatcctttctttaatccaaactttcaccaggttagcaattgcattttcagcttcatatggtggcatctctctgattaatgacttgcctccatcatcactatccacagaatcttcaactgcaatattaacaagatccttctctaatttatcagcagccttaagcacttgaaccgtatctggggtcagctctgtaagtccagctatgaactgtttcagctcatttccaaagcaagaatgaagggtggcaacagcaacgcctgaagcaaggggatgccatgtctttaaaattgggctgtacaaatttttctccttaattgctaggtcaccaatgtcctttgcaaggatagacagaacaggggtagggtttcttgatgaccgcttggaatctgcttcttccattctctgcaaagtgaaagctgtgtcacattactgtgctactgcactatagaaaagacgtacatgaaaggatcaactagcaagatttgaaaagttcaaattatatggttcaaaagaaacaaaattactaataggatggcttgagtttgaacaaaacagtttcttgtggttgattaccaggaatctactttctagcttttcttccccaaagcgcattagccattaaaagtaaagatattgcaataatctaaacaaggcatctcagcataccaaagtatggaatataacatttaatcaatatgaatcagagtgagaaataatagggacttacttgagcaaaagctgtacggagtgaagaccttatgtaggtctctatcctgctgcgagctacgtcagtctcttctttcctcctccgacggtattcatgggatatatcttcaacaagaacccttgcagctgacactccaattgacacaataccttgcatggactcaatgttacttgtattgaaggtctcatggtaagccagaagtcttttctctgtccaacccattattgagcttaaagttgaactcaacactttgctgtaatttggatcttttgtggttttggcatcctttgcaacttcggccaactgattctccgcagcagagagcaactcaatatctacttgcccggacataacaaaatggttgaacaatgcccaagcaaagcaaaggttgtgaagcatctggttaattcccagaataccccaggtcttctttaagagctccatcacctcatcaatctcatcaacaacagtgccatcatcattatcaaagcaagcttctaccaacatctggtatagatggagattcaaggggaaaccatcagcccagtggcatccgtcagaagtcccatcatcagacctaccagcaagggacatgacagcactacgtaggacctgcattgactcagagtttttcccagtttcaagtggtctatcgtatgctccacgtataatttgccgcagtcgttgtgcagaaacatctgatttgttcaatggaacaagtgggtgaacaagcaaaccagcctcaagaagcttcaagttcctactctgccatgcctcgtactcttgaggatcagggatatctgatgccttgaactgctgtaggaattctaagggcaagaccatagattcagcacgcctgccaagctgtttcaagaaaaagaaaaatggagttcaaacttggtaccaacaattacaggaacaggcgttaagtcccgaacaataatagagcagagtagagtatctttgatatgatatatacaataagatcatgtttggcttgttgacatcaaacatgctaaaagtccagaaaacacaaacacacattcagcaacatgtcaatacttagctatgtgtttgtttaaagtttaaactgtccaatgttgttgatctgttaacacatctatcaaacagaccatgtcataggagggtatataaaaacataaaacatatacaataaaaaaaataatcaggcagctaaagctaaactgccaaacttacaatggtcatctaaagcctgcaaatttgctcttttggggagaagacttggcaataaagatctaaatatcatcattcagcacagtttaactaagaaacctactgaagtggagatggcaatgaatcaaccattttcagaatgcatataagacaacttagagcatgaaggcaaggcaggaagcttaacactcagggtgtagatttaggatgttttggttatgacagagtagcttctgcaattaagataatccagcaattaagataatccagtagataccctcgctcctccctcctcccacactcagtacgctgcactcagcactaaaatcacaaattttacgacactttgtagaactatctttcttcaatactgcctctagtacatggatgcctctagtacattgctcatggatgactgcagtacattgccatatactgtttccattcctcaaaactgcggtaaaataaagatgtctttgttttgtagtgagcatgacaagaataaatggctaattgtccttttgtggagacacatccaatctacaaacttatgagcatgcataagtaaaatagcaaaaaacatttccgtcactttgtacttatcaaaaacagtccgatgataacattacgaacccatttcagacacaggaaaaatcatgtgtgaaatgaattaatctacggtgaaattgatataaaatccatgcattcgaacaaaacactaaattattgtccttgttgacattataagatatgctagcaacaaccatttggatgtgactctatcgagaagagttggtatgtatagctttgctttgtacaatgcatccgagtatcctactactgaagcaaaaccgcagatcaagctaagaatcatggtattgaaacagtcatagtaataataataaaaggcgcacataaaaattatcttgagaaaacgtatattgactaagttccaacttccgaggctatatgataaacaaatcacagaaaataactggatatactccggctgg

SEQ ID NO: 30642 - DNA, 14910 bp, Oryza sativa
cctctctctcgctcatttccccttctgttgatcggacacaacagcggtgccgacgccatcaccgccccatatgcccgcaacgctgatggtagatcgggcttgcttagccacaacagcaacaccgatgccattgctaccccacatgccggtccaccgagcaacatggagggcaaggcggtggttgtgaaggggaagatccggtcgctgttgactcaagcgtctcccatccctcccacagcgacgccttgccgcctatcgcttctctccagcagcgatggtgtggccaccgtcgatgcaaatgacctggccactaatatatgtaggagacgaccaacatgcagagaggtgcagtagcaacgacctcctcaacagctaggcgcgtgaggttgtgatgtatgtgaacaagagtcggcgcttcgctgctgcgctagccactgcctccctcggcggcaccctccttgtcgcccgtcgcatcaagtggagagagaagaagggaggatggaggaagatgaaattgacatgtgggtcccacgtctagaggtattttggtctatatgatgacaaaaaacgtgaaagcgatggcatggttttaattttacatgtatttcgacgatatggatacgaatagacgaagagcaatgacatttatctaaaatggcacatttataatggcatgatccaatttacccaatttcgaatggttttcgagagttcaaatataaagaagaaatttggacaaaatttgatcaaaatttattaaaaattggcgaaacttgtcatatgctaggatctaaatccagtactcgattagaaaagtgaaccctgatacatgtataaggttttcttttgatttctgaaatcattcactaggttaatagctttttgtttcttgtacttagggaaagtttttctttgctatatataattgcagatatgtaagctcagacagtttactgatactaatttgatcaagtgtggcactatgatagtacaacttgtctagatttatagaaaataaatctttatatttgtagacagaggtagtaatataagtttaacaattggctcgtttgctgatgacgccatcattaacacatctttaatgctaaatgattaaatttatgccattaacatcggtgatcatggttggatagcttagtgttgttctctttaccgatggcattcgtgatgacttctaactgcctaccgatgaaacaaagatggagagttagcatacggtgacattaacgatcaatatggtttaatgtttctcattttgatgtaatattctactacagcttgtatgaatattgctcaacaatataatattctactacaatttgtgccacatattcatgcctaatgatgcgatactcatttcgatactcatttcgatgaagtttcttatattaggacatatatacgttctccatccaaaaagagaatctagactacagtcaatatagatttatacgtatttaagctcattatctgaaacggcgtatttttagcgcaatattgcaatgactaagggcggagataggagtaggacagttagggctacaactctactcctgagtctaaatatctatattagctagaattatactttaaaacttcaaaaattagaagattaaaggcgaagctatataaattacattagttgagctccaggcttagaagaatcttggttctgccactggcgacgacgtatttttggaagccagaagttgtcaaggcaaatgcaataatggacacatgtaatcttatggggtgcatttccaatcgtaaccgcagcaaaaagttttcggccagtgctgatcgatctccattaccgtatgtgtcaaggttaagcaaggacttaggtaccatcaactaattcgtaccagttgtcacccagtaattgcatatagacccttacagtaatactccctctgaaacaagttacaagacgttttaactttggtcaaaggcaaattactttaagtttaactaattctatagaaaaaagtagtaatatttacaataccagcataatttcattaaatctataattgaataattttttataatatatttgtcttaggttaaaaatattactacgtttttctataaaattagtaaaacttagagtagtttaacttttatcaaagtcaaaacttcttgtaacctgaaacggatggagtattttatatataaggaaaaaaaagagaaataattgcctagaccaggtccttcgaagaatcgtcaatctgtccagttgtctggtgaaccaagtccacgaggatcgcaggaagtgcaggtcctacgtggcaggtatcgctggttttatttcaagtgtagcttcaagttcaagagattccagtttgattggaataagaaaaagatatgtaataaagtgttctataataagaaagcagatctcgtagttttaccatatttgataagaaaaaatacatgccgttataaaaaaaaagtacgagcgaaggaaacgatacactataatgggcataaatataatgggcatagttggggttttctctacggtttttagaaaacaagtttaaatgagaggtaagaggcatataaaatattgttaaattgtccttttaatatctgccatgttgttggcaaattgaatttaatgaatattgtctaggctttgaagtataatcattttagtttatcctctccacgtactttccttagagagctttttaaaaaaaaattgagttaagtgggttttgtctatagcaaccaaactgtaccagttgactgttagaaagcatgtccaaaataagaaacctctatgattgatactattatgcatgcagcaagtagagtaaggaaagttactctaggataaaggagaagtttattttataactctggtctcctaaaaattatggaaaattcggattttgggcaccccctaaagtatcaaaatatgttctaatagttttaagtcattactgattgtccattgtttaatgggctttatttagaaaacgtgcacttcattaatgaaaaataaccactttgatataaagtttattacatatagcgatttttttttgaacaatgatagttgtgtggattttagaagtaatatgacaaaatattttgtccatactcttgaagtagtgggtcaccaaactatgcttatggtggtaattatgttgctattttgatagatagggatatctttacaaaaataataagatcgaattgaactatcaattgcacatgatttatggaaacacaatgtatagattaatgtgttatgtgccaaccaaaagtaagtatggcactagaagaggtaaaccttatcagagccgaaaaatcatcttgtcacggaaccataaaaacttcaaataaaacctcttagagtatatgagttctcaggttcacaaaacctcgtatcaaggcggatccaccacccgacaaacttagactagctagctggatgcacaatagaatttgactgtttttgatgaatcacaaagaaaattttcataacaaaaacacattgatataatataataggatcaatttggccatgctttagaaatctttctaattttaaggtcggccactgcctacggttgagttgaaatttaaacgacctatgcgttcacattcctaatcccgccgatcctgcaaatgttaattaaatcgctgtgagttttttatgtataagacacagctgcaaatatttgcatgtatgaatttcaaatggacgtacgcgttaaattaaatttcaacgcctcgtgaaaagaacaattcaatttcaacgatttcacgagaagaaaaaaaaatcacggttcttagctgttaaacttctccgatccgatggtagacgcgtgatcgtcgtacacagacgcgtgaatataatgtaggactacggttctcgtacgagatacaggaggaccggccgttgaaatacatttgaaacttttttactgctctttaattaccattgcgcaatataatggagaattaccgcggccgatcgaaatgaccgggatataacggttatttttacagtcacgccttaggccgtatttagttccacgtcaaaattgaaagtttgactaaaattgaaagtttgaagaaaaaagttgaaagtttacgtgtgtagaaaaaaattgttgggatgaaaaaattgaaagtttaaagaaaaagttaggaactaaactcggtcttatctaactaaacacaggattaatccggtggtgattaatgaagagtgtgctgatcaatgcgcaaaattagagcacattgtattgacatggtacacgaatttaagtgcaatctagtatataaacttgtaaaatacttattttttatatgaatttgttaggtgtgtaccaaccaaaaaaaataataagactaattttgctaggctctcatcggatggcctgttcagccaaagaaaaagttaaattttaaattttcaaacttaatttggaggttgattttgagatattttcaacgtaatttcctttttatattagcttttaagtcaccaataacacatatataaaagttttacctacaaattcgtttttattccctaataagccggcttattagggaaaaagccaaccgatggggaccctaatttaagtgttaacatatcctctcttataacccactaactctttaagtttgacatgcaaagatgccacatcatcatccactaactatcattacaccatatcatcatccattaacaatcatgacatttaaacatcatgcaaacatgttatattagctataacttttaaatttattaaatttaagatcattatgtttacataatatttcaatgtatatcttcattatgttttataatatcctatgtatctatatagttcatcctcacttagttagtgcttaaatgattaatgtatgtacaaattatctatatcatttcttctctaattaagccatatcacctcaattgtttatagcctttaaatgattaatctacgatgcaaactatcttcctacttttcctctttcataaattcgtaccaccttacgtttacatttgaatcatcaatctacatactatttaaatttaaattatcataaaccacactaacttacttaatctgatattatctagctattttatatgttatttttatttattattgttatactaaattcctacagcaacgtgtgaggtttcacctagtgttatatgataagaatgctacctatacatataaatgttaaatagagatgattaattagctggtatagttatgggcacacggctgggccacatgtatgtaacccccaagttggttaatcaaataaatagtatgcgtgattaattggctctatcaatcatatggtctgatcctacggcgcagatatatatatatatatatatatatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatatatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatagacacacacaccagctggaacgtgccaataattagaaaaatctctcgatcaagtcaagcactagtgtactacagctcaggcatggcggttgccaagcatgcgccagaatgtttctgcgagggagaaacatgggatccatgggatgcccaaaacgatggcgaaataatctgtgtgcattaatttgacgaattttcggtaggcgaaactgacacgcttgatcaagaacagctaattacaaagctagctagggccacatcctctaattcacacatgtacaccctgtttagaagagtttaccttttaaaatatccagctccactaaacagcgcaaattctcacatatattctgagaatatatatgtaactataaaaatgagaaaacaaagtaaaagccaaaatctagcttttataaattctcataagttactaccaactgcatatagagcctgaaaagacggaagtggactacaataattttgaagtcgctaaaacaacttgaaagcacattattttaatcaggcggtattgtatttttatgcattttagctattttttctagaccgaggggttaattcgaagagttttttttagagtgataaagttgctagaagcataaaatgcacatccctcaacagatggccgtggtagcctggtaggcgacgcacttcctccgtcccaaaatataagcatttttatcattgtactaagtcaaccattttaatcatgtaaaattgatgttattagatttatcattaatcaaactagcataatatgtaacgctttttatttaaaatattttatttttataaatattgttggttaaaatagtatctcaaaaactatgtcaaagttaaaaaatgtttatattttgggatggagggagtaccgtttacagacttgggggaggtgtttacagggtatactcactctattctgaattgatcaccgcattccatgtttacactgcacaaggaggagaagattgatccctaatccatttgatcaacgcattgaagaaaaagaaaaaaaatgttgctttggtgaacgcatcattcactacaggatatgaagggatgcaactatgctctgtatgcatgcacccaaacatttactttacgtagagaaatgaaaatacgctgcgaagaaatacctaatacgctgatcatttcttaaaacattgaaaaagtactatataatgaatatttgtgaatgaagggactatataatataattgattaataaaatatctagtactctatccgttccaaaatatatataaattctagcatctgatcgaaatgaagggatgcaactatatatgctctacatgcatgcgtcgaaacatttactttacatagagaaatgaaaagacagtgagaagaaatacttaatacgctgatcatttcttaaaacatcaaaaaaatttatatgatgaatatttgtgaatggagggagtatataatataattgactaataaaatatctagcactacatctttcctaaaatacaaattctagaattcaaaatttgctccaaactataataaatttttcacccacactcctttctgaactaatcacaacatttcaccactttctcttatcaatcaatcataatctttttatatttaattctatttactttctttaatactgtgtccattaaaactcttcatattttaggacggagaaagtatcttataaaagaataatttaataaactataggatatatgacactaatgattgaagactaatcgctttcaagggccaggacaacgctgataagtgattagatattgtgccttattgtttggcatattcatatgcttatcaaccaaaatttaaattttcaacgttaaatttggagttgattttggagtattttcatcgaagtttatttttcagcctttgcttttagatcgctaagaacccatatataaaagttttattcacaaattgattttcatttgcaaatatgccatttggcacgatgaggctgattgtatctgttctgggttgtcgtcactatcgtctagctgacagtaggtacagtgctgatattttaggcccacctgtcggtgaaatcgaaactcgaaaggttgttgaaccaaggttgtttcagtacctctgtgttggctgcttggtgctctatctctatggagagctaatgggcactcggacttgtccattcaattcagcaaaatgcttgtacacattcttaggtaaggtcaacttaattgctcaatccatgagagattttttttccttttcttcataaaatctttcagtgtgtctcaaaaccgttttataatcacttaactttctaaatcaacattccaaaaccgttttataattccaaaaccgttttactccatacgggtatgtgtgtgcacggtcataaagagtatgcgcccgttgtgagcatctgcgattatactgtgtttccccaaaaaaagttgattttcagaaaaattttctaagaaatgttggtgaagatttttcttttaaaaaatgacaacgtgctaaggtctcaagagttttgctcacgctaatccggtaactataatcagacaagaactatcttaggttgtgttcttccccattccccctcctttcccaactcacctcactctttttccacacgtaagcttatgaaactattaaaaggtgtgtgtttttttgcaaaaaaaaaaatctttacgaaagttgctttaaaaatcatattaatcctttttttaaaaaaacttagctaatactaaactaatcatgcactaatgagtcactccgttttcaaggtcggagagattagttctcaaccacaggaaacgaacacaacctaaagctaaagcattgtcttactgttttcaaagctaaataagtaaatgtgtagttaaatgtggaggtaaacttaagatcaagctgaagcgcatggaaacgttattattaaagagtccaaaatttttagtagtataaagaaaggtccggaattttgaatcaaagacttcttgggagaaaggcagcatacaattaacaatcagcatacgtgcaaacagttccaacagaaagaaaaaacgacgagacacaataaaacaagaagttataggaagcaaaaaagctccaaaagatgtgagtgaagcaaatcttgaaaataaaaagagagaagaataaataacaaaacctaaaaaaatgaattctcaaaaacaaaaatgcgattgtttaaaaaaaaagggaaaaatgaaaacaaaaaaatgttgacgcccaccgtggggctcgaacccacgaccacaaggttaagagccttgcgctctaccgactgagctagacgggccagcttgtctgaatggcattttttatgttattataagtaaaagttataaaaagattgcacaatttttcaattgcatttcgtgaggttgggcaggaacctgaatactgataagaacaatgtaccagtgcagaaaagcagacgaaaatcacccaagccgagaacgctgagcattacgaattttccatggaaatgtggaatctcacacccaacacaacgcatttaaaaagtccaatcctgttagttcttggaggtaatatgctcttcagttcagtcttgactaatccccctcttttcctcccaaattactgcacaaaatttggccatcaagcagccccacgaacagcccctaactaggttcggaatttgccaaagagggttgaaatgtaccatcaccgggggggggggggggttactgtactcatcaatgagttctgaaccaagcaaaaagtttagcccctaactaggttcggagttcctgttagttcagcattagcgcatacggcaagaggcaagaggcagatgtgtatttgacagtttgacacaagccatcaggagtgctttggccgccgggacaatcttctcaggttcaccctctcctggcatcagaaaaaaaacagcaagtttatcagcatcaagctaaattatatcatttgcaggaacggcatatcatttgtgatttaatggttgaacattcgcaggaacggcatatcattttttgttctaaggatacgtgggtaggattggttgaaattacctgggttccatcatggtcgtattcgacaaggaagacacatctgcacccccttatatcatgttgtttccgctggatttccagaacatgcgcatcgaaatgcaatgcttcatcattgctctcctaatgaacaaaatcacaatgaggaaaggaaaaacttcaataaaaaatacattttaaaaaaatcaataaaaacgactcgaaagtagaaagttgcagcagtacaacatattgtatagcctctcagttatagtttcagggcaaaagaaaaagggaacgtcattaccctttaccctaccttgaaacagaggacaaggtctccttccctgatgagtttgcattctgatgattccaacgggatggattgcaggcggatagccttccggacattgatccattcatcctcttcagccccaaatccttgaaatctcactcggacttcctagaacaataatgaagaaatagagttttcaaaaatagatctttaatttgtacggtgcgaacaattataaaatgcaataacgagattcatgtgatcagacctaagaagaaaacgaatatgttatcattgaagactctccaaaatccatgtggttcaaacttaagatcaagctgaagcgcatggaaacgttattattaaagagtctaaaatttttagtagtataaagaaaggtccggaattttgaatcaaagacttcttgggagaaaggcagcatacaattagtaacataggggtctgagacattctaaaattcagggcagtgcacaaatacttttgaggaaaaaaaaaaagaacacatgacatatgctagcaagccgataaataaactatcagctgaagagacataaatgcaaacatatcctacaacatcaattattctacttacaaattcaccagaacttaacttcctgtatgctaagaaagtggcgatatcatacctgcatagcacagaaaatcatgtgatgactatggcattagtgttggcttgccaaagttaagaaacaaaacaagataagaaaacttgaaattagtcagtacatgtacaaacattaaacttccagcttcatacagcagtactaagtactaagaacactgcacaaatgcccagttgcaaagttaactgagatcactaccacagttctagcattctaggttctaacgtaccaaactagcataatcaggaaaggagcaagtgatttgtcatggcaaaccttcccattgatgggaattatgtctctaagtactcctaacacaacaaacttgggtacaactttcaacagaagttaaatatattgcttgatcctgcatgattagcattaaaattttgaagacaaggaaatggaaagtatatgggagaaagggtcaaaggaaacaagaattgtatccccacaaagtaaaagggtattcaccaagcaaaatcctttgaagacctagcctcgaactgcatgtcttcaatttcaggaagcttatctatgttgtctgaaaagaagtcaacacataagaaataatgcacgaagcatcatgctttaacagattataatatttgcaactacggaactacctataggtaaatccggcgaaacctcgcctatatcatttgaaatgcttgtatcaacagctaaagcattttcttcagatgatggaggcttttcttcagaaaccggtgcacttgcttgggaggctaaagccttttcttcagagccagtaggcaaacaaggaggtataacagttgatgcagggaacttttgacggaaccattcttgaacctgttcaagcagatgttattatagtacacaaattgaaatttggggcataacaagagtcagacggtataacctgcacagcctgtagtgctttacttccaactcggcctggagaacaactgcgcacagcagaaaatgaaataaaaaaaaccataatcattagtttgaagctattgcatgtcaataataattcacaaattaaaaagaaacgtttttgcaacaccagtattcatacagttagacaacatttaactatttaagacatatctgcttaaggagaacaacagaagacacttcgatcctttcataagcttcttgcagaaaactacgatcgaagcctatagtctctactctctacttattgattcagaataaaaataaaggaaaattaaatgtttgccaatccaaaagattgataatctaaaatatgccactccacagaatgtaaatgctccaacgtgaatactattttgccattttgagccttttttagaataatacatgtctttttcccaacctgaattgccatttcctctttcctagattcttccccctactcccatctaattttctctcatcatcggacatgacaccgcacagttcagtttgtttgttacaaattacgaattaggttagtgttgatggcattaagctatcccaaccatactgttatttaaaagataaaggaccaccgccaccttataacactgacattcatggcaaagatgtgccacacaattgacctattcttgcacccacggtcagcaagattattggttatccaagcacctatctccaatacaataaaacatgaatctaaattcctcaaacatgactggactggctaatgcctcgcagccactgctgtcatgcatggcacacgtgagcaccaagccaccaaagtccttctgacctgctactcctcataatgaaaccacgcgcagatggaagttcgtatctgctgaggacatcttatccagacccagactaccattctcatgtcaccacaggtcatctagtcatgattcaacactctgaacaacttcaccatcatcaagtatatgtaatgctcggaccatctcgaccagacatcattggagcgctatccctgagcaagcccaactgcaaacttttggtcataaccgctggccctcaccaccacatgctggccttatgtgacctggagctgctcgacaaggatgccaccccattctggtcaccaaggataagaagagcgctacagcgtacaagggcaaaattaccgagcaatgtgtgggtctagagtctagaccaaatgattgaaaaaaagactgaaaagggcaaaaatagaatagatcctctcttcacagtggcattagaatgattatatatagttgagtggccttttgggcatgtcagccttggcaatggtaaatgtcaaagttttacctacaataaaaaggtttagaacaccctgtaaggttgtaacactgtgggactcacttaaattcttctgcgagcttccggcagaaaatttcatccaagacttgttcctttttatgtgtaaccaacttctccatccttgcaatctgcacgaggaagtatttaggttaccatggaagatgcaaactagcatagtacaaattgtatagctgatttaaccatgataatacagcatgcagagggaaagactgtgtactatactagtagttcacttaggtacagtggttgggatcatttgagccccatctcctaactttaaaaaaaatggataggatctcctttgtgttcccatttctagtcattacatgcatagctaaatagagattgatttacaactagagaattcatgttgaatcatgaaactacgtaaagctaacaaaggagcatttactttcccttcttccttcctctgaaatggataggcaacacacaaatgatgaactatagagtttaactcttaaaattggccataggatgcaaaacacagcaatctaataagtacacattgtgcactactaaaagcccacaaaggaccatcgaatatccttttctccagtagttaggatatattgaagagtggaagaacaaactcaaccgaagtgtttttcccatttacaggagcaaagaactgaaaagaataagttattctgcttcagttacaagaatattaagtttaacaaagaaggaagagttggcaaaatagcaatgctgaccagtggccacagaagaatatctgaataggaggatagccacttccttgactcaacctcgtgactttgattaggactcacatttagctattcttgggatcaatatgaccgggttaaatgaataatgcaatatgccagtattttattgttgcatgcattgatcactacatgcagcattctagccaaaaacatcagtgcctcatgactcttcatatttatgaaaagagtataaacttctaccaggatcacccaatgctaaactgaacattttgttcagtaagcaaaaaagaaaaggaacaaatatacactgtagtcaagattagtcaacagatgctgaataactatagtacatcacaagcctgcatgtaatcacctgaatgcgcactagcaaataaagtcgccatagcatcaaaatcccaatcaatttcatcatacacaaggggagagaacttcccatggcccccacaagaaccccgaccaaaacccaccaagaaaccacaccacttgaacgaaatggagcgtggggaggcataaacagcagcagggcgaatccgatcccccgaagaaccagagaaatttctcccagctcaatcgcggagatgccccggcccgttcgtctctccccaccccaacccaacaagaaccccggagaagcagcaccaccccaagcggaaccccaccacaggggcgccgacgagaggggggaatggatggggcgcggcgaggcctcacctcggatggcgcgaagcgaacgctcgatcgccgctccatttctcgccgccggcgaggtctccgccgccggaagaacggggaagacgccctcctcccaacttgcagcaaagagtagaaaagaaaatgaaaaggaaaaagaaaaaaaaattaaaagagaagtaggggaagtggttgagtgggccccaccagataatggccaaggaagggactggttggtgggcccaggaatcatcctgcc

SEQ ID NO: 30643 - DNA, 5215 bp, Oryza sativa
ttggaattctggccctctttagggtgtgtttagttaaagtttagttgaaattggaacgatacgatggaaaaattaaagtttatgaccgagtttagttcaattggaagtttgaagaaaaaaattggaactaaactcggcctaagatttcaacttttttcttcaaacttctaatttttccgtcacatcaaactttcttacccacacgaacttctaattttttcgtcacattgttccaatttctttaaactttcaattttagcgtggaattaaacacagccaaaattggaagtttgatttataattggatctatgccactataaatttgtttgtttagaaaaataccactacaattcacctaataggaaaagggaaatgctgaacaccggtataccgtcccgacgggataggatagacaccaaccaatccactcttcttctacctagctattctttctacaacatctctctcacacgtgctgctgcaactaagtcaacgacgagctccggcgtggcatgggtgtggatgacggaggacgcggtcaccagcgacgagctccgacgcggccgcccccgacgagcccccggcatcgcggactccgacgacgagcttcagcgtggcgtgaggcacggacggcggaggatgtggccgcggcgacgagccgcgtggcatgggtgtgcatgacggaggacgcggtcgccggcgacgagcttcgacgcggccgtccccgacaagcccccggcatcgcggactccggcgacgagcttccgcgtggcgtgaggcacgaacggtggaggacgtggccgcggcgacgagcccggcgtggggagcgacaacggaggatgccgccgacagcgacgcggtcgccggattgctgcttggagctccagcaccgccacccgccatccacggcgccgccgttaacgcccacctccggctccatccgcgtggctagccggtgcgccctccgccagcgccccaactctgtcacaggccctctctagtcgtcgccttcgtcgctggccgctggccgtcgatcccgctgtgagtccaggccttcatcctatccatctgctgcttcgagggagcaaagagacaagacggggtgtaaagagcttgttgacctggtcatggttggctgtggagtgtggtagaatcatcttctacatggtaagaatcgcataatacctgatagatatcatcttctacgttgtaagaatcgcatgatacttgataggtatcatcttttatgttgtaagaatcgcatgatacatctcgatacctgataggtatcacccgataccagctaggtatcaggacctgatacatcgcaagcatcacccaccacgtggtaagaatcacatgatacctaataggtatcatctgatacttcacaagtatcacctgatatatggtagaatcgcatgatacctaataggtatcacccgataccggctaggtatcaggacctgatacatcgtaagcatcacccaccacgtggtgagaatcgcatgatacctgataggtatcatctgatacctcacaagtatcacctgatacgtggcagaaacgcatgataccggttagatatcaggacttgatatctaaccggtatcatatcgtttttgaatggaattgcggtatatagtagctatgatactgggactgataaccaccaggtatcgtttatcaagaccgatgcccagcatgtatcaaatatgatacttggccatccggttatctggtacttgataccaaacggtatcacacacgatgcctgttatgaggcatggcacccactcggtatcaggtgtgatacctgataatagacttaatgctcactcggtatcagatgtgatacgtacccagtaacagatttgatacctggtagctaggtaggctactacttgctatactaaactagcttggctatcacatgaagatttttttgcgtatgcacgtggacaaaatgacaaatgatgggtcaatgggggtgacatgacacaccttttgagacacgatgacaatatacatgacatactaattgaacggaaggaatcgtccggctaactgcttgtaggcctgtaccgtccgaacggtataccggtatatagcagccctctattgtttaggtattactgaaattttataaatttagaacgatgccatcgccgtgatgttttccatcacttccgtcttcttccgtctctttttctcatctccttcctcttctcttcgtttcttctccccgtcggccagccatgcctcagcgtcgtgctgccggcgaacgccatgtccacgcgcaggagcctgagccgaaggagactgtgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtattttcaataaatggaattgcatttaagaaataatttaaattgaaaaaggttttaaaaagtctcttttggctttgggccaaaagtcggcccaaaaccgctctctctctcctcggcccagtccggcccagtccgccgcagccgcgcgcgtgcgtccgcccgctgacaggtggggcccacctgtcagggccgttgtcaacctccggccgccgccgcccgaaaccctagtttcgcgccgccgccgttcctttccaaatccggccgctcctttccttctccggccgaattgatagaggggaaatgatcctcgggatctcctctaccttttctcctttggaaacatcggctaattcgttttggaaattgttggaatcgagttcgaatcggattcgtctctctcctccgaaccctaaaccttccttctcgtcgccagccgccgtgggccttcgccgtcgccttcgagcccctttaaaaggttccccggtgtcttctctacccgccgccactctcgccttcgcctctcgtcgccggaagagctctagcgccgtgcaacctagcgccgccgtcaccgccgtcgctccagccgtgcgccgccgccgtctcggtcgtcgtcatcgctcgggaaggccaccgtcatgatcgccaagtcgccgccgttctcgtccgctccttcaccgccgccgaagaccgccggaacaccgtcgccgccgtcgacccgaagtttgccgccgcttcctcctcgtcgccgtcgctgtctgttgatcttccgccgctcttttggtcaccggtgagttcgccgcgtcgcgctctacccgttggtgctctccgttcgtgccgaagtgccgccgttcgccggcgagcatgcgcgcccgagccgccgagccgccgccgccggtggtgacgtcaccgccgacgtcatcgtcgccctctcccgtgagccggtcgtagaccgatcgatctcggccgtccgttttggatggatcgatctcggccgtccgttcgcgtgaaccgtcgcccgtgcgcccggtccaccgaaaccctagccgctgacgcaataaacccctttttccttttcaaaaataattcattattgcgtcataattcaattaaaatcaatttaagtgttttaatccgattaaatcttcaaaaattcataactaattcatcttagctcggatttagttggttcaagtctctaaatttttctaaaattgagatctacatgttaaaaatatccacatgtactgttcatgcttatttatatgctgttttggtgattttgcttctttctgcttagattccgccgtttccggagagtccgttttcgcaggagaagaatttgaagagttccaaggccagcaaggcaagtcacacagatcccaaacaaccctttgagcatgttgatcctatttaaagctattgtttctattcaactattgtatttattttcgaatgtcattgggtggaattaacctattctttgctatagcccttttgtatttgattactttattccttgataccttgggttattacaatttgactagttgagctttatttatattggttcaactagatattagatataattgcttagccatgcttagaaacattagctcactattgggataacttatgactcattattatttaatgatggcttaatgatagttcacgatggtcaatcgtgattgtttaattatttaatgtgccaactaaaacctgataaaggtgggttgtgagcacatgattttgttggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttatttataagggggtgattatgatccaggaaaggtgcgctgtagtggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccatagtaagtgatgctttaattggtaataatttgattagctcctggtttggaatggtatattcctggtttggagatagaactgtgcagccgggatggttgttcagaatggttgggcctatgcaacagggtatgttgtatagcgttggattaatattgtttaattattactcaactgttttattaaattctcaaatatttgctaaatgctgcttttgcaaatgaaaccctactatgccatcctttgttatcctgtgcacttgcatatttgctgcgtggcttgctgagtatgtcatatactcaccttgcaatcattcatcataggaagggttctacaatgatgctgatggtgtggaggattaagtgtagccttggtcaagctgcttgtggagtggagccgtctgcgccgtttattttattttccgctgcttagatctttattgattgagaggaactatctacctctgtaatgacattttgtttcgcttattaattagcgtcataattg

SEQ ID NO: 30644 - DNA, 4273 bp, Oryza sativa
ggtggcaaatcatatacgtgcgacaaagtcagtggcatataaggaattatctctataattagccctaggaaaaacaccgtgggaatggtggaagattaacttgccacctcatcaatattttcagaaatactgtcaagaattcgacgactcttccggcatctcgcctagttgaatcaggatttcgctagggatttggattggagattggggaaagggatgaactgaggagggaaaggtagtttagtgacattcgatttctttcatttcttcgatatcgtttacagacaagggatttccccttaaatggtcacatgccacagcacacacacccacctgacgcgtccgccggcccagcacggcacgtcagttcactcacacactcttggcccataactggcccacacaggcaagccttgatgaactacagttgtcatgacaatttccctccccttaaggagtggcttgtcccaaagccggtgcatcaagaaagtggtgacgctgttgatgaagattctcccatgtcgcaagctcatcagggagactagtccaacgcaccagcacttgagatgttgtagttcgtcctgattaaccagtcacctgttcaatatagattgcggctgagcgtgctctgtaccattaacacaagcatgatgtgaacttgaacataccatgaactcctgattgacagcctgtttaagcctctatacatgtacgactgggtgcaccagactgctcactggtaagtccaagcgataagccaccttcccaaccttctctagaatcttgtacggcccaaagaagcgaaaactcaacttctgacaagctcgattgaccactgatagttgcacatagggccgcaatttgagatagaccatttccccaaccgaaaactgtcgttcttggcgatgcttgttagcctggcttaccatccgttgttgggcccacaacagttgttgatgaatcaatccttgcatcaatgatctctgctccaaccaagtctgcacatctggaacagtactctgtccaagatccaccaccccaaagtgcgtcggcttttgagcaaacaacacttcatatggtgacttgcccaacgcagtatgaaaagctgtattgtaccaatgttgcgcttgagacaaccattgggaccatttgtttggagttgcatgaactgaacagcgcaagaaggcttctatacactgattcagcctcttaggttgtccatcagtttgaggatggtatgaggaactcatattaagcttcacattagcaagtctgaataattcctgccacaatgcactggtgaagattctatcacgatcactcactatctacttaggcattccaaagatgtcataaacattagtgataaacgcttgggccaccgtcagagcagtgaatgggtgagatagaggtataaatttggcaaatttagagaatttgtcaattaccaccaggattgtgtcaaacttgcctgacttaggaagcccttcaataaaatccatgcacactgtgtgccaggcttggaggggaactgacagaggttgtaacaaccctagagttcttccatgttccacttttgctctctgacaggtctcgcattgctgcacaaactggtggacatccttcagtaagcttgaccaagtgaatagactttggggatcctctagagtcgacctgcctggcctgaatgccccccaataccactatcatgcagagccaacatcatagcctgtttagctgcaacatgctgtcctaaccaaattttgccattcagtcgaattatcccattcaccaatttatatccaccttgtccttctggatgtaagctaagtgcagctagaagcttcttggtatcagcatcctgttggtacccttcctggattatctccaaccaccttggaacactgatagaaactgccaacaactcatctgagttacttctcctagacaaggcatctatagccccattgtctgaacccttttagtacttaattttatactgcaaccccatcaacttgacaaaggccttatgctgcatgtttgttgtcaatctttgctcacctaaatgacttaaactcttatggtcagtcagaattaaaaactctgcatgctggaggtatgccctccacttttccacagctaacagtattgccatacactccttttcatatgttgacatcatctgagaccttttactgagccccttgctgataaatgcaattggatgcccagcctgcgttagtacagctccaatccctgtgtcactggcatctgtctcaaccacaaattggtgagaaaaactggcagagctaacactggggcctccaacaattttgatttcactaactcgaaggcttgttgctcttttgttccccacttgtaactcacatccttcttaagtagggtggtcaagtctctggtaatcaccccatatccttggataaatttcctatagtatccagttaatcccagaaatcctcttaactgtttgacagttttaggaacaggccagtcttggactgcttttatttttgatggatcagttgccactctagaagctccaatcacatgcccaagatattctagatgttgtttggcaaaagaacacttactctttttgacaaacagttgatgccttgctagaatctctaacacaatcctcaactaactaacatgttcttgtagggttcgactgtaaatcaagatgtcatccacaaacaccatcaccccttttttgatcaaatgggcaaaaattgtgttcatcaatccttggaaggtggctggtgcatttgtcaatccgaaaggcatcactctgaactcatagtgccctacatgagttttgaaagcagttttaaactcatcacattcttccaaccttatctgatggtatcctgatctgaggtcaagctttgtgaaccactgggctcctgccaattcatccaacaactcttccactactggcatgggatatttgttcttcactgttacttcattaagtgccctgtaatcaatgcaaaacctccaagacccatccttctttttgaccaaaagaactagtgaagcaaatgggctcacactggtctggattatgccttggtgcaacatctgagctacttgtttctctatttcatccttcacattcactggtttaacatttggcagcaagggaattctatggtcaaactgcgtatgaggtggcaactctgttggctctttgaacaaatgttgaaattctgttatcacctcattaatttggtctgggacatcctcagcttccaccaactcctccctcattgcacaaagttggaccacttatgacacagccccatctttaagcatcccctttagttgctggcttgtaacctgctcacaggattttatttcctcctttactcctaccaaagtgatccttttccccatttgagcaaacctcaatttctttctcctccaatctatccacattggactaaactcctctaaccaatccattcctaggatcatgtcgtaccctcctattggcaacacttttagtttatcctggaatgtactaccttgacaccaccattccacctgaacacatttgtcacaagtcatctttcctccatctgctatggtcactgaatttgcaggcattctttctgtgggaagctgcaatttgctaaccaaactctctacaataaaattactagagctcccagaatctaccagaatcagtacctcttgatgctgaatcataccttgcagcctaattgttttctttcccattgttccagcagctgcacactttgaaagtgttagctcttcttcattatcttcttcttcttctttctggatgtcagcagttccatcctgtaacatcaatacttcaagcaactcatctaacacatgcaattgaactgactttggacatttgtgcccaggtccccatttctccccacacttgaagcattcaccccttgctcgcctagcagctttgagtgattcatatatgtcttcccacttgggtttctcctctcctttcttgttttcctcaggatgtgcccccaatattcccttggcaacatatgctggcttgatgcctcctttgaatccttctttcacaatcactttctgttgagccttcgatgctgacaattctcctagcaactcctcctgcgttttagccaaagacagagccagatcaacagttctaggtttatacaatttgaaagctattttgacttcaggtttcagtcccctcacaaatttggtaacaaagagggtaccgagctcg

SEQ ID NO: 30645 - DNA, 6310 bp, Oryza sativa
cttcaggtttcagtcccctcacaaattttgttacaaagaaggttttatcatagcttctattgtagactaacaacaccctatgcatcaactccacaaacttaacataataatcatccacactcccacactgttttagattctccaactcttctaggtgttgctgatatttatcccttccaaatttcccattaacagctacaaccagctcagcccaagtttccacaggatgtaaggcctcataggtttacagccacaaggctgcattcccaatgaaatgcaaagtagcaaaggatgaccaagagttgtagggaacctaatacatttcaaaatacttctcagagttggttttccagagttttgggttatctccatcaaactttgggaaatctgtcttaggcagtctagggctggcggatctaacactaaagctggacccccctactcccttctctgatgtttctcccaactcaaaattaacaggcgaatggtggaattggggcttactcttgaccagggtttgctccttagccttgaaggcttcggatgcgtcaccctggtgagtcgattcgacgccgtgcctacgggcgcttgtgccgcctgcgatggtgtcgttggcgtcaccgattctagctgcgtcaccctgaccgcaatctcatccaccggcttgttcagctcccggattcctgaatccacgcatgggatccatttctccagaccttgaagcgatccgaggatgttgttgatacttgttgtgagctccaccaccttctcgcccaacacctctgcttcttcttccgctgcccccatcctctcggttagggttggatttgccttcttcctcgccagtgcgcacgagaaccgaagtgctctaatactagattgtcacgaattccatgactcttccagcgtttcgcctagttgaatcaggatttcgctagagatttggattagagattggggaaagggatgaattgaggagggaaaggtagtttagtggcatttgatttctttcattttttcgataccgtttacagacaagggatttccccttaaatggtcacatgccacagcacacacacccacctgacgcgtctgccgacccaacacggcacgtcagttcactcacacacccttggcccataactggcccacacaggctagccttaatgaactacagttgtcatgacaaataccttacattcatgccatcctgtacacttatactcgttttgaattattcttttaccaacatacccttgtcaatttgatttataaacttgcctgctgagtaaaaaaggttaaaaaaaaagagaaaaattcagctgctccagcccttaccctatcatagagagagagagagagagagcgagcggccacagcaccagctcggagagcacagccaacagcggcgaggtccgcggaggaatgctggcggaagggcacaaggcgatggcgcgagctcgccagtagaactggcggcgaggttagggacggtggcggcaggcgcgagctaattcggctgcgcaacctctgcacacgtggcgaacaaatacgacggcgccaatgcaaggtggggctgcggcacgatgagcagatccggcggcagcaagcaaggtccaagacgataggttcagcggcggcacgagctcggggaggatggcgggtcacgacgtggaggcgatggccggctcaggcggtggtcgccaatggcgagccctccacaccagctcttctttcttctttttcttgccttttctctctataaattatttttatcctagattttctttgtctctagtccgacggcaatgaaatgcatatgtggcagcaactatttcaatttgggattttgatccatatggcatgtaaagtacatgaagggtatttcggtccatacgaaaatacaatagcaaaaaaagggtacaaaacaggtattaaggttgcaagatggcatggatctaattttgaaaatattgcaatggcatccttccaattagatgaattgtagtgatatttttcaaaaccgttaaatttatgatggcatagatccaattaactcttgatttatccaggtaaggactcctttgaatcaaagtgttgtagagaaattttatgagattgaaattctatagaaaatttttctatttggctctttgatttaaaggattggtgtttttcaaatccaatataattcctatagaatggcttattacatgtaggtttgaaggaaatttagcaaaaggtccaacctcttggaaaaaaatcattttagtctatctgtctcatctgatttctgtgttttttctacggctcaattaaacgatcattcatgtgttttccatgtgttttgcgatactctgttttacacttgcattactgtcagaatcaaagtttttctattcctctattttttttcattcctacggttcaaagagacgctaagagtatgaactaggaagtcttgattttgtttcatttatatatgtaaaatgttgatttgttggtgagatggtgagattgaagggaacccttccacattaaaccaggttacaattgttgtacataatgaaatggaatcagttggcatgttaggatagatagctttttaagtcaaattgttagctcaaaatatgcatgagtgtgagatttatatcttgctggatttacatgagtattaatacatatggtaccggagaaaatgccaaccatatcaaatatccggttggtacctaagatttgagaatcccatgtgaaatataaattgaggcactatatttaaaaacttcctagaaacaaacaatagattagtattttagaatcttttatcatgatgtagtgatttatttttattaagcggaaaaatataatcctaaatgcttggaacgtacatttatatcgtcaatatgagccatatctattaccattaaacatgtatcataagctaatacaacaagctcgaaaaatctttaaacatactgaaatgcattgacatgaactaaatatatactcctacctccgtgcgagaatcggaggtataaaaaatccgaggccttaattttttagggaggctgtttagtgacccctgtcaaatagtacttgacttgtttctgacactcataggttaagcatgcatgaattcagaactagtaatccttccgttctaaaatacttatatttttcgaatattgccaagtcaaatattattaactttaactattattagaaaaaaataaaaaacaatcatgtaaaatgatgttactagatttatcattgaacaaactatcaaaatatgtaactattttttaaaaaatattttacttttatagatattgttggtcaaagtggtatctcaaaaaccgtgtccaaattcaaaaatgcttatatttttagacggagggagtagcctggatctacaggatagtgggagtgcaagcccgtagttaatcttgaaaaatagaggttattgggtatcccatatacatatgactaacatatctaacgagctactccctccgttgtttaatatatcacgtcgttaactttttaaaatatattggaccattaattatattaaaaataattgttatttattttattgtgacttaatttattatcaaatgtagtattctttaagcatgagttatttttttatatttgcaaaaaaatgaataaaatgaatggtcaaatgtttaattttttttacttatttgtgtagatttaggttcccttcaatataagttgaataataaacaaatgccccgatcggttgagctgtggttggacggagcaataaaaaaattaataagcaaaacctttatgccaatatcattcacgattttatagtcaaggctagaacatagtatgatgaaaaacccagaaaatgagctttctctcaaaatttaaattttcggtattccattcagaagtgtagtaaaacggtcaatgtgttgacacgtttcaataagatctgaaggtcgcgtgttcgatccacgctcaccgcacctcaattttcaataagttaaattatttaaattcccttctttagggttgaaaattaaattgcttacttaagtttttaatttttctattcatcagtgtcgaaattaaattatttccccaagtttctaaaattttgtttcttcaggatctatggtatttttcagcttgcaattttcatcaagttatattattttcctaggattttaaaaatttcccctcttcagggttgaaaattaaattgcttacttaagtttttaatttttctgttcatcagtgtcgaaataataattatttccccaagtttctaaaattttgtttcttcaggatctatggtatttttcaacttgcaattttcataaagttatattattttcctaggattttaaaaatttcccctcttcagggttgaaaattaaattgcttacttaagtttttaatttttctgttcatcagtgtcgaaattaaattatttccccaagtttctaaaattttgtttcttcaggatccaaggtatttttcaacttcattttgtcttcaacgtagttaaattgttttcctaggttttttaaaacttatcttctttagggttcaaaattaaattggtttcctaagtttttaatttttcttttcgttagtgtcaaaattaaattgtttccccaagtttctaaaattttatttctatagggtctaaggtatttttcaacttcattttatattcaaggaccaagttaaattgttttcctaggttttaaaatttctgttcttcagggttcaaaattaaattatttttcaaagtttttaatttttctttttgttagtgttgaaattaattttttttccccaagtttctaaaattttgtttcttcagggtctaaggtatttctcacctgtcgccgcttcggatttgtatgtcgtcaccgtctctgctgttccacgccactcggaaaagggtgccaccgtcatcgccgagggagtgggccgctcggagccgctggacgcaccaccaccgccgctctgggtcaccgccttctccgccgctctccgggtctgctctctctctctctcctcgttcttgagtcttgacggttgcatttggtatatgaaaacacgatccaaaaacaagttaccgtgattttcgttttttgttgaagttagtaaacaatcagataattacattgaggcgagcttcttttatgagcttttgaataaaatttttgacgaacggttgctgtaaattattaactatggaatcaattgtatgatgctcctattgcaaaagtgaacttgaagaaaagttgtgctatgtttcagcaatgtgacaatatcacttgttttactgcaggggttgtgcttatatatatttgttttcagaacttttttttaaaaaaaaggagactacttctgtagagttttgagtcacatcagcatggtgcgccaattttgcatttgtttagaaaattccaaggatgtgcacttttttttgtttgtcagctagcatttggccaacacatccatgtttctatgcatctcgagttcaaaattttctctccaacaaagatccatcctaactatcacaaacttgcaaataaaatgctgcctccatgccacatcttctccttttttttgtggactgaattacttctgtatatgtgaaagtatgattggcattctaattctgtgctgttttgagcttttcgtcagaagcatgcaatgatattatggcatactccttgaaatcctgcgaattttattaagaaaaatactttcttcctactgttgttacactagctgtgtggagagaaaactttgtcaaaagctaaatattacggtaaatgttcttggtaaatcttttttctggcattatagtatgcaactgagctatgccagaaattgcgatcacacccaactgattaactgaacgacatagtggagacttaggttaaaggattagaaatcagagtaacttagaaaacgatacctgtccaatgctaatgcagaggcttgctgaaagattatgtagagtttttacctgaaagaatctctacagacactacaacacgttcatgtattctaagagccttctatggtttttaaagctcttgtcctggtatgcttgacacggagctgccttgacaaactactatcacatctggtgtgtggttgctatttgcttgttcaagaatgtcgggaaagtggagatccgtggagaacttacggtgagtttgctattcccatgtcatccaatgaaccagttttttacttcctccgtttcacaatgtaagtcattctagcatttctcatattaatattg

SEQ ID NO: 30646 - DNA, 2873 bp, Oryza sativa
gctagaatgacttacattataaaacggagggagtacttgataatgttaatatggcatgggaatcaatggtctcttcctatacaaggcagatcctcaatggattaacttatctgcatctataccaatataaaatatatctgtttcatcacataattcttttctagccctgcatttctacagcctacatatggtataattttagtatcatggttgattcaatctgtagagtctagcgtgcactgcagaatccagtgtgcacaatctgcatacagtataattcaattgcaagatcggtgttctttgtaggcatgcaaatcgataagaacttattcatgtgagttgatggtcttaacataatgacatttgtttatcagcgtatgaattatggggaagaagtatggcatgttgcccactgtttttcttcttattatatactagatgagggaaccaaagtggatcaatacgccttcagaattttgtgcatctttcaatttgggtaagatgatattgaaggaccagaagccaccaataaaatagaagtgcttatcttatccatttcatttactggaattatacttttgctttttcattctatgcagagagcagagtcaaactataggattgcagttccggtttcatttatacaagttaaccgtgtgcaatttaaagcaactaaattttgcacatcgttgcaattatcagagacacctgattggggtttcgaaagaattatattagaatagttttgcctcacagatgatttaagaaacttgtcaattagaccttaaatgttttcgtttgagattggtttacattcggcaccttaccttccatggtaatctgagtccatgtccttttaaggaatagcataaaagctaacactccctattcccaaacgatgtttgacaaatgcttgttaagtgatatattgtgtgaatcttatgatcacctgtttatatctgcaggttatatagattcatgtcacatgtgtatgtcttcagaatatctatatttatgtcagtgtctgtttttagatttatatatatttaggttacctgtgtatatattgagatttttcctaattgcatatcattacaaattacaaatatatttaatgaattttatatggatagtgtactctgttcttgttccatttttttccaagaataattgtcattagaatatgcagatttagtttgggaagcaaaattctatattctcaacttaggctttgttttcctttaggtggtgatatgggccctgtttagatcccaccccaaaaattttcaccatgtcacatcgaacgtttacgtttgaacacctgcatgaagtactaaatataagtttaataaaacaactaattgtacagattgcgactaatttgcgagacaaatttttaagcctaattgctccatgatttgacaatgtggtgctacattaaatatttgctaatgacagattaattaggcttaataaattcgtctcgcggtttactgacggattctgtaattagttttttattagtgcccgaacaccccatacgacatcctatataatatccgatgtgatataccaaaacgttacatccctagatctaaacaggtagctgagaggtagctgagaagatccaggccacttaatttagatgagaaaaaaaaatatctcccgcgagttcctcatggcttatcatagcaagaccaatggtgccacttgtaaaatccagatttctgttttaaccggcttggcatgcactacctgaattaagtgagtaaacatgtccatgcaacgtttctcaattcaatgagcaggaagacgtgccatgcacatgcataattactagtaacaataaaattctcacttagtctgaagttcttaacctaggtcatgaacaccgtgttgactgttcatccgaaacttgtttggattgatgaaaaattttgccaaccccaaatttttggtaactttgatagtgttgtatagttatttgatttgctaccaatttatgctctcactagtataaattgtattatatcagatttggtgtcaaaacttactaatgtttaggcactactaaaatattggtaagataaggattggcactaaaacaaacaagccctataataatcacttggctttccttttgtgaggttaatttcttggttgcagcccaacctctccttgtggcccgtgacctattgatgcctcctcctaataataatgtcccagtcatgtcacatcttgttcgtgtaaggacacgtgatcagtgtagataacttctttgtgctacctcccacaacatttgtttcagtcgtgggaaatactcatttcgtcatgaaagaaaaataaccttatgtctagattcattattataggtggtacgtgtccagtagcagtaaatacgtcttcatcagtaacagtaaagcagagcattcccgtgtgccggaagaggtcgccgcggctggagacaattcagccggtgttctactggcgactggcctcctcgagttcttgatcttggcggattgccgtccatggagaccacacgaagcgatggcagcatcatggtggtaggggcggtcgatatcgattgcccccagcaccggctgtgcgggtaccgcgacttgatacggggcgtctccggcggcggcgccgccatgtcgcgctggccggaggcggcgcccttcgtcccgcagatcgccagtactggtggcgatggtggtgcagcggtggccggcggcggctggtcgagcgggagctcaagcccggctccatcgtcttgcagctcctcctcctcttggcgcgagggagactgctgcaacgacgtctgctggtgttcttcttccacggtccacgagcttcgcagcatcgcggag

SEQ ID NO: 30647 - DNA, 8883 bp, Oryza sativa
  unsure (1)..(8883): unsure at all n locations
nnnnnnnnnnnnnnnnnnnnnnnnnnnnnnnnnnnnnnnnnnagttcttcctgctccgccgcgacagcaagacggtgcacgcggactacgtgcaacaggtggtccagttcgcgcggttcgcggaggagagcatcctcaggatgctggccttcgtcgacgccgccactctcgccgtcgtcgaggaggacgacgacgaccaccgggtggccgaggcgctcccggggatgttgcaggtgtacgcctgcatctccgaggcctctccgaccgtgctcgccatgttcaaagaagcatccgatctcctcgcttccggctcctcccgccatggccaggaggcacaggttttcgacggcatggacggcatcttcctgcgcaagaggaagaagctgagcgacgcgatctgggacatgatggagaaggttcgatcctccttcttgcaggatggatgctggcaagtctcgccggaggcatcagcatcaggagtccatgagaccaccgtgctgatgatgaactacatcgcgcttctctggcgcaacgacgacgtcctcaccttcatcctgcaggatcaccacttcagcgtgttcgtctctcacacccagggcttcagctcggtcgtgaacctgatcaccgacatcatctcttgccttggccacaaattggaggaaattgcctcctccctttccaattccatcttggacccagcgttgcgttgcattttcttgctaaacaattggcagcttgtgttgcaccgcatcgaatccctggacctgccatcttgggccttgatagacagatgcaggacacggaggtacatagacacttacattgacgtcttctggtcgcctctgttgtgctgcatcttcatcggaaattcttctgatactcctcgaaagaaaacctacagacctgctttcggcttccgaagatacctgtctcttgaaaattttgagatagaattcagaaaaacctacgcgaagcacaagtttttcaaggttccagaccctaagcttcggcagagattacgtcaagccatcatccagaaaatcattccgcattatagcatgtatctggaggagcgagcagcaaggggaatgcacaatcgacctcccaaaattactcctgagcagttgaaggagctattagaagaattattcgaaggttgaagcagatgaatttcagtggaataaatggctatatatttaattagcactcaccgttttgtcaccctagcttgggtcgtaggtttgaaggtttgtgctccggccagcaattaaggtgtggtttgtcttctttggactttggtgattatggtgagagtataattcaccaagttcctgcaaacagaaacttggttagtcttgccttattcgccggagaccttacttagtcttgcctgcttgtgaagatgggggttactaaaactgttgaaatgagttttacttaaatgttacaaatttaattatttccgttgtacagataatctattatcatcttcgtgtactctctttggttttgtcgtgcatctacttgtactttaatattgtggtgtaccagtaaagtaataagaagtaatacgttgtgagttgtggcatcccaaaaataattttcttgagatgttagcttacacttacagacgacctgttctcgacttctagtatatactttattttgttgtctaggggcaagatctactgtaacaaaataaatgtaaaacatgtaattttgacagtttatacaatgcagtaggagcatgcatggaagtataaatcaattgttaacaattggaaacatcaaacaaagcgtccaattaatggtttcagacgccgcctcatccccaagcttcacactctggtcgcctcaaaccagagcgcattcatcaaagatcgctgcatcccggacaactttacgatgttctatcaatcaaccaagcgtttgcacgagagacggcggccggccttgcggctcaagttggacatcgccgaagctttcgattccatctcttggcagttcatcatcctggaagtcctggagcacaagggctttggacaacgttggaactcctggattgccatgcttctgcgtacggcaagcatgaagatccttctgaatggcatgccgggggatggtgtagttcatcgccgcggcattcggcgagatgacccaattatatcccccttgtttttcatcttggtgatagactccctgagctccctctttgttaaggctcagaatgaagggttgcttcaacctctcagtgtccctcaccgggtgtctttctacgttgacgacgtggtcgcattcatctagcctacagtgcgagagatcagggcagccacggagatcctcaacatcttcggtgaggcttcgggcttatgggcaaacttcgccaaatgcgcggccctgccgatacaatgctctgaagaagacctattactagcgcaagctgaacttccttgcccacttgcagctttcccgtgcaagtatctggggctccctctgtctattttccggctaaagaaagaagatctgcaacactcatcgacaaagtcactaaccggctaccgacgtggaaggctgagcaaatggaaccgataggtcgcattaccatggtaaaatcggtcctaagcttggtgcccatctaccacctaattgccattgatccgccgaagtgggtaatcaagggaatagacaaaatccgctagggttttctctgggcgggcagggccaacgctcatggcggtcactgtcaggttgcttggtcgaatgtctgctcccctacaacgtatggcagtctgggagtactgaacctagagctcatggggatcgcaattcgttcatgctggatatggtcccatcgcacttctcaggaaaagccttggcaaggtctatcaatcccctgttctccaaaggaacacagcttcgtggctgcgtccatgatctgccgggtcggcaatggtgcttcggcgctgttctgggaggaccgatggttagatggatcctgtatccgctcgctagcaccggcgctctacgatcgtgtccctaagcgaactcagcgaggagaacagtggtggagggactgctcaacagaagttggatccgcgatattcaaggagccctcaggacccaggccattctcgactacctcaacctctggttgttgttgcgtgcgatgaacctcacggactgatgggaccatttttttcgtggaaatgggaaagctcggcactctactcttctcgctcagcctactaaggtttgttcctcggtcggattcccttccaatgtgtgccgatttggaaatgactcgcatcaccgcgatgtcgctacttcctatggctagtcgctctcaagtctcaaccgatgctggtcggcggataggttgcgcatcaaaggtatgccaatcccatcctccgcgtcctttgcgatcagcatggagaaagcatcgatcatattttagtggctgctgttttcggccatcgggagcccagaatgcttgcctatcaacgaagtctccttccatacttggttgtgcgacagtaggaaatccttcaccaactcccaacgatgaagtttcgacaccattgctacactcgcagcgtggacaatatggaaagaacagaataactgggtgttcaaccaaaagcagagaagctagatggaagttgcaaagggaatggtggaggcggcggcgttgtggcggctggccaatgccgccatgccggccatccacctatagtgcccttggactgcttaggtcgcatcttgcatctgtgagattaggctttagcacggtataacctatcatgtccttccgtccccttctgttttttctttgatctgtacagacttttactcctcttaacaaagatgcacttcttgcatattaaaaaaaatggtttcagacgtggtggaagtcccaggagtagcattatcatcaaggatatgaaagaactggaagtcggtgctcaatacatttagtatctctcgacgcggctcatcttaatcatagacaccattgagaacacataaaccaacaataatagatagggaatcaagccaaaagcaaatccaatcgtgtgcacattcacttcaaaatgatggagcattttttttttcatcttaggaacacgtatacaccttgcagtgcaattgacacacaagctactccctatgttggacctaatacactattacttaggttaattatccaaatatttagatgattatattaaaaaaatgttgtagggtataggccactggccatgattgtctgtcttgctgacgagagaaacgagcagtacaatgcctagatataaaattgttccatgatcgatcgatgagagattgagagtgctagcttgctttcaattcatccccatgcatgccaggagaggtgaatgagcatcgggttcagaattcagatcatgcttgggcccaactcctccccggttatcgtctttgccggtggggttttctccccgatagccatgcccgtctgcgaaaataaaacccctacgtcaccgaaaatgctttttctagtagtggggattgaactcgagcatgagataacaccgaacatccatgcatccatatatccgatgagtgatcgataggcattttttttgccgggacggcccaaggcaggccgcccaaattgtattaaggagcgagagaaggtttcaaaaacttttacaaatcgacattaaacagtcgaggagaaccaaaaagaaaaggaaaacaagcacaccgccacaagcgggatctttagctgacttctctaaaaatgttggcctctctccacactacaacttcatctttgatatctctgaagagttccgccgcctcgataggcattggacaaccgcaacattgatctatctatctcccatgaacatacaaatgcaaacccgctatggatgcggatataggctacgagcataaatgcatgcatatgcggaaccgggtatagcgagttttctttaagtggatcaacaaataatttttaatagaaagttaatgtatctaaccaattattttatagaggtatctagttgctaaaggcgatttcagaataaaaaaagtaaaatcaaaatgatttaacttattctctcaatttcaatcgaccgctattagtataagaagtggtgatgcttgcagtaatatatgtcgaaacatgcatgcgtccttcggtcttcttttttcttcgatcaaagttaaaaatcttgcaaattcttgatcttccgatgtgaattctaagcttcccctccaacttagacaaccttgatgaactaggatttaaggtggaagcaagaggtaggaggggtgagggatgaggagaggggaagttccccaactttagagggagatatgtggcagcccaacaatggtcaccgacgacgggagcatgacgagccacagggactgaagagggtagtggacgcaaggaaattttggccatgtgattgggtggcgggtgctgccggagccggaagagaaagacaagcaggggcggagcccaataggcctgggaggggggttcccaggcacccgggccgaagcaaaaaaaattagctattaccactatgaatccaccatacaggcaccccttgatccaaaactcaggaaccccctcgctagccttcagcccaaaatctgcaaaacgccaaggcccaacaaggcccaacatctgcacttcacaggttaatccaacgtcgatcgttgggcacggcacgcatcgtcgttccatcttccacctcttcctctctctcgactcagcgttgcggcgccgccgcctgttggccagaatcgccacgccacgccacgccacgccgtcgcccattggctaaaatagccgcgtcgtcgcgttgtgccatcgccgtgccgatttcgtctttggctgctgcacttgaatcttgattaggtgattttgccttaatattggcttgttggctagggcgagcactctaaggagagtctaagtttgtgattaccatctcctcgtggaatggctggacggcgtcgccttctccaacagcccgacatggcaagccaatgatgccaaccgggcactagagcaaatgagcagatgcaaggtccttttatcccatgtcatccttaactccttttgttttcagttaatgtagtaagtaccgacataaagcttgaaaattttcaattaatctcgaatagttttttctctatattttaatgtctggtttcaagttgaactttcaaaaattttgagtatttgaccgtactgttgtgcatagttcgaatatataactgtttgtatttgtaaatgatttcatgacttattctttacttaaaatttaagtatgatcctctctttctttattcagtcctaatggatgaatgaagacagtgatatcacattttttatgatatattttgtgatttgtgactttcttatacgattgacaaattatcaatttcacaaatatttttagctgattttataattcaggtacacaatttctgtcctttttctcaacactttcttttagtataatgccctcaatgggagaatcgatgtttaggatacacaattatctgcataatactagtgttagctcaccagccgatctcattagagatgagagtgacaaatccttaattgacacttataagagtggcaattagtaaaatatccccacgcttagaagcatcgggtaggccatcgaatcaattcttttttccaaaaagtttgatttgtatgaatgttaatttcgtgtcatatattctctattcaacttaatagatcactttataattaagcacgtcacctttacttctagtagaagaaaacaggcgaagttgtatgagccggaaaaaggcaaacggactcgcatattagccaggtagttttaacatgcaacgttgcgtgcttacacgcttgctgagctaaacctcatgctacagcttaaatgcttaatacaatgtaatcaagggaagacgaatataacaattaacattataaaaaaatttagtgcacttcacacatacaaatacaatgcaagatattagactgccaaatttcaaaatccagaagcaaagaataaaagaagcattagtggattagtccataatttctaggaatcagaaagagagggattagtagagctgattgtcgcaaaaaaggggataatatattcagttccaaatgactaaaactgatcccaaattatggttactacatagtcaaaagaaagaaggctgcggaagacggatcgatgatggccatgactgtacttgaaacaggacatataccaccataacggcctgaaaacacacgcagaaccttaaacgagtacctcattttcaaataagtcaggcaacctaaactgactttaagctctccaattacatccataaacagccgggcgagaagtactttcatttgcaagaagatccaactattggcataacaatgtcctcaagcaacggtatcaaaaaccaaagaaaccaagctcagttgccctctctttctcgaatgtctcgaagtactggtagatgatagtaacagcaagcagaataccagttcctgaaccaatagcacccatgaaatcagctagaacagtcaatgcaccaatgcacactccaccaaatgcagcggcagtggggatgtatctgttcaattccttctgcaagtttgactcacgatggccaggcatcaccatttgctgttcctgttatagtgacatagaaatggagtttatagatggcctttgagtaaaccaatatagactattagatcacctcaacactaaatatcccactatatatagattcctcagcacaaggtcaaaagtttctaaatatccactaaaaaggttccagcagtttcagataagataataatagttaagaaactttggataaggcttcatggaaaacattgaacgctacttgaacaattcatgtgcttgaatgactataatgttgcatggcacaacaatatttggagttttatgtatacagagttcagaggttagcatacatcaaaacatgtgcagatgggatatcagacttaagacatcaccacacatgcaatgtaatgagttggactataggtaaacaggaacaataactagatagaaaatatgtatctacatctttaccttcagctgtttagcaacatcctttgcagatgagccagatacttcaatccatgtctttgagaagagagcacaagctgacagcatgaagaccacatagaacaacgcatggaacggatttgcaagaacatcagccaaactgcatgtttccaaacatgaaaggtaagaacaaaaacaaaaacataaaatggtgacaaaaacaaaaggcaagaccataaggatagaatggtgacatcaaacataacgattattcaccttgatggagcagttacatagtaagcgagaccaccaacaggaaccgaatggccagagtactcagattccttccatttcccaagaaggttaaccagaaaatttccactgtacctcctgtagagaagctgcaacaaaataaaaacatgttaaaaacttgatcagtaatgtaaatattactgcggcactacaataccgcacgcacctgtgatatgaagtagaggttggtaatcagtgcagagtgcagaatgatgggcatgtttgaagtgtagaacaacttaattggatatgagccttgctgccccctagcattctttgatctcactggaagcacaacacggaagccttggaagtagatgactatgaggaagaccaatacagttgcaagtaaatttgtcacattcggaaggttctgacggtagannnnnnnnnnnnnnnnnnnnnnnnnnnnnnnnnnnnnnnnnnnnnnnnnnnnnnnnnnnnnnnnnnnnnnnnnnnn

SEQ ID NO: 30648 - DNA, 6283 bp, Oryza sativa
ctttccaccaacacaaaaaaaaaaaaaagaaagacgaattacgcatagtagtttttttcaagaaaaagggtgaaaaaccgcaaaagaaacaaaaaaaattccagctcatcatataaaataccccaactgcctcgcttccccttcccctatggcttctactagtactcctgcatgcacgcccctaaccccgcctctttccttttcttccttactcgccgcgcgtgcgcctctagatttggcgaccttcactgccgccgccggcgccagatcggagcgcggcctcaccgttgtcaggtgagcccggtgatccgatccttccctcatgttatccttgtttttccccatcagatttggccgatccgtgtgtgcctgatctaccgcgccgcgggggaatgggggcggggcgcggtgttgcggtcgcgcgatctagagtgtgttttttttttctcgatgtggtgtttggattcagtggagatgggggttgtgatctgctgcagttcggtttcgctgtttggaggagggggaattgggttgatggtgtcgggtagatctggatcagcatgcccgcttaggttgcgtgcatgctggaaatttaggtatttaggtagggatgtgatctgcgaagccttgtgaatcaacagctgtgttttttggtcgggttggcggtggagatgggcttggatcgcacgggtgctgctacctgtgcagaattttgcacgcccatgtgaaacttggttcatacggtagttaattttcctttttcattttgattgtagttcctgttccgttcatgtgctgaccattgctgcgatttatgcaagtttttttttttttgcaaattcccgtaatagaagaattggattgctcccaaaaaaaattgcaatggaaaattacctgctcaaagttaagtttgacatgtcaacctagcaagaatggtaactttcgcaacgctcaattcctatcaaaattggtaaaattgacttggatccggagtcaaatttagcatatatctacgcctaatcattattattattattttccttcaaaccaagcatgtcagcaacgtcacgaaacgaaaacttgtctatttaggcagggatgtgatctgcgaagccttgtgaatcaacagctgcgttttttggtcaggttggcggtggagatgggcttggatcgcacgggtgctgctacctgtgcagaattttgcacgcccatgtgaaacttggttcatacggtagttaattttcctttttcattttgcttgtagttcctgttccgttcatgtgctgaccattgctgcgatttatgcaagtttttttttttttgcaaattcccgtaatagaagaattggattgctcccaaaaaaaattgcaatggaaaattacctgctcaaagttaagtttgacatgtcaacctagcaagaatggtaactttcgcaacgctcaattcctatcaaaattggtaaaattgacttggatccggagtcaaatttagcatatatctacgcctaatcattattattattattttccttcaaaccaagcatgtcagcaacgtcacgaaacgaaaacttgtcccagaatccaagcacaaatccctgccaaccacctaaccaaccaaaacatcgctctcgatcacatacttcactagcatcgatccgatacccgccggataatcacaactaccaacgaacacaccaacccaggatccatccatgcgcatggatctggacgcccccacctactcaccaaaaaaccacccgcaccataatcaaacgcatccatcccgcagaaaaccaaccaaaagaacgcgacacggatcacacacaccccgcggatacagtacagatcgagcatgagcacgggccacagatctacaggagaagccgcaacgaatggacccgccccgatccgatccgacggcgagaggaagaaacaagaggagagagagagagagagcccgagctgctgcctcacctggccggcgccgccgccgaggcgagtggaagcttcgccgccgccgcgggatcggagggcgtgaaaccctaggcgaggagagagagatgcgggggcgcgcaagagcacgagacgggaggagatagtactagtagcagttgaagagaggagtacctcgatgggtcgctgcgggtggagcccacctccgcggtgatctgacgtggcgcgcggggacggtggggccgagcggcggatggaggggtcccctgctaagcagatgaaaatcaccaaatttccatggaaatgtgaaatcttaccccaacacaatgcatttaaaaaagttcaaatcctgatagttcttggagccggtcatattatcgtatacttccttcatcctttaaaaaatacttaacctataagagttccttcgtccttaaaaaaaacttaacctattaagagaatatgagtcatgtgatcccttctaagacaacaaatctggctaccctttatctagaatctagatcacatcccctcctaggttgagtttttttttgacggaggaagtatgctcttcttaccatgtccaaaatttagacatcaaggacctcacaaacagcaattcaaatgggaatttgcccaagtgagtgggttgaaatgtaccatcacatggggttactcatgagttcataaaacattttagaccctaactatcggattgaggggctgtttggttggcttctaaagattgccatgccaaaccttaggcatgccacaatttgttagtacagtgtttggttggttgctacacttgtatcatgcctcactttacaaaatcattgggcctacacgttatagactcaaattcttaccaaacttagccacacttgtggccaacaaattgttagcctcactttttgtggcataacacacttgtgacaaagtgagatatggtaaacttagccatcaaccaaacaaccccataaagtaaggtgtggtaaacttagccatcaaccaaacaacctctcagttcctctcagttcaacattagcgcatatggcaagaggcacacgtgtattcgacagtttgacacaagccattaagagtgcttcggccgctgggacaatcttctcaggttcaccctctcctggcaccagaaaggaaaaaaaacataagttttttagcatcaagctaaattagttcgggtggtgaggttggaaactcacctcccgcgcacgcaaaatgaagcaacgcattttcttacgattaattaagtatttattaaactgttttaaagatggattaatattatttttaaagcaacttaaaaaccttttgcaaaaaaaaacgcaccatttgatagtttaaaaagcgtacgcgcgcgatacgagggaggtgagttgggaaatatggggaagaatacaatatcattcgcatgaacgacatatcatttgtgatttactggatgaacattcgcaggaacggcatatcattttttgttctaacgataggtaggaatggttaaaattacctgggttccatcatgatcaaaatgcaatgcttcatcattgctctcctgatgaacaaatcacaatgaggaaatgaaaaacttcgataaaaattacatttaaaaaaaatccatcaaaatgatacaaacgtagaaagtcgcagcagtgcaacatataatatctacggtattgtatagcctcagttattatttcaggaaaaaataagggaaatttattaccctttatcttgaaacagaggacaatatctccttccctgatgagtcggcattctcatgattctagcgggatggattacagtcggatagccttccggacattgatccattcatcctcttcagccccaaatccttgaaacctcactcggacttcctataacaataacgaagaaatagagctaaattaaaacatgcaaaaggtttaaatgtttctcaattctttaatttgctttaggatctactaacccattagttcacatctcggccattgtgagccccttaacgggaataactaaggctcatgcgagagagaagatagatatagcacttgcgatgtctgatatagttttagctctcaccaagtcttgccccatgagctattgctccagtgagggcagaaggtgagagtgaagatgcttttaacaagagaacgttggacaatgctccaatagtacagaagtacaacactgatcgtgcgaagtaggagtcatcaaaatgcaagtgcttgatggtgatcaagagctccattgtggaggcaataaggggagcaatcccactgccatagagtaccttcaatgggtggagaatcagttcactggttctttaaaggcctgtgcgaaatccctaacaagaggttagtaaccatgtagtatacgagcgaaggggttagagagcatattttgaagatgagtggcatcgcttcaaagctcaagaagatggactttagttcttcctgatgagttcctagttcaccttaatttttcctccttgccttcagtttttgaggcttttgttgtgaactacaattcattgcccgaaaactgggactttgagaagctcattgccaagtagtgcaagaaggggcactatcagaaggattgccctgaattcctgaagcatcttataaagaaagggattccgtacgaggaggactcttcaaagagcagaaagacgcaatagtaatgtgaatgttgtatgcaatgaagtgaatgttgcatgcaatagtgtgtcttcctcgtctacgaatgtaagaagtaagcgcaaacgatgcaatgaggaaaccacggcgaaattgtggcactgtcgtttaggccacattttgaaggggagaattgaacgatttattaaagaagaaattttgtatccgttagacattacggattcagaatattgcatagattgtattaaaggaaagacaatcattatgatctaaagattaaagcaataaggtccaaccgtgaagaagagtactactatgctcggcataccccttatggccaaatacctggaccttttgcaaggtttctacaggaaaatggcatatggcatagtagcccagtactccgcaccggacgagcctcaatagatcggagtagcagaaagactatggatggaggtattaaaaccgcctgcccatattcttaatcgagtaccaagtaagtcggtacccaaaacaccgtatgagctattgacaggaaggaaattcatgctaaattatgtacgggtgtggggctatcaagttgaggcaaagttatttaacccaaatattgggaagctagatcacaagacagtcagttgccatttcattggctaccctgagaagtcgaaaggttttcgtttctactgtcctgatagacacaccaagttcgtggaaatgagacacattgtttctggaggatgagatagtcagggggagcatggtaccccgataaattagtcttgaggagaagcgggtacatctaccgactccgatgattcaagaaccctttttctcgatacctgttgatgtaacaccgacaacacagaatgttgttgtgacaacacctgatgttagttctcctgtgacaacaacgaatgagcaagaggaacctgagattcaggatcctacagaactagttgtcacacaagaggaagagcaacatcagccccaaatagaagatgtaccacaacttagaaaatctcaaagagaaagaaagacagatattcttagtgactaccaagtctatgctagtgaagaagttcaaacacagggtgatcccacctcgtttgaagaaaccatgagaagtgctcattcatcgaagtggcttgaagccatggaagatgaaataagatcaatgagtaccaacaaagtttgggacttagaagaaattcctaaaggagccaaaacagtaggctgcaaatgggtctacaaaacaaaatgtgactctaaagggaatgtagaaagatataaagcacgacttgtggcaaaagggtttacttggagaaaaggaattgactataatgagaccttttctcccgtgtcagataaagattccttagggatcgtaatggcacttgggcatattatgatctagaactacatcaaatggatgtaaagacgtcattccttaatggggatttatatgagaacgtctacatggcacaacccaagggtattgttgtggaaggaaaagaataaatgggatgccatatgaagaaatccatctatggattaaaacaagcctccagacactccagacagaggtacttaatgtctgatgaagtaataagaaggtttgggtttaatgagaatgaagaggacaattgtgtt

SEQ ID NO: 30649 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgaatacgaatatggtatcggggtttccgtcggataataatccgtaaacagtgctatttggatatccacataagccatgagacataccccatttatttataactctatgaccttgaatatacatttttagattttaatagtagttcatctcttaacattagtccacactattaatattatttaaatttttaaagatattcataaattatattatattttatataaaataagctaattatatatgttgatacttgtttctattagaagttgagttggttttcgtgttccgagaaaaaaatgtctccgtattcgtgttcgatcatattcgattcttattcgtattcgagataatccgtatttgtttccgcattcgagctatccgtattcgattccgtcagggtaccgagctcg

SEQ ID NO: 30650 - DNA, 791 bp, Oryza sativa
gatggaaaaacgtgatggctataatatggttccaattttgtgcgtattcggatgatatagatatgaatagacgaatagtaacagtagtaatgacatgtatccaattcaccttttcggaatttcactccaaatctactttcgtcctcgaaacctcaaaattgcatggttgtggatcaatgctctgtactccctctgtcccaaaatataagagattttagatagatgcgactgtctcacgtccacccaaaatctattatattttgggaccgagggagtatactacctacctagtggctatatcttggggtacccgttgcaattagcacgctctctttctctctcctcatcatccctccgggacaaaaagcggcacgcacacctcccctcctctccctttctctctcctcctcccctcaccacgagagcgagcgcggggagctccccacccaccaccaccaccgacggcgactacctccgccgctgccgcgatgtctcgcctcttccgcgagtcccgccgcgactcctcctcctccaacggattctccgccgccgccgccgccacgggctccaccggcggcctcccctccccgttccccgacctcggggtccccctctccgccgccgacctccgcgaggccgcctacgaggtgctcgtcgcctcgtcccgcaccacgggagggaagccgctcacctacatcccccaggcgggggcatcggcgggtggtggtggtgggccggcgtccccggcctccgcctcgtctctctcctccgcgaacgcctcctcctccccg

SEQ ID NO: 30651 - DNA, 458 bp, Oryza sativa
  unsure (1)..(458): unsure at all n locations
nnnnnnnnnnnnnnnnnnnnnnnnnnnnnnnatttcatatgattgtatgctcgaagaaatgttcagagttacaatcattaaacttcagacttgtttttctcaatgtgtactctatgtacatgatcctaaaaacagcattctgatgagttcctgacaacgttttctcggtcttgcgtgcatgatgatcaatgaaagctctggtgcatcccgctcgcgaaagcgaaaggcagaaggagaaagccggaagaaacatgggaggacaggagatgatcgtggaggcgggagacagcgtcacgctgcaattcccggtcacggagattgttggcggcgacgaatctaaggtgaacaacgccatcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30652 - DNA, 10335 bp, Oryza sativa
aaaagaaagaagaggattatttttaatttttttctttttaataacatttgtcaattgttgttgttgtttaataattatttccggtgctctgaaaattcaagtaaaatttgagggctccttttagacaaaggagaatttacaaaaattctccgggccacatttgaatttttttcttgtacgtattttaatgtttgccaatttcttttcgaatttttaattaattctattattccttttagcgaatgaattttaattttgggatgaatttatcaggacgtgacaaatccaccccccttacaagaatctcgtccccgagattcgaggaggctagcaagaagttaggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatagggcttcagttccagaactttgcatagttcatatctttggagtcaacctcatacaagttacccacttcatgtcatgcgtcgagatcagctcgtcattactaagataccatgcttgtcatcatttagcattcaaagtattcccttacacattcagccctgacgtattctttttagatttctcttatcaatcacctttcgacctacttcttggttcgataataaacacctttgctggtatcttctatcaatcacctcgtaaactttgtcaaccaagtactcttcactccgagagttgtggatgcttctggtgacgatgaggtcctttggcttgctgcctttcagtgaaacccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatcagcatcttccaaaataatcctctttagaacttgtttttatcacacatgtctcccttattacacgaatacacggcactaccttaaacaaaaagggaagatgcttaacatcggtacattgtttatactatgggttagaattaacatgaggcctcacaggtacggcgtttgctccagtgaccacaaggcgagtgactcgtcttcttcttgcataatggccggagtgatggcgcaggttacgcttcggctgtggacaatctctagagaaatgacctggttctttgcagttgtaacaaatcaacgtcttctttactgagctgtccatctggggacgatcattgtgacttggagttggaattggtggttggaaatccttgctaacattggcatcagtggtaccatagttgctatcaccattggagtctttctcagagtcaaaattgctaaggttgtcattctggtttccaacattgatactatcgttgacatcttggtgaatgctactgacattgcacgctttattcgagtggtcactaatggggcaagaaccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaaatactggatgttgacaattctttctttgcagttcggtcttcgattatgctcactttcgagtttcatggttttgtccacaaggttctcaaaatcttcataatcctctagaagtagttgcactgcaagctcatcttttaacccctggagaaacttctcttgtttgtcttcatccgtttccacatcttctggtgcatagtgagccaaacgatagaattcatgcaggtactctgtgacggtcaaatctccttgcttcaggtagcgaaactcttgttttcttagtgtgaccattcctgcgggaacatgtgatctcttgaatacagatgaaaactcgttccaggtgatggtatgtccttctggccgtgatgcttcgtagctataccaccactctgaagccggtccaaccaactgatgagctgcgaagccaacccgctcctggtcggtgcactgaatcaaccctagcttcttctcgattgtgcgcaaccaatcactggcttccataggatcgacggcaatggcaaaggttggaggccccgttttgagaaattccgataacttgcactgttgctggactgtaggtacttgaacgttggttgcccctgctgggttgttccgattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtattatccatctgtcacaaggtagaggttgagagggaaagcatacaaggaaagaatagaccagagctagggacaggaccttaaaggaactaactctttttgttgatgtgttgtttgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatctatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcatcaggcctgacaatcaaaaataaacagcagcggactagcggacctacggctccatcttcacaggcgctcaactggggtataagccaggactccacctaagacatcttctccaaagcttctcttactgaagagggaaaagattgagcaagaatgagtacgaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataatccgacaattccatagtgtccagatgatatgagaattcccaaagtctaaagttataaaaccacctaatgttgtcctatttaatcagcgaagcatctacctaaattcatactagtggaaccatgaatagagcacccactagttggggtttttattttcctagggtgaacaaggtaataataacaataacaataataaggtcataacaaaggtaattaggcatggctagataaaacagtgataacgcgggaatttaaataaagcggtaatgcaataatttaaatcaacataattttacaaactgggattcaatatgttcaaggatgatgtgacttgccttgctcagagagaacggacttccgaaccttcggcgacgaccacgaaccacgcttcgggaacttccgggacgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaggtttaatgctgttatatggagatttgcggattattataattaagctttgcaattataaaacatgtgtaagcgctagcctggaaaagacaggaaggctgcgccgttgacatgcggaccccacatgtcaacagaagggaccgcggtagaccgagtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgatcgcacaacgggtacggggcgacaccgaaaggacgagggcggggaagcgagaagacggatccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgtagcgactcgcttgacgaacgcggacgacggacgagaacggcttgacggagggacgaacgccacaacgatcgggaacgacgagaggacgggggcgacgacgaccggggccggcgaggaggcgacgaggacagccggcggcggctgcacggggacgaggacgacgagggacacgccgctacgatgacgatgacggaggcggcgccgcgagacgacgagccgggcgagagggaacggtgaagacgacgacggacaccggcggtgttcggtcggaggggaggcgaggccgaggacgacgtcgcggctgcgatgccgaagatgatgggggtgtggccgaccggtgcacggcgtggagggacgggcggccgaacaactccggcgaggcggatggaggggctcgcggcgatggcgttccggcgaaaccgaggagtggacgaggtggagggctacgccaccacgcaagggagagatggcagcgccggctgatgcacgggcgcggcggaagggggctgccggaggagatgtcgacgaggaggaaggtgagaccggcgcgggcaacggcgttccggcgatattcgggcgacgccgtggcttggccgggaaagaggacggcactccggtgccgggaaaggtgatggcgacgtcggccggcgctccggggacgcggcagaggcggccggaggcgaaatcgtggcggcaacaccacggttgccggcggggaggcactcccggaggtcacctcgcgaaacggagggcaagccggggtggaggaggtggcggcgacgctggaggaggcgacggcgcggccggccggcgcacggtcgaggcggcaccggcggctggagacggccggcggcaagggagagagaggaggacggcggggagaggtgctgcggccgtgggggagctcgggaaggggctaaaacgagagaacgcacggagggggttgcattttataggatgggggagggagccgggcacgggagagggcggaacggcgacgggaatggcggccggcggcaatggagggcggccgaggaagacgcgggcgttcccggcgattgggggcgccattcaagggggaaattagggggaattgaagaggagtcaatggggattaaaaccccccaattaatttcggaatccatggtttgatttgcgcggatttggaggaggaacggagtagggttcgcacgggagggagagaaggccgtgcgggaggaggaagaaggcgacggcgccctggcgcgtgggccccaccggtcaggcggcggcgtcagcgcgcgcacgcgcgcggcacgtgcgggaggggagcggctcgggggctggggcggcttgggccgagcggccggcccaagaggagaggaggggaggcggcatgggccgagcaggccgggagggaagagggggggggaaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttttctttttaataaactttgtcaattgttgttgttgtttaataattatttccggtgctctgaaaattcaagtaaaatttgagggctccttttagaccaaggagaatttaacaaaaattctccgggccacatttgaatttttttcttgtacgtattttaatgtttgccaatttcttttcgaatttttaattaattctattattccttttagcgaatgaattttaattttgggatgaatttatcagggcgtgacataaattaagtggataaatcgtaataagcaaatatatggacttataattaataaaaattccaatagtcatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctctagtcaattataattagcatatgaatgatagtaaattaaatgttaaaaactctaactaacatatgaaattgccacttgcgtgatttaaaacttttaaaaatcctctagtcaattataattagcatatgaatgctagtaaattaaatgttaaaaactctaattaacatacatatgaaattgccacctatgtgatttaaaacttttaaaaatggtaagtatcacatataactagcatatacatgatttaaacttgttgaaacctctaataatcgtgcataattaacatatgccatacatcaattgatttatatggataatcaatacatccaaaatagtttacatcgtgtacacaataattacggcattacatcggcggtgacggttcactgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgatgttttggttcgtgctcttcatgtcttgggctctcgtgtagaatgtgtacccattgatctcatatccctggaatgtcgcgatcgacccagacggtcccctcgccaggaaggcaaattgttggttgatcgactcgttacccatgagatgttgtcgtagccacgcgaggaaagtatcaatgtgatgtcgtgtaatccatgcatcggacttaccgatgttcctggcgcgaactaaagccaagtgctcctcgatgtaaggagctaccaatgaagagtgttgcagaacagtgaaatgggctttacgaaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatactttttcagaacgcccatgtacctctcgaaagaaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgactttctgcgaaattacgttcaagaatgcacatagctttgttattgttgcccgaacattgtctggaaggataccccttattataactggtagcagttgtgtcatcaacacgtgacagtcatgagactttaggtttgggaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttatgcaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtgtcatccatacagtgagtgcaagccttgtaccccttgttggactgtccggataggttgctaagtgcaggccaatcgttgatggttacgaacagcagcgctcgtatgttaaactcctcctgtttgtcctcgtcccacacggggacaccttccttcttctacaactgtttaagatcttcgaccagtggtcttaggtacacgtcgatgtcgttaccacgttgcttggggccttgaataataatcggcatcattatgtacttcctcttcatgcatagccagggggggaggttgtagatacacatcataacgggccaagtgctatggcc

SEQ ID NO: 30653 - DNA, 8156 bp, Oryza sativa
  unsure (1)..(8156): unsure at all n locations
gcgccgccgtcatccgtcgccgctttccgcgcctccggttgccgtcgccggcgaccgtgcgtgcgcgccaccgccctcgccataaccggtcggccggtttgaggccgagccgagccgaccgggcgtctcctcctccccatgagccgccgctcggtggggcccgcttgccagccgcccctctctctccttgagtcactgacccgcgggtcccgcgtgtcggcgccacccctccttgtgctgacgtcagccctggggcaatattgcgcaataaattgattaagggtttttcttttatagtaaaaacacagagaatcttctaaaaatcataactaattcatccgagctccgattaagtccattcaagtctcagtaaattcataaaaatgtatagaatccattaaaaatggttttgcttcctgtttcagtagtcttatagcatgttttgcttgtgtgctttgtttgtcgcgtagatttcggtcgtttcgtcgattcgcggtttcttgaagacgttgctgtggcctcatcagtgcgagagcaaggcaagtcatacattgcaattgatcatattgtacccaatttacaaatgtcccgcatttctattaaatattgcattgttttacaatatcatgtgggatgggtcctattactcagctatatgttgtttcccttacgccattaataacttgggtattaaaatgactagatgttggtttaggagatgcttagccatgcttagttcaactagtgcacaaagggggatcacattaaagcatagacttgattattggcatagctttgatttagtgccaccgtaatggtgtgggttaattaaaatacacatcatggtgggctgtgggtgcatggtcttgctagtcgcacccatggcatttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggcgtccggttgatcggcttccggattcaccgcggcatgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgtcgcaacgtggtgtaacgttggacagtgattggttaatatggattaattactgcaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagcgttgaagtccttctcagttgaagatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggtgtgacaagttggtatcagagccgaccttgaccgtaggtcaagccaaatggaaaccctaagagctctcttaaaccttttcatctgcatatgctttttgcacttggatttgtttcgggaaaaatttggggttttgcctcttttgattttgggagaaaatcttggtcgcttatttaatcggatctcttgactagggacagtccaaggttttagcaaaactttatttggaatttatttggcagccagtcgggaattgttaggtggtatgcattaagttgtgtttagattcgatgggatgcagtctttatgcgcatcattattatcatgcatttatatcatacattaagttattgtttagtcagttgcattagtgtcttttgtctgggttcatgaaaaatgttctatgcataaaaatcatcatgcttggctagttgtttgggccatttgttgctttgtttaaatttggatttgagcatgcattgattcctatcccttgtctaccttagaagtcagacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacagccttaattaggaattgtgtgcctctttttcagtgttttaatcaagattaagataatggcacttaatttcataagaaagattagtttccgagccatctgttttcttcctttctcttatttctacctatcccctccagatggtgaagacaaggaatgatctccgtgactccaacggcgccagtggcagcgaagagcagacagatgaagctcataccagtggtgcacctggtagcagttcatctccgccgcccgagaacccaacagtcactcagatgatgacaatgatgatgcaacagatgcagcaacattaccatcaaatgttgcagcaggtgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcacagattcctgaagggattatggcacaacagaagagagagagttccgtgcattgcaacaaggaaccagaacggttacagagtacctgcacgagttcaaccgcctcgcgcgctacgctcccgaggacgtgcgcaccgatggtgagaagcaggagaagtttttgtttgggctcgatgatgaattgaccaaccaactaatctccggagtctatgaggactttgagaagcttgtggacaaggctatccgccaggaagacagctggaccgaaaaagaaagacagctcagatcagctttcctcaggggaacaatcagaagcctcgtttcatgacgggacagctaggtgggccttccaccctgatcgtctgtcagcaccgtccctatcgcccgagtaacttcaacaactattacaatggtggcagtcacaacaatagtaagcagcacaaccacaactcgactccacccccactaatggcaccagctcagtcagatccgccagctgtgtcagctcagtcagaacagcccaagaagggggctgtaggaaagccaggaccctgcttcaactgtggcaagcacggccactttgctagcaagtgtccgaagctgaatcgcactggacccaggttcatccaggcccacgccaatcatgtgtctgcaatggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgacatgaggacagcacattattgcccctcggtgactatagagatcagaagatcaccgtttctatccaacctcatccttctcgaatctaaagacctagatgtcgttctcggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacagttatgtcatttggactcaccaatgcaccggctttcttcatgaacttgatgaacaaagtgtttatggagtttcttgacaagtttgtcgtggtgttcattgacgacatacttatctattcaaagtctgaagaacaacatgagcaacatcttcgtctggtactcgagaaattgaaggagcaccagttatatgccaagtttagcaagtgtgacttctggttatcggaggtcaaatttctgggtcacgtcatttctgctcaaggcgtggcagtggatccatcaaatgtggaatcagttaccaagtggaccccaccaaagacagtttctcaaatccggagttttcttggacttgcgggttattaccgtcggttcatcgaaaatttctctaagattgccaagcccatgacacagttgctaaagaaagatgaaaaattcaaatggtcagctgagtgcaaccaaagttttgaagaactcaagaagaagttagtctctgcaccagttctaattttgccagatcagacaaaagacttccaagtctactgtgatgcatctcgccaagggttgggatgtgtgttgatgcaagaaggcagagtggtcgcatacgcttcgcgacagtaacgtccacacgagaccaattatcccactcatgaccttgagttagcagcagtggttcatgctctgaaaatctggcggcactatcttattggcaaccgctgtgaagtatacactgatcacaagagtctgaagtacatcttcactcagcctaacttgaatctccgacagcgaagatggctggagttaattaaagattatgacatggggatacattatcatccaggcaaagcaaatgtggtagcagatgctttgagcagaaaaagctattgcaatgccttatgcactgaagacatgtgtggcaaattgcagcaagatcttgagcacctaaatttgggcatcgtggaacacggatacgttgctgccctagaggcaaggcctacgctcgtggatcaagtcagagcagctcaggtaaatgatcctgaaatagctgagctaaaaaagaatatgagggtcggaaaagcccgagatttccatgaggatgaacatggcacaatctggttgggagaaagattgtgtgtgcctgacgacaaagaactgaaggatctcatactcacagaagctcatcaaactcagtattcaattcatcccggtagtactaaaatgtaccaggacctcaaagagaaattctggtgggtcagcatgagaaaggaaatagccgaattcgtcgcactctgcgatgtttgtcagcgagtcaaagcagaacatcagaggcccgcaggactgctacaaccccttcagatcccggaatggaaatgggaagaaatcggaatggatttcatcactggtttgcccaggacatcgtcagggcatgattcaatttgggtagtcatggatcgcctcacgaaagttgctcattttattccggtgcacactacctatacggggaaaaggttggcagagctgtacttagcaaggatcatgtgtctgcatggggtacctaagaagatagtatctgatcgagggagtcagttcacatcaaaattttggcagaaactgcaagaagaattggggactcgtttgaatttcagcacggcttatcatccgcaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcagatggcaccgtttgaagcattgtacggacgaaagtgccgcacaccacttttctggaatcaaacaggtgagcgccaactgtttgggacagaagtgttaaccgaagcagaggagaaagtcaggaccgtcagggaaagactgcgaatcgcccagtctcggcagaagagttatgctgataatcgccgaagagagcttactttcgaagcaggggattatgtgtaccttcgtgtcactccgctccggggagtacaccggttccaaacgaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagaagccgattcgtatcctcgagaccagtgagagaaggaccagaaacaaggtgatcaggttttgcaaagttcagtggagccaccactcggaagaagaggccacctgggaaagagaagatgaattgaaggccgctcatccgcacctctttgccaactcttccgaatctcggggtcaagattccgtttaaggggggtaggtttgtcacgccctgaagttcccctcccttgctctaaattcataaaataaatcgttcgaagaaattgtttaatttaacctagagatgaatccctaattaataaatgcaaataataatcggaatcggcatgtggaatttttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttctttttcttgggcccggcccattttctcccgcgccggcccgctcctccctcctactcccgaagttcacccggcctccttctccctctcgggcgctgacaggtggggcccacctgtcagccctttccctaacctctgggcgcccacgcccgcgccaaccgccgccgaaaccaccacccatcgcccgccgcctcccccggctttccgcgccccgggccacgtcgcccactttcccgcacgccccgcccttcccgcgcccacgccccactcccgctcacccccgcgcccgcgagatggccgggattcgatttgaatcccgcctctctctctctctcctcctccacctcctccactactccggcgaaattgcgtcgttcccggccacgactcgccgcccccctcctatttaagcacgcccgcaccttcctctctctttttcctttctcggccgagccctcccgagctctccatcgctcccgcgcctctcatcccgccatccgccgctcgccgccaagctccggccgcactccgccaccgctagagccgtcgccgcaccgcgccgtcgacgccgccgggttcgnnnnnnnnnnnnnnnnnnnnnnnnnnnnnnnnnnnnnnnnnnnnnnnnnnnnnnnnnnnnnnnnnnnnnnn

SEQ ID NO: 30654 - DNA, 1560 bp, Oryza sativa
  unsure (1)..(1560): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnntgctgaatgtataaaaacaaataaacaaaaatggagaaaagagatagaattagaatcagatgaaaggatattatctagtagagtacgagttttagaaaacagaataaataaattagaagtagaactagagaacataaaaattaactatgatattaaggcattaccagaaaataaggatatacaaaataccgaatttaaagagcaagtgatgacattaaaagacagtaatactgctaaaataattcaactaaaagatgccataactaattttggaaataaatatatagtaaaattgcctttcaaagaaattttgggagtaagaatactggtaaaggtaaaattatcacccaaggtatcatataaaattttagcactcgtagacactgggtgtacaaaaaatattattcatgataagtacttcataaaatgtccagagatagttcatacaattgatgataataatgcagaagtctctacagacatgtccggaataaagaaaattcataatcagttagcttataatgttgaagtatacattaatggaactaaatatataatagatgagattacaataagaaacttatccatgataagtgatgccatgataattggcctaaggtttttacaacaatcggtacaaaccacagtaatacatgagcaaggaattacttttatcccatgtcaaaacaatgtgccatatatctcagaggtacgaaagcgtggtggaaccagaatcaaacccgacaaccttgaagcactcagccttgagtctgaagaatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatcacacacaacacaatggagagatatcctttagaatctcacacacaagtggaaaaaatgaattaagaaggtttcttggaggctgggttgaattaaggctcctactgtcctccacatactacattatgcatgaccgacacacacacatacatactccatccatctacttttgatagtcatatttctaaatctgaaaaa

SEQ ID NO: 30655 - DNA, 1693 bp, Oryza sativa
gtcatctattaaaaaacagagggagtattatattatatttccttcatcaatcttaatataaactaaagcaactataattatgtactccctccgtcctaaaatataagcatttttccgactctgagacagtctctgagatataactctaaaatataagctttttcgattctgcgacggtctccgagatataactttgaccaccaatatatatatgaataatatgttttaaataaaaagagttatatattatgatagtttttgtttattgataaatctaataacatcaattttaaatgattgatctttttaattttattttttttctattgatagtcaaaattaatgatgtttgactcgttactatttaaaaatgcttatattttgggatatgggagtaactattttgagacagaggtggcacctaactacccattgatgtgacaggctgtgagtgaatgttgttttttttatagctaccactaattaattaatggttttttgaagtacgtttatagcactactctttgatttcaatctaacctattcaaccaagatgggccttcatatatcttgctcgtctgatcgctctatttatatatatcctgaccacacacacaactcccgatcgagaaccctaagcgaccaagcagccggggcgccaattgattttgcttagatatatagctgcatcgcgatgatgatcaacgcatcaggcgagggcgcgaaatagctagagatcgagacggagatgggtgagccccacatccttattccgctaaagtagctaagctgtacataagtccattacattatttgaaattaaaccgtgcattacatcaataattcttgaaaaaggaatggcaatgttgtatttttgtatattatcagaaggatttcactaaagatgaaattacaactggcctctacatcaactaggtatacacaaagcctagacaaaacaaactgattcaaacatgaagatatcatgtagttttacaccaacacactcaaatagaatcaaaacaataacataaagtcataaatatcatctccgaaaacaacacttataatatattgacgtgtaatctttttcgcgttcggaaaaaaaacacttttaaggacttgtaagcaccacgtgggacaaagactaatcaaacaagcatcgtgttagctgaaagccggcctaatactactaagggacataatttgtactaattgtggatgttgagggacaatggttttacaattgagagaggcggattaatctctccccctatttgagggacgtagagtgaaccttttaccattgataactatccagatgggtgggccgaattgggccgcagtgatggtgccggtgtaccgggcactctatcggtggcacggcacggcggcgtggatgatgccgggggacgtgaacgcgatgatcggctggctgtttggtgggccgcggaatgcagcggcagcaggtgccaggccggtcgccaccggggggggggaatttaactattcgccacttttaggtttgccaattatccaaatgcccctcttaggtttgcacttaataatttgccactgaagagaggtaattttttaattatttgccacttttgcctacgtggcgtgccacccgtgcgtgccagcgtggaaaggaccccacccgtcagccctcttctcaccttcttctctacct

SEQ ID NO: 30656 - DNA, 5566 bp, Oryza sativa
ggcaaaagtggcaaatagttaagaaattacctctctcaagtggcaaattattaagtacaaatctaagaggggcatttggataattggcagatctaaaagtggcaaatagttaatttccccgccaccgggacactatagtccttggagaaattggcccacaaacagttggacggtctaagtttaaagcccaagtacgtcacttgtatggcctaaatagtttgcaattatatatccttgcgatattttagtttattataataaaaaaattaatttcttaagagacattttgatcacaatatgaagagattttatttgggggcatctaggaatcgggcgcccgattcccaggtgcagtagactcgaatcctcctcctcccatgcgccaatcaaaaatcaactaagtaaagccactgctatgcccagccggaacaagatatttctacgtcagagggacgtccgtgccggatcgtcgtccgtttcacatccgacggtagcatcattttcagaccgtgctcctccatcgaccatcgtctccgtccagttgcagaccaagggaaaaaacgaggttccgctcgtccgcccgccatggccacgatgtcggcgaggcgcttctccgtggatgccatgaccaggcagcagaggttgacggagctgagtacgacgagcagccagtagaagcagtcgagcctcccgtcatcgaggttatcaacgagctagccgccgtcagcgccatggccggtgaaggtgatcttgtgcacgatgatgatgagcagcgtgctgaagaacaagctgatggcgcacatgctcaggaacagactcgtgttcatggtcttcatccctttggagtttggatcctcgcggaggaagacgttgaggagcatgtaggtgaaccgtgaacgcttcgccaaagctgacaggagaaactggggcatcagcaggagcacggcgctgtgcgacgacgatgatgtcagccggtgccacaacggccaagcgggtgatggagagaaagaggccacaaacacgcttggagctggggcttgccaacgtcgtggctatggcggacgagcggaacaccagcggtgttttcccctcgcttggtctgcaactggacggagacgacagaggtgcatgggctggaaaacgatgctaccgtcggatgtaaaacggacgacgatccggcacggacgtccctctgacgtagaaatatttgtacgtccctctgacgtaaaaatagtttaaaacaaactttaaactatttttttcttaaattatttaccaattcacaatccaatttcaccactaaatttgttgcaattaaatctttaaaacaagactacacatggctataattcaatgaaaaaaatatttagctttattaatgaattgtttttaatgttgcacctatatcatttaaatgtttcatgtagtattcatatgatgtttcactttttaatttgtaaatgttgcacatgttgttctaggaatgtttcagcatgtactttataatgttttaataattatagttccaccaagtagtaaaatgaccaatgaagttgtttacatagtttaaatagtttgaggtgtcgatataactggttttgtgggataggaatcagatctgacatatatttgagggagacaaattatactcctccggttgataaagatccagattggtggggaattttttgtatttttagatttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaggagaaggggaggagaagaaaagaagaggcgaagccctgccagtttcaaacttcgatttcaggtaatattcgtagattatatacgtgactaaatatatgataaatgcattgtatgaaataaagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctataaaaaaatggttgatgcggggcttgggagttgatccacagactagtgacattacaatctatgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatagtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaagaggctatgcaatcagaaccaggagaaaaaattcaatgagctttggaagagattagatgagttgacaggcaaatgtagtgaccagcgtgcaacaagaccagcggccgctgtacctgaccctcctcaagcactcggagctctcccaacagacagtgtaacattggttagaagaactggggagcaaattcgaaaattttctcagtggattgagaatgagccaaaagagaaatgggctaagacttatgacacaggtggtgctagatatggtataatgacaacaaatttggcggaagtttacaactgggtgatgcgcggtgtccgtggactcccactagttggtatagtggagttcattttacatgggacatgcaagtatttcagggagcggttccaagcagtttttccctctatgccgaacaacaacattttatttggaactttcatggagaaaaaactagcggagtggcgtgcaaaggccatgaaacatccgagctctagtgcaaggtacccaacaacacaggtttgaggtactctgccaagacaaggcaggcaggggtatctaccgcaagagagtaaagcaggagtgcgttctcaaagacgacggcacatgtcactgctcctgtagaaagccgacgctgctccacaggccatgcacccatgtcatttccgcggcatctgagtgtggcatccaagatgcagtatatgtgtcacaatacttctccaagcaagcaatatatcacacatggagtggcgagatttttggcttcggtgtagctggggagttcacaaagattaacgatctgataatctatattcctgacccaacgaaactccgagacaaggcgggacggaggaagactcggcgcatccgcaacgatatggatgagtcggaggcaggcagggtgaagcggtgcagcaaatgcgatgaacgtggccacacctacaagtattgtcctaaagacaaggaaaaaccaagtgcggcggaggcaggtctatcaggatcagcagcagatggagctcgccctacgggtgaaggcactacttcaaggcgaccccgtcctagacgttctcgtggaacgaccggttacgtggtgtagttcgtgtgttgtatgttggcaaaaggctttgcttgtaatttcgttcgaacttatcgatatgttcgcattgtgttgtgttgcgaaccacttgttagacttccgcatgtaatgtctttatgttttacggcttgtaattttgttttatgttatttcattctcggtacgtgcctttgtgtaacgaaagttatgttctcaataatctgcactcttgcatgtctctataagtattcttccgtttcagataacttgtttttacaattatattattaccttcttatttaccctaacatgtaacacgttacttgcagagatggcacatcctgagttgttggatccggcgatagatcagcgccaccggtcgtaccttactggggtggagggggctcagcttgggacgttccgtccacggtcgtcacgtgagcgacttttggttcacgactccttcgtcgagaggtatggttttactgtgttcacgacaccgggcttaccttacta

SEQ ID NO: 30657 - DNA, 8146 bp, Oryza sativa
cgcacccgtgcagcgcctaccaggtctaccgctcgagccgttgcagcagtaccgcaacaccgggcctaccaagaggtggctgcttcagttcactgtaagttctttctacctaaactgacgtgtattatgtacgtaacttgtaaagtgcctaacatttcatccaacacttgcaggttgaccagctaccggaggaggccgacgagtactccttcagccgttgtttggaggcgtacttgttgtggctttttgggtgggtgatgttctgtggtagtcacggacactcggtcgaccggggtctcgtgcactacgccaggagcattgccgacgccgcggtcggtgaggtgcctcagtggagttggggctccgcgttgctggcggctcaataccgtggcctctgcgaggcttgtaccaggacggaccctggcgcgatcttcggtgggtgccctctcttcatttctctttgggcggctgagaggattgcgatcggccgcccccttgtggagcaccacccttacgacgcgtcgctgtacgagaacagaccggcggtcgactacccaacgatgggtactctgtggtgccggcgtcaggtacgtcgctagtatttggtaatgttgtcctactattgttaacttcatcctacgtcacactgaccttattgtattgcagcgccgatgggctcacgtgcaggttaggcggtcgtacgcggaatttgtgatggagttcgaccgccttctgccgacggacgtagtgtgggagccctacagtgccttgcttacccacagtcgggcgccgctaggcctgtccacactctgcacgagggaccaggcgtactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgttttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagccacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcaccatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcacgcagacgcagcaccacaggtgcgtccccgaccgactgctcctcgtccagctgcgcacgttcctacgccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctgcgcagttctggcaggacgccgggacttcgtcacagccgcccggcacgtcttggcagggtcctaccgggacttcgtccgagcacgggtgggcttccgccacgcacttcgacattagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctacacttcgctgttacgttttccaaaaacaggagtcctttccagccgttgtgcagagaggaagctgccgcccttgcagagggcggcaagccctcggctccccgcggcccgtgcgcgccgtcaagacgcacacggcgccgtgtgccacgtcggcttgccgcccttgcgaagggcggcagggtctagttttgcaaattttttcggcgctataatatttctgtaaatattaaaaaaaaaaaattaaaacaaaaaaaaactcgatggtgggccgaattgggtcgctatcgatccaaattgtagtgggcctcaaaggacttgggccagtttcgtcgaaatggaccagatcctttgtgtgcatggttggacgctgcaatgtttagcttttatcagaaccacacgatttcaatccaacgatgcggatggaagttcgcgagcaccacttctaggagatggagccaggagggtccatccaatagtcttgtactgaatttgaatttgtcccattttgatttgcacaaatttgaagcgattgaatttcgtcgatcgatcgagaggaggattttacagtggaagggttttccagccgggcttacacacgatgaaagtccacgaaccaaacacaaaacaccttcttgattaattaattacgatgaattcgtttgattaattagctaggaaatggtgcgtccgccgtcgacgccgacgacctggccggtgatgtaggaggccgccggcatgcagaggaacgccaccgtggccgccacctcctccggctccgccagccgccgcatcggcagccggtccatctcgctcttgatcagctccgggtctatcgtctcctgctccatccatccatccaaattaatcaatcaaaatcaatgatgtgattaatcacactaactgtacaattaatcatgcactaattgcatatgagtaactgagctggagatcaattgacgtggtatatactcccctatttaagattttagattataagtagttttgattttggtaaaaatcaaaatgctttaagtttaaccaagtttatagaaaaaaaacagttacatttacatcccaagataaatatattgtaaaaatatatttaattacaaatttaatgaaacttatttggtgttgtaaatatcattatatttgtctacaaacatggttaaatttgaagtaattttgctttgactaaagtcaaaacgattcctagtctgaaacgaatgggagtatttagcttacgtcttggcagatatcagtcttgacgcctcccggcgcgacgcagttgacacgaatgccgtcgccggcccactcggcggcgaggctccgcgtgagctggttcatgccgcccttggtcatggagtacacggccagcgccggcatgccgacgctgccggcgacggaggagatgttcaccacgcagccgcctccgccgccgcgggcgccgccggcggcgagcaggagcgggtgcgcgagctgggagaggtggaagcaggactcgaggttggtggccacgagcacggggaagtcctcgccggagcacgccgccgccgcccggaacatggtccggccgacgttgttgacgaggatgtccagcctgccgccgaactccgccgccgccgcggcgaccagcctctcccggtcgccgcgcgcggagacgtcgcagacggtggcggtgacgcggagcccccgctcctcccaccgccgccggctcgcctccagctccgccgcgttccgggcgcacgtgtgcacgcgcgccccgaatccggcgagctcctccactatcgcatgcctatacggtcgaacacgtatacgtaggtatatacagtcgtattatactcgtatatatacggtgatgtgtatatatatacccgatgcctttgctgccgccggtgacgagcgccgtcgcgccggcgagggtccaccggtaggggatgctgcgagctgcggcggccgccatgatcgatcgagcttggtgttttctctctctatgccggtgtagctgagtgctttgggatgaatggattgtagacgcatatccgtatacatatttatactagtagctcgcacgtatagtagctttaattaactaaagcggtgcacaactggtcgtcgttgaaatttgattacaataaacatatacttgttccttcgttttatattattagtcatttcgatttttcttagtagttttaaaaaaagtaaagcgacactatttttcagaaaaaaaacatattatcaaaatatattcaatgttataaataaaactaattaatttggctaattaacttggtgttataaatgatatcaaatttttgtaaaaacttatttaatctaaataaatttgacttaaaaaatcaaaataatgtatagtataaaaccaaggaatatataagctagtagttgttcatctgatggccggatacgtggggatcatatgcagcacaagaaggcggcgaccggccggccgccggccaacacgatcgccggccggtgcatcccaagcggcgaccggccggcatgccggggtataattaaactggaggagtatatacttgattcaaatatttattatcgcatatatagaaaatataaagtgatatattcgtatacatgcatgcggtgcactaccgtcgtcgtcgttgagctatcatgctcacgtgtcatttcttgtcaactatagctcccatctataatctcatgatctcatctaaaatatatttatatccgtgtagctagcgtatgtatttttctacccatctactccctccgtttaattaggaatgtaaggtgttttgggttttttttcactaagttaaactatttcatatttaaccaagtttatggaaaaacatgacacctataacatcaaactaatttcatctgatatactgttaaatatatttttataattaattcatttgtccgatattaaaaatgttgctatattagttatagatttggtcaaatttaatgaaatttgacttagagaaaaactaaatcaccttacgttacgaaaaaaagataaattcatttgtcttcacttttgccgggtttgttctagctaactagaaaaaaaaaacatgcatgttaaccaatggattggaaatttatgtattgctgattatactgtatgagcccagattgtaccggtgtagatatactcaaaatggttaagaaagaaaagattaaaaaagtttccatggcgataaattatgtcctcaaagtttcagatgcatattaattaatatgacctcttgacacagctgacggacactgctaacgagacgacagagaagcgatgcatgtgccggtacatcggccgagatgcctcccgtaaatcatgatctactcatatgcatgcatattcatatattatcatgaccttacgtatgcatatactagggcaacttgtggagttgtggtacaactacctccggtgacaacgctcggattcagaggtatcatcaactacctggtttttcttggggtaaaaatggttgcatagatagctcagctcgctcgggtgtactgatacttgctgttgtttaagaaccgacacctacgtaagattttaggtgtctgttctaacctagcactaatatatactccctccgtcccctaatgtaatggattttgacattttgtttgcactgtttgactattcgtcttattcaaaaaattttggaattattatttattttatttgtgacttactttattatccaaagtactttaagcataacttttcgttgtttatatttgcacaaattttttaaataaaacgagtggtcaaatagtacaagcaaaatgttaaaatcctttatattaagagacagagggagtatatatatggggctgccagcacattttcggaagtatggtgtatgtgacgtacggtccaacagtataaccatcacctatgatcccttatagcggtgtgctgattttagataaggcactaatgactcgggtcattagttctgcatagttgcctagttggtaaccccacactcatatgatttttttgggcctaacattgatatgtagattctacaagaaaaaaaaatacaagtaccacacctacgattaaatctcataaattaattgtgcgctttaccacctacggagatttattattagaaaaatgttagttacatgctcagctgacagtataacctgggatgagctttaccgcttcctgatattaataaaaaaaatataagtaactgtgataagtctattacttaaaattagatagacagtttgcactcgattactacaaagaccctagcttcctacaaatgtactatgattcggtttgtagaatatatatcacgatagacattaatcatcatgaacatcatgttcgggcttgacaggaccaagagctgaccacgaccaatgcaaaaaaataataatgtattggccaaaatgctaataaattaataattaaacacaggaattctagagtaacaacaaaataatatattggccaaggttctaacaaattaataattaaacgcaggaattctagagtaacatatataaattagagcaacagcaagaacggtactaactaaccacgcgctgttatgacttttttaaaaaatatttagtactgatcactagtggcattaatgcgacaaactagtagctcctaaatgtaacaactgagatatatccacatgaaaatccaaattaatttttatatttctctatgcaggggaaatcgcctattagcttctatcaaagccaatttcaaggtttaaatgcaaattatatcgagtatatcagggtcaagaataagagtcctatcgaattttggtagtgagaaagcttgagcaatgcaaaattttggtttgatgataattataatgctgtgagatggttagatatctatcgatatgttttacccaaattttggtcgaacgaggttttaaagaagtgttcttgctaaacacatatatatccgaggagttcaagctactgcttgctttcgtatgctatatatatacctatcgaatttgataatattatttatttggttttcgggagatgaattatttattacatgcaagagaatattattcattataatactttggttgagtttgtttaatttgtttatgacagtggacattatctctgatctagttagagaaaattaacagaaaaccacttctaaagcaacgaaactagtatttatatatatatatatatatatacaccatgagaagttgacatatatagctataataattgatcgtgccgtgcactgagttaattgcttatgtcaatgcatggtcagaatagaaactaagtttagcaaggaacatgtggaaatatgttagtaactaatcagactatgactcaaaatttgatgtaattaagagaaatacttaacagcaagtttaatagtatatatatagtcaagtactagctcttaaaaattaatacgtaatttacaactaatttaatagcatacccatacaacagctacatatcaatatactataccattgatagatggcatatagtatctcattacacacaaagttttagaacatgtgttgtagttgactacaaatctactctcatctcctctctcctctacctaagcatagatctaatgtactccatccgttccaaatttatggattcaaaatttatcatgaaatagttgttattctagagtagtatttataattaatcaacttcgatccattcaattttctccctattctactccaactacgtaccttcttattcccagccatatatacattatttaataagagacatagtttttcttctcaagcttaatatatagtacaaacaatctagaatagtactccctccgtattttaatgtatgac

SEQ ID NO: 30658 - DNA, 5828 bp, Oryza sativa
aacggcgtcatacattaaaatacggagggagcagtaatttttaaagctcgcttacatcatttgatgtattcgctcgaaaatgggaactagcaaaaatatagaatggactgagaatttgctaggctttcccggtcattataaacatcttttaggtcatgcgtgccaatttgatgaatgtatacacaacacatacttgtttactgaaacaatactaatatttttttacagcattctgggaattatttttgatggataataaatgaaatcaacatatctcgatcgtcactgtatgtacacattaaattaattagacaccttttaatcatcatcgtccttggtttgtttacatttgtcctattttatgaaatgtgctgcggtctcaccacaagtctacaactacaatcaccactactggcatttatctgaaaaagcaagacaagaatatataataagaaaataggaagaaaaatcggagttcatggtgtacggatcttctctcttcatcagtttcaggtacggataaattgcatctgaccaaggtgatcacagagagagaaaattaacaaaataataataattaaactaattaagaaggcagagtaaacggttgacttaaattaaaccggtcgttgatttggtatgtcaaagagctactgaatatttgattgcactagctggccaaagcaagaaatatgatagtatgtcggcaagatgaaactgcagttgaacatggacgaacagatttgcttggccgtcctaatctttgggtgcattcatctacccttgcagttaacttgttctaaagaataaatgtacatgtaggcatacatgattagcacacttaattatatatcatagtcttagctaattaatgtatattttccaccattaatcctatctttgacaagcttgagatggacagcaattcttgagaaatgtttggagatatatattgattctttcagaagatactgtggatgcagagacgaaatctttttggtctacggatcatgtatagatgtggcatgccaaccacatggagtggcgattcatccatgtagccaaatttcaagaaaacttgggactcttttaaataagattttgaccaacaaagtcaaatcctgaacacatcctacgtgcaacgaagcggtcaacgagaagatgggcctggactgggccttcagcgtgggctcaaacaaattgctgacacttggcaacaatgggcagtggtgactgtcagttctgtatgttctgcaactgatggaattcagaaaatgacagtattttactcacgaatcaaacacaaataggagtcaaaactaaattataaatgtaattactcttctgttgttggttgttaatctgcttggtgacaatatgcagggtttgtttttttctgcacaagatttggtgatctgcatgttgtgataatatgcagacaagaactgaacagaacaaacaagaagatatgataaaagtgcagtgatccattgcatgctcattaattagtgagtgacatgcttgacattggtatgaaagcgagtacgcatcactaaaattcactaattcctcaagcctcagggcgtactaatgtgttttcatggctgtatgctctcaaaaaaaagttttgctgatgtctaaaattactgcccatgtcaaagttgtttgtttgtttgttcacttcagattgacagagtggaagcagttgtagtaaaaaggaaaaaccatccctgacatgaaggttgaagcaaagtgtaagaacatttaaggcttagttatttttagattactagcaatgtacccgtgggttgcaacaggaaatataattcatttacaatatagaacgagctcctctaccggcgaatcgatggaccgcctttatgagtttggccctgggagtacgagtgcaaaatctagtactccttccattccatttcaggtgcagccatgattttccgtattcaactttaatagtccgtcttacttgaattttttttgaaaaaaattaaaaaaatattatccatatttttatctaataactatacaaatattaatcataaaaaaattcaaataagacagacgatcaaagttagacacggaaactcatggctacatttaaaatgggacggatttgattgcactagctggccaagcaagaaatatgatacagtatgtatgcaggattaaattgcagttgaacatggaagcacagatttgctaggccgtcctactctttgggtgtatcgatccatccttgcgttaacttcttcagaagaattaattaatgtgtatatatatatttatacatgattagcgcactcaattaatatgatagccctaactaatctatatttgcagtattaatcccatcattgacaacctagggtgtgtttgaggagaaggggattggggagatcggggagattgggaagatacgtaaaacgaggtgagccattagcacatgattaattgagtattaactattttaaacttcaaaaatggattaatatgattttttaaagcaactttcctatagaaatttttctgtaaaaaacgcaccgtttagcagtttgggaagtgtgcgcgtggaaaacgagatatttttctctctcaatcccccagattgcccaggaacgaacgaagccctagagatggatgaatcggagtgcaattcttgagatgtataaactatatatatagctcttatatattctttcagaagatactattgttgcagatacgtaatctttttggtctacggatcatacacatatgtatatgatacttggaacatggacattaatccaaatacataagctaaactcttacgtatgtatctgcatcaatagtatcatatggatcatacttcaaagtatcatacggatcatattaatttcaaagaagcttaggatattacgtacgtataattgatccaaatacgcacgccaaatacggatcatgtacagatgtgggctagtaagcaccacgcaggcccaaacaaagtcgtgacgatgggccgatcgaatcaatctgggccgcaaaggccacatcgaacggcgctcagaggcccaagggggttcggcgttgaaaactccgaacgccttcagttgtatgttctgcaaactgatggaattcagcagagtatcgagaaaaagtgatagtattacaattaaacaaaacgaatggtaagaaaagtagtaagtagtcttgtgttgtttggttgttaattagtctgtttggtgacaatatgcaagtatgcaacggtggtttcagtactaagatttgctgatctgcatgttttgatatgcagacaaagtactgaactgaaccacacaggaaacatatgagcaaaaaatgcagagctccagtgcatgagcgcatcagtgacagtgaatgactgaagtaggggggtgaaatcggtctacttcagcaacaacaggaggcccaatagaagtcgctgacacttgcaacaatgggccgatagaatgaaccggaggcccaagggggagtcggggtttaaaggaataagttcatatgaggtcccttaactttacaccgagttcgattttcgtccgtgaatcacaataccagatacaatagatccctcaactgtcaaaaccggtgtagatgaggtccctcagcggtttagatggcggctttgactgatgtggcgctgacgtggctagtttgacttagtcctcatcgtatgtggcggtgacgtggcacttggaagcaaaataaaaggtcggacccacgtgtcagtcattaaaaatagtgggacccaccctgctctctatctcccctgcgccgtcgtccttgtcccttctccctcccggccattcttcatccttcctcgagctccctagccggccggcgagcgcgcgcggagagggagaagggcgccagccatcgggtggggaggccggcgagcgtgcgtagagagggagtaggcggggaggccaacgagcggaacgggtaggccggcgagcgcgcggcggcaggcgagagagcggcggccggagctgcacgacctcgccccccctcctccggcgccgccgcatcgatctgcacgagttacggcgacggcgagctcacagccgcgggacacggtcagcgtggcgctgacgaggcccggaactcgagctcgcagtcgcagccgccgctgcccacttccccaatcccctccatatgcgtcaaagtttttgatattcatggcgttctgctcttgttctggtggattgattgattggtgtgcttgtgcggatgatttgtgcgaaggcgacgcgaagaacgcccacttgatgtctctggacgtcgccgcggagaggctgcggctgttcaaggccgacctgctcgactacggtagcgtggcggcggacatcgccggctgcgatgacgtcttccatgtggcctgccccgtgctcctctccgcccctaacccaggggcacacatatctcttttttcagcaaaataattccttttcttctccattgactggttcaaactgtagactgcagttactgaaaatcgacaaaaatcaacagtttctactaaaaatgatttgtcgaaactgttgatttctcaacaaccagtagtagctgaagtctgcagagttgtaattaaatcgtcatgttcttgtagctaaatgaattgatgttgctgtaggttcatacacttgctgctgctgtaacgggcacgacgaatgtgcggaaggcttgttcagaagaaaggttgggacttgggaggtttgtggtggtgtcatatgtctctgctgcaatggtaaatcccaactggcctgaaggcaaggctatagatgaagattgcaactcgtgcagatcgatgcggcggcgcagcaggagtcttcgtcggcagcggggccgaggtcgtgcagctccggccgccgctccttcctctcccgtcgtgcgcacgccggcctaccctccccgcccgatggctggcgccctccgcacttctccctaccggcgcccttctccctctccgcgcgctcgccggccagcaaggcagctcgaggaaggatgaagaatggctgggagggagaagggaaaggacgacggcacggtggagatagagagcagggtgggacccactgacatgtgggtccactattttttagactgacacatgggacccaccttttattttgcttccaaataccacgtcaccgccacataggaccaggattaagtcaaactagccacgtcagcgccacattagttaaaaccgccatctaaaccgctgagggacctcatctacaccggttttgatagttgagagacccattgcatctggtattgtgattcagggacaaatatcgaactcagtgtaaagttaagggaccttagatgaacttattccgggtttaaaactccaaacccctttgctggtagcaagcgcgccaccacggccgtacgtccccatgcctagcgccggccgacagcgcggcggcgcgccggcgatggatacatcagtggcacggcggtgcgtggcggcgattgtgctggcgtcggtggtgactggtgagcagtggatggaatggaaggcatggacatgttgtttatgaatttctggactgaagcatccagaacgcagtgtttacacccaaatttggcacttaggattaaaataggaaatattgctaaaatttggaagtctaccggtttcctccgaggtaggccggtctgaccgccgtgtgttgggcggtcagaccgccggttgagggccggtcagaccggcggtgtgtggccggtctgaccggcaggtccgtgtgctatcctgtttcgttggatttcgaggtttccttgctggg

SEQ ID NO: 30659 - DNA, 14222 bp, Oryza sativa
  unsure (1)..(14222): unsure at all n locations
agttttctcttagtttgtccatctttgtctgtttgcgccgtaaaccgtccgccgccgctgcgagagtgcgacatctctttgtaggtttgtcctgaaaaccttccgttttgcccacgagacgggtagctatctagaaatcggttccactagccgatttagttatcaaattccatctaggtttagctctttgctagatcgaggtggttggcgactctaggattaccgcaaagcttaagatgctgtgatcgtgcttgtcaacttgttaaaaaagttgccaacacgcagcacttgagttttaggccgccagacctggggaaatgatgcccaggagcaggagaaaggaagcctcgaaacaggagctcatcgaagcagcgctcaccggcctcttccatgctagtatcatcttcatctagcccatcatgttggtccttggacactaggccttcgacgagccatcgcctgaccaagcatgtcctgctgacgctttcttcctctnnnnnnnnnnnnnnnnnnnncaggcagctcttgtagtgcacggacagcttgctgtagcagaaaagcatcactttcttggccacatccgctcattgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccgttaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaatgcctgaacctgtataaatcctttgtctccaaacccatacacttttctaacttgatagccaccccctttcattattgccgaaatctagtttcgacagttggcgcgccaggtaggggtagcgtcaagcttttcgccgatcagtgcaatgggtcctttctccggcatcgacgacctcgtcttcccgcccgggcagacgtttcggttcggcagcctcgacttcatcaccgacaacttcggcaagatttctctcctcgactcggaatcaaaccagtcgggagagaaccggatttcggtcccgtttggattcccgaacgcggctgaaagctacttcaagaccatctcaaccgagtcggcttcaaaccactcggccgagattgcatcttctccaatgacaccagatcaagatgatggggcttacccaccggtcctgatgaagctccccgacgatttagcggccgtctccaccacgacagcgtcttcatcccgcaggcctaggcggaagtcggcttcaacaccgatttcgcctagcttcagggaagtcggcgttatcctccaaccactcggcacggtttcgacggatcagctagatgaccactacagccctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataatgagacggaggagcaacgccaagcccgggagaccgaagagcgtcgccgactggaggaggagcaccaagcacaagaacaagaacggctacggcgtgagcagcaggaccgtgagcggatcgcgaaggaggctgaggaccgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgattaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctctgacatcaccgacgacgtcatcatcgccgcgttcaccaaagggattcgtcacgaagaactagtcggcaagtttgggcgtaaacctcccagaacagtcaagctcatgtttgaaaaagccaacgagtacgccaaagccgaagacgccgtcaccgcatcgaagcaatcgggtcccagttggaaaccgaaaaatacgccggccacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggatgacggcgacaccccggctggttttcaagatcaccgcaaggagctcaaccatatctttggcggccccctagcttatgaatctaaacggaagcagaagttaactgaacgggagatcaacgctgttcagcccgacacgccccagtatcttcgatggtcagagattgcaatcaagtttgaccgctcggatcatcccgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagttaaaatcaagcaatgcgccttttcatggagtaattccaggattatccgcaactccactcggccagatcactcttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctgaccctacggagcgacatcaagcaagctgtcacatgcgacaaggagagttgcgacatggcccaaacccgcgagatagcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagttgttagcagcaggcttcatcaaagaagtccttcatcccgactggctggcaaacccggttctagttcggaagaaaacagggcaatggcgcatgtgtgttgattacactgacctcaacaagtcctgccctaaagatccttttgggttgcctcgcattgaccaggtagttgactcaaccgccggctgcgagcttcttagttttctggattgctactcggggtatcatcagatccgactgaaggaatccgaatccgactgcttgaagacttcattcatcacgccttttggggcatactgctacgtcaccatgccgtttggattaaaaaacgcaggagcaacctatcagcgcatgatccagagatgcttttcaacacagatcggccgcaacgttgaagcctatgtggatgacgtagtcgtcaagaccaagcaaaaggatgatctgatcttggatctagaagaaaccttcgcgagcatccgcgccttcaggatgaaattaaaccctgaaaagtgcaccttcggagtaccgtcagggaagctgcttggttttatggtgtctcataggggcgtccaagccaacccggagaaagttaccgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatctcaaacaactcctcaccaagccgccggtcttagcttcaccacacccgcaggagccgttgttgctgtatgtatcagccacctcccaggtcgtgagcacagtcttggttgtcgaacgtgaggaagaaggccatgtccagaaagttcagcgaccaatctacttcgtcagcgaggtcctggccgactccaaagcgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagccggagtggttttaatttccccgactggagaaagactaagttatgtgctttggatacatttttcggcgtctcataacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagccgccgacagacttgccaattttggatccaagcgcgagacggcgccctcagatgttttcgtcgaacacctttatacaccgaccgtacctcataaagataccactcaagatgcagacactcgtgacatagctatggttgaagccgactggcgagagcccttcatacgatttttaacttctcaagagctccctcaagacaaagatgaagccgagcggatttcaaggcggagcaaactttacgttttgcacgaatctgagttatacaagaaaagcccttcaggaattctgcaacgctgcgtttctttagaggaagggagacaattgctgaaagacatacattctgggatatgcggaaaccatgcggctgcgcgcaccattgtcggcaaagcttaccgccagggttttttctggcctactgcagtgtccgacgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttacacgcatctctttgtggcctttgataaattttccaagtggattgaagctaaaccggttgtcacaatcacagcagataatgctcgcgacttcttcatccacattgtgcatagatttggagtgcccaatcggataatcactgataatggcacacaattcactggcggagtttttaaagacttttgtgaggactttggaatcaagatttgctatgcctccgtggcacaccccatgagcaatggacaggtggagcgagccaatggcatgatacttcaagggattaaagcacgtgtttttgaccggttaaaaccctatgccggcaaatgggtgcaacagttgccatcagtactttggtctttgcgaactacacccagtcgagccacaggccagtcaccttttttccttgtctatggggcagaagcaatgttgccgagtgaagttgaattcgaatctttgcgcttccgtaatttccgtgaagaacgctatgaagatgaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccgtttattatctctgaagttacccggccaggttcatatcgactcaagcgcgaagacggcactctcgtcgacaactcttggaacattgaacatcttcgtcgtttctacgcttaactttatcattgtatttccctattttgactgtcaaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaaacttagcaaaaacttttaagaaatcaaaaactttgcaagaatcatcaagcacagcataaatacaccagtattgtacaaattgagcctccatatattacatttacactcagtcagaatcagtcctttcatcatcagagtcatcattactcggctggaggtcgttgttgcgaaattgctctacaacatcactcgcaattttgtcagccgcagtttgcgcactgctgataagatcaagggcggcttcttcacttgtcccgtctgcaaatccatcaatggtgtcgatttcaattctcgggtacaaggattttgtcatcgccaaggccatgccagctcccatacttccagctttcttgatgttcttgaaatatacttccggagcaacactcagcttatcaaatatttcggttgcgtcgagtgcactcggaccaccattattgaggaacatggcttggataattggtgcagcggcattggcgacgttatccctcgctccttcaagcctcttgatcttaccaaccaggacgtcaaactgagcttgagatttgatcttgcgatctacaaaacacatttatgatgagaatctgttgcattataaggagagaagctcaggttgtcagctggcgttaccttcgacttcctttaaggctgagtccctttgcgcagccagttctgtcttgtctctctccagggcttcaatttgcttcgccatctgttccatcctggcggcttgcgctgtttgaaattcagatggttaaggatacagttatgccagtttaaaccgatgaaacggatctagggattaccttttgacgaaccactcagctcatagtttgaatcctggagctgggcgattcggtcccttaactctttctctgtctttttggcgcactccttggcctcatgcagctggtccctaactgcttctagagttcccaaatgaggaaccagcttttccagagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatacgagggatttcttctccgtcatcacctgatggtcctgatgtgtttccaagacattagaccgataaactgaggttatttaaatcgccattgtttgagaagacaactaacctgaagatgtacctagctgagcgtgaggtgatctttgttctttacctgaagacccagctatcgagtcgttaccagcctctggtccttgtgaagtcgtcgtctgcgcttctacctcggggatctcttgatcagggcctgcgtccgactggtttccagtcgggggctcttgagttgttgccgtttcagttgttgccgactggtttccagtcggcggcaggtcactcggattggccctatctcccgaagcatgggcgccagtcggctggctttcagcagtcggctggttttcagtagttggctcggggtccttggatatattttgctctgtcatagccggatcagggtcttttccagatggatctatatcagatggtttcctgcagagtgttctttcagtattcagcatcattttcatgagcagaacatgccgaagcggaatcataccgagaggtttaatacctggaagatgttctgatctttggcattgcacggccagccagttttttcctgggcatggtacgctttgggggtttactaggcgagcccttatccccagatttatcatcgtcgccttcatcatcatcaagtaccagctttctcttgcgaggacctgtttgaccagtcaatttggaggactgaggttgcggatcttgtctgatcgttggccctccgcctccctgagcggtgtgttggcgaggagaccggcgctgagaaactggtggatctgacttcatcaatgcatattcctgaataagatgcttccatagttagtcaactcagcatgaagatacgactatgttctgatcacggtttgaaggtttcagatacatacctgcggaggcggattgaatgcgttgtatggcacaactggcagttggtgagagtagctgactacaattgcatttgagaagattttgtgcatcctctccttcatgattttgaaatccagggagtctggttcttcacggttgggatcatgtttgccgtcgaactcgaatgccgtgcgggatctttccttgagtggcgccagtcggcatttgatgaagtgccgagtgatttgctctccctgtaagccttgttgtttaagatttaacatacgatccaacaactccaaggcttgtgctgcttcatctccgattggaagagagttccaagtatcttggtacactggagggagacaagtgtacccgggaagagcaggctcgggattctgggcatagaaccagtttgcatgccatcctttgttcgaagttttgaagggcatcgagaaatatttttggctcagagtaccccttagttggaatcctgcccccccgactacacacggtttgttcttgtttggttggggcttgaggaagaagatccggcggaatagggcaaagtgaggtttgatccccaaaaaggcttcacatacatggacgaaattggcgatatgcactatggaattcgggtttaggtgatgcaagctgattccatagaaattcaagatcccacggaaaaattttgaggtcggaagagcaaagccgccgtagaagaaatgcgagaagactacgatctcatgtgtatcaggggtcgggaaagcctcaccgcatgctggccgccacccgatgatctccttggctgggagaacgccgtgcgccaccatctccttcaggttttcctccgtcacgtcggacggcgccaattggctttcgaagctttctctctcttccgccatcgatttttctcaaatgtgctgatttgattcgagggatggcttggaagaggtgaggaattgaggcggtggatcacgggaaggattttgatgcacttttcggaggtggatttggccggagttgtgaaccctagttcgccggcgcagcttttcactgtagcaaggagtggggaaaatggcgagagttccggcggggaagacgaagcgtcgcttggatatcggatttttcagttaagggtatcggaggtgctaatgggcctaggcctgaacagtatttcagcccaatacttttaacagtgtggcccattgtgttccttagggacttaggcatattttgctttggcaatattatgcgcacaacagtgttgcccaatgctgatcaaatcctttttatgcggtcatataattctttggaattattgcaatgcgaattaaaaaggtgcccgacagaaaggcgttatgctgtttttgcaagcttttttaggctaacaaaagctgtttgggttaactaggaatgacttgtttttattatagtcacttccttggtatgttatatacctattttcattatggtaaatagtcaaggcctaggctattcgacttatttattaccataatcttcataatacttgatgggtaatctttagagtttttattcggatacctgtcaagtatgttcattcgtgaaccttttagagtgtaaaccactcggatttcttttattgtggctaaaaagcagtcggctagcatgcctatttaggcgccgcgtacgcttttgtcatgtaatgcacaattgtgttattatattgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccgttaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaaggcctgaacctgtataaatcctttgtctccaaacccatacacttttctagcttgatagccaccccctttcattattgccgaaatctagtttcgacactcattctctaagattattggacaagttctccagttctttggtcccatagggatgggcgtacagagaacgaagcagcatcttgatgatgtgagggtcatccagattccagcatcgtctttgatctctttctcactcactctcaatagctacttaatcactgcagtgctacctgtgaataatatattgtatgtgtatttggaaatgagctgaattcagcgaaattttggatgacaactagagttgatcgatgcaatatttatagagaacttttacggtacaatgtactaccagtatatactggcaatatataaaaagatatatttggaatttaatagaaaattagaaaaggcgtttcaatttatttctggatctcgtcgtgcggtggggaagagcattgatttgacaacaacgctcatgcggcggcgtgatctaacgagtagcgaggagaggttggaccgttggacccaggcgactgggctcaggaggttgatgttcacggcggtccggctcaccgtgcgctcgtccttctgccgagcctcacggcccatagctagacacggcggcgagctgattcagtgtagattcagttgcagagattataaaatatatacgactcaatagcagcggttgttttttcacacggtgtgttgttttgatttctttactgtgacccgactgattaaaaaaagacaagtttgccctttttaagtttatactgcagtatcattacgtagggagataaatcaatctacactgttagattgtttatactacaagtatatactggtagtatattgtaccgtaaaagttctctatgatctcccgaggtagagtccattgatcagcaaggctagctagcagctagtatatgggtagcgtgcaagctagctatatgctgaacaaaatgctaactaaagttcctacgtagatgaacaagctagcaatacgaaccgggaccaatgttagctagcaaaggaaaacgatgtaccaaagcgtaggcagggaggtcatcgagtcgaatattttccttttctttttccaaaggaacagtggatcgaataatctcaccagctgagcaagcaaccttgatctcatctacggccacgatcaacgtagtcactcactatatacgatttccggtgcgattaccgcagcagcatgcccaaagattctgatcaccagcaaagccaattcctgaaaggcttatcatatatacatatgtatctatatatatctcaatgctaattaggtatttttagtagctcctatggtaattagaaaaaactaactattaattaaatagatcgtattataagtagaccgtaaaataattaatacttaattaatcatacaccttatcttattttacgtatcttctcgatcttcgtctttttcagtaggtcaccgttgaagcccacgacctagatccagggcgatgccggccgtagtggcgatgggcgagaggcgacgacgatgaggcactggtggagaaccaatttttactcccggttggtaaccccctttagtcccggtttttcaaccgggagtagcaatccgggactaaagatggacatatttagtcccggttgaaataaccaggactaacgatcatctttagtcccagttggtaacaccaatcgagacaaaccggatggtcccctttgatttttttttctctttttattttctcccgaatcaagtggcatgcaaatccccaaatcaaaccccgaatcaagtggcatgcaaatccccaaatcaaaccccaaatccctaaatcaaagtaacatcccaaattcacatcaccaaatccacatcacaaatcttaaagttatttatacacataaatcaaatacatcacagattctaaaacaaatcaaatacatcacagatcaatacaataaatcacaaatttatacatatcagtgaatcacaaattaagaaaaaacaaacaaagccgctgccgccactcgccacggccgccgcctgcggccccgctccgcccgccgccggcccaacggatgggaaggggaggagggggaggaggaggaaggggaggaggtggaggagaggggatgaggaagagagggtagatctgatctgtaggaatggaggaggagaagggggagaggttcgatctgtgagttgcgattgtggaggagaggataagtgatagggattatatactacacgtacaattttagttctggttggtttcaattttagtcccagttggtaataccacccaggactaaagtgatgtctccaaccgagactaaagatcctcggcctcaaatattcatctgacaggggattaaccgggactaaagatcat

SEQ ID NO: 30660 - DNA, 1800 bp, Oryza sativa
aagatcatttctccaccagtgaggggagtgatgcgacggtcgacggcgtggctctggaaaggctaggcgtccgaattcgcgcgcctaggcgtgctagatctgggagcggcaacgaccggggcgatggcttggcacgtcaacagtgacctccacaccaccggaggagaagatgtggcagggtttggcatctctttgctagatctggtcggctgacagtggcaacaagggcgacacacatggcggtcagaggcagccagctgcctcgccggtgcgcgcggtgggttggggcctacggtggcacccagcggcatcgacaagcggtgggttggttgacacagggcacccgtgcggcaaacagagctagtacgagacatgcattgttatgttggacagatcaactaaatcacagcacacacaggttacaaccttgcaatataatgaatatatatacacgcggcagtgaacttgcgattattaattcttaccagaaccggccagatagaaatatgtaagtaggtcttcatttaattattctttccacattctgatctccttctactgtgatgaagcaacgtatatagatcgatcgcgtggtaaggggaacacgcacttcatgagatcttgagctccctcggacttacttgaggaattcttgagctccctcttggacttgattgaattcgattgaaccccggatgatgtccggagtgatcttcctcgtgctgttgcagttccagtcaaccttctccttcgtaggagctgctgcatcggcggccttgaagcgaagtatggccgtgttattgatcccagcaatgtcgtcgggggagatcgtcaccaacgtcttcgtcttgttcaagttccacacaatcttctccagcttgggagctgcacgggctttgatcaacaaggccgtcttatcagagacatgatcaagcaggaggagcctcagctccccgaactccccctcctcgagggtgacctcgctttcgatgtatgatttgcgaagcagcctgaggcagcgcaagctcttcagcttgccgaggatccgcagaccgtcgtcgcgcagtagggtgtaacgtagagtgatcttggaaagcgcttggaacttttcgttgatccatgtagggagcttgtagcctctcttgtcgccgccatttcctcccttgaagaagcacttgaggttgaggtctaagctctcaagtttactgggagctaggatttcttcttgtgaatggtcaagagtcacgaacacgtcgtcgccggccatgtgctccgcagccggcggtggcggtggctccgtgatccagactgacagtgagcgcagggtatctctccgcttggagattgcttcaagcaaatgagtgatgttaccttggctgccgtcgaggacgactcccaacttcctcagctgctctagagacccaatccgtgcaaggtcggcttggccgtccttaatccggacatggcgcaatgtctccgtcttcttcccgatcctgtgaggtaccagcacggtggagcctgactcatttttcttgccttcgccaccgccgtcggtattgatgttgttgccggcaaggagatgcttcaggttgaggaggtagatgcgcctcatggcggtggccggcatctttttggtgtcccggatatcgagcgtctccagctgccacaagtcctccatcttcttgggcagactggaaacgtcggtgttccggaggctcagatacttgagggaggtcaccttgcagatactcttaggtggctcttctccaatctctggcagccccctagatctatcacgtt

SEQ ID NO: 30661 - DNA, 5548 bp, Oryza sativa
gacaacacacccagcagcgagtccaccgcgccgttcgtcaggtgcgccattgtcgtaggatgcaattatcttatgatatatctctctatcttgatcttttttttgaggagaacgacggtaggagatctgccggaatttaatattagaagagaaaaattacaaagtagcacagatgtacagaggttacaagcaaaggaaaggagagagaattacagctgcaggaaaagctaaaaacaattcaagctgatcttgatcttgatcttgatctttcttctatgtactactagctggtgaatacttgggcaatatttgtatatagagtagagggaccaaattaaagtggttgatagactgtagcgtgcaaattaaggcttagcctttgtggatgctgaacaagatggtagagcttatacacgtgtacagatcgaaccagatgcaaatgctacagcaccggctagcaaggaaaacaaagcataggcgggaggtcagaatatttacttttcttttcttcttttgcaaagcaacgtatattataaccctgtggatcgaacgaacgaatttttttttttttgaaacgaaaagcggcaaaagacttgccgaatgtattaaaggaaatataaggtcagaatacataaacagaaacgcaaagaccgtctaacggtcgaacgaagaggcttgccaactaggcaaaaaacctcatgatacaagcgacttaaagaacaacagcatttaacatctggacaaattaatttggcttatattttccttgattaaggaggccacctggttctcgtcttgtgaagagtgacataaaattcttctgtttcgttctagccaaatattccaccacgttattgcaaggtctttaagaattagcttccttgtagctataggccttagcttgcataatgattcccaccaatttttgaaggtgcaagatgagctctgaagggtataggcagtatgtccttgccaaaggcaaattttgttccataccatagctgtgaaagggcattctttggctagatgagtagcatcttcgaacgaacgaatcgaatctgtcagtccaatccccttgaacaagctaagcgacctggatgatccatggcatgcaaaactttttagataatggaaagtttttattgaactcagttaattatattaatgtgatacaataattttgaaaatacttccgatctctacgtaactgagatgcacacaaccgaacatacaaaaccacactaaaaaacaagaatgacatggagtattgaggaccataaatccaaagactaaatcaccgcccatggcatgcatgtcaatatattagaaagaaaagagtttttgtcacacaatacaatcggccagacaagcctataccgagaggaggggaacaaaggtacaaataagaaaaatataagagaaaattacttcggaaaaaaaacaactctaaacaatgagagggtgtaggcggagccacactataatcaaaattcaatggcctaggctcgagaggttggtctggcgtttcactgtaatggattctcctcaaggagctccagcttgacgaccaatgtgacatggagaagattgcgcaatcgcataaaaacaaggtgaaaacggtatggaaatctttccgatagtattgataccatttccatataactaatacttcctccatcccataataattgcattcttaggaaattagagacaatttaacaacaaacacaatttaccacaatagccctatttaataattacattgtatacgcttatttcatatttatacttgattaaaaggaaggttgagcaatacattccatatgtaaacttaattaaaaagaaggttgtgggtatacatcggttaaattaaaacatgcccccaactgaagctcccacagcgatttggagtcgcgtgttcgatcgccgcgatatccacgttgcccccgaatgctcaggcagccggatttcgcaagcgctcgtggctccgcatcgactctggtcgtttttcaaaaaaaacccttagtattattgataatttgatgcaagtccccaatcgtacatttctaggttatgcagtcttatccaaaagaccttcaaaatatgaaatatcttatgctaagaagacaaaattcggaaaattggactgcgctctgaaaaacgtaaagtgagggatcattttgcaaaaatgaacatccccctccccctctcccaaactagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccgacacggcacggcacagctactgtagcggcacggcacggcacggcccgcggcacggcacggcccgttagcgggccagcggcgcactgacaaggcgagcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcaaaaatttgtttatgtcggtttaaattttcagaatggatccgaactttccataccagtcgccgtcgttcaccttgggtgatttcgaccccaactacatgtcggggtttgacgatacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgatggaagggaggtatcgaaagcccgttgtagaatatgtaggcaaattttatctgcttgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctacctttgtcacaagtttattatccaactgctaatataattttgcacaaccttcttgaaattgctaatttatttaaagaatacgaaaatgatgacgttctaactaaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgagagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaagtcattactatttttaacaaattcttttgcaatattttcgcaagtgtagatttatctttaaattatttcaaaataatgaatcacaatctatatttttaaatttttcaacacaacaaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttggttttttttttaaaaaaaacactgtgcactggg

SEQ ID NO: 30662 - DNA, 21294 bp, Oryza sativa
  unsure (1)..(21294): unsure at all n locations
gtgcccgtgccggcccgggccgtgccgccgttttggacacctatatcccaaaccctagccgccagcccactcgctgcccctccccctctctcgctttctccccctctccaggcggcgaccgggcctcgctcgattttccctgccggcgacaacctctcccgcgcgccctccgctgctctccgtcatctcctcctctcgaccctgccactccgtcgctgcagcaccatggtggagactcaccaaagcacccccactgccgcctccaagtactcctccctgtccccttcctcctccgccgccaagcagcggcgcccgcgcccgcaaagagcgccggttcgtgcgaggatgcgttggcggccaagagaggtgacgattttttttgtcttttcagcgcgtgagttggtggcatgggcttgggattgagctattaggttttgatgctttgttgcaaatcaaggaggagatagctggcggtcacagcggcggagtgaatctgcctggaacttgttcgttcttaatggcattctcaacagcactgcatagccaggggatcttgcttagatccgcttgtgctttgacgccggtctgctggtctttggttaaaaaatgccaggtctactttcttccctttcccttacctcttatgattctcttatgctttgtagctacaatggagcaatcgatttggtaaaaaatgtcagtcagtgcaagctacagggcttggccttgtgttgctggagcagaggttggcagcctaccactgctgtgttgtgtgctgcaacatttaatcaacaaacaagtactaataatctactatttatcttatgtgaactcctattatctatgctaatgttttttggttgcacaattggaactgtcaaaaatggggaagatgtgttggttgctgttctaatactatctgatcatcttcttctacaatgagaaaaaaaatgaagctggcattgcaactcttgcaatataaatcagggcaaccgtgcagccttcatatatcataatgtgtttccaaatttcgaataatatgtttcacataactgattatgatggctaggagaaatttggttctttctccagatgacgcagtaacgaagtaatgacctgataagcatgtatacaacagccaagcagaaaattgtatgtcattgttcacaagaactgatttggcaagcattttgtggaccttagaacttatatcacatttttgccttgctgcatctaacctgctccgtagaatcatttagccaatggtctgacttgtgctctctgctttctttgatgcctcaggaacattgtgctgacaaagtgacaattagtctagactgtagtcttggcctgaaacatatttccctgcaggcttagaatgcagattacaacccataacgtatatttgcaactgttgatacttgatttggtttacttctagaacataacctggaatttcttattaactgtaccgtcacccttttttacaaattgggtggaaagtgcttggctgcaaactaattgatcttattgttatgtgaaaggctgcagattctttatgcatggtcaagcagctgatagcaatgaaagtaaaagcagcgggagatgcaagtttttcttgactggcaggtagctgatgtttttctctcttcctctaataacctgaatccattaaaaaaagaaaacataatttctcttactatagttgtttattttacttgccaaaggtcctaaccacaataaaagaagtcgatagctagctacctcttgtttggctggtagtggtgttccctgagtaatgcaggcatgattgcgattgtaggagccttagggattgttcacttcatcgccgcttgcaaccctacaaattttttttgttcccaaattttgctaatttaacaagctaaatatgttcttactatctctaccctaccaaaattacctattttcttattttcaaattttggcccaactagctcctaccatttctaactttcatttcttactaatttaattaacactatgattatgttggactactaccatttctaactttcatctcttattaattaacattatgattatgttggaaatacatacctgtttaacatgtagttgccaggtcaacaatgatgcctttgttttaaagattctagattcgaaccgaagctacatcaagttacaaactaggcctcttgcagtatatgatcaagaataagttccactttcatgacatcaaatttgtatttcaactggggaaagtatttcatctatgcgaccaatgaggcatatatctatgcttttgacttcaaattcaacctgctaaagattcattggattgacttgagcatcaaaattagtgtaattagcaaagcattgctgagaatcattcatgttatatattttgcaccaaaatttgtatcatgttattgcttactattataatgaagcggttgtcctaagtgacattgagaatcagtgttatttgtaataacaactagatcatatccatggtgcttcttgttacaagaaattgatgatcaatttttattaactacatgtttgattttaagccgctgacattgtgtctatgcacagcttggtattacagtaatgtgataagtctaatttcattcactaccggagaattttgtaataattttttatacatttttttgattcacgatttcaattgaaatgaattgaaacatttggatttaatattgatagggcgcacaacgtgcgtcaaaatgtctagttctatttgttgtatcccatcttatcagaaatacaatctttttgggacaaaatttgaagggtagaaatacaattattatgggacggaggtagtataataaaaaaaaattnagcggtgttttacccgacttattacctttgataaaaaataagtttactaattatgtcagcgtcgcatttaagtaacacaaaataattaattcacaaatataaaaattcccgacatttcctaattaaggacatcccaatgccctttctgcaacacattcgagcagtacgtgtgaaagcaatcatggcccaaaactgaataaacttgtgtggcatccattgctttctttcatccatatgaaaaaatggtattaaggcggtggcggcggcggtcgacgactcatccgagacagcgagacctagagagagagctttttttttcatgtttgtgagagggcaagaaggacgtacggcggtcagatacccaaagggagtttggagtttaaaactccaacccaaccgcgcaaaaaaccgcccgtccttattcctagtggcggagctagctcccatgcaagtcgggtggccaccgggctccaccactaacatctccattgcaaatatcttttgatgttcgaaaaatactggtatttatttgggcttcacgatattgttagctctactagtgcccgttcctagcgctggttggtcgctgagctccgcagcaaagcacagcacaatggtcaataccggaaaatactaccccctccgtttcacaatgtaagtcattctatcatttcccacattcatattgatgttaatgaatctagacaagacatatgtctagattcattaacatcaatatgaatgtggaaaatgctagaatgacttacattgtgaaacggagggagtagtattcattcgtgcttcacgatattcctgctctagatctcgttattggactcgtcgtgcatgcctagcgctggtccccgccgctggacccacggtggtgacccgacgacggcgaggtgttcggcagtcagcacggcgatgcgtttcgtggagaacgtgggcccgaaaccgaaacacgcaggcagctatactggcccagtaaaaattgcgacgcgacggcccaaatgaatagattggcccacttaatctggggcgcccacatctcagggccgaggtccggagtatgagggcccctttgaattaaaggattcatgtaggaatttcataggattcaaatcctataggaaattattctgtttggccctttgattcaaagaattgaagctctccaaatcctatgaaattcctatggaatggcacattgcatgtggattttggaggaaatttagcaagagctccaacctcttggaaaatttcctttgagtctatctctcttatccgattcctgtgtttttcctgcgctccaatcaaacgaccattcctgtgtttttcctgtgtttggcaatcctctgtttttcacttcaattcctgtcagaatcctgtgttttttctattcctccattttttttgtaccctgcgattcaaaggggccctgaaactccgaagaaccccctacgccgtctgttgcttgatgcccggctgatcctattcctacctacgcttatcaatcaacaaagcatatactcgtatgatgattgatgcgtgcatgtgcaacatggcggccatgtgatgtgactgtcaatttctgtttctgcaactcatggaactcaccagcaatttgtgtctttgtcaacttatattaaactttactaactccaggaagctgccacaagaaccaaacaaaaaggaaaagtaagcaaaactagtatctctctatcttgatctttcttctattgtactactagctggtgaatatttgggcaatatttgtgtatagagtagagggaattgatcgaacaaaagaccaaattaaagtggttgatagactgtagcgtgcaaattaaggcttagcctttgtggatgctgaacaagatggtagagcttatatacgtgtacagatcgaaccagatgcaaatgctacaggtcagaatattttacttttcttttcttcttttgcaaagcaacgtatattataattaaccctgtggatcgatcgaatcgaatctgtcagtcgtccaatccccttgaacaagctaagcgacctggcatcgatcaatggcatataggctcgatcgagagattggtctggtgtttctgcgacatggagaagattgggcaatcacatgcatttccacaaaatatagggtgtaaacggtataggaatctttccgacagtattgatatcacttccacaaaactaatataacaataactaatatatctttgcttcttaaattccagatttccactctaattaacaaaaataaaactacaaaatgtgcatgtctttgctgctgagcttattataagttgacaacaactgaacagaggacaacaggatcatcagatgatcaaaatggagtgtttcactgcatgcgcagcagcaggtgactgttaataccaatgagactcagcaaacgagacaagacaaaaattctctggacagttacatatttgcttcttgaattccaggcttacacttcaacaagaacaagattaaagaatgtgtagggataacatgatgagttccagcactagacttgctgatctgttatgatagacaagaagtaaatagaaatcaccctggcatgaagcatagtggaagatcagttcgatcaagattcagagcttcagaatatttttaacagctcatcaagatgtggctgatcaagattgggcaatatttgtgtatagagtagagggaattgatcgatcgattgatcgaacaaaagaccaaattaaagtggctgatagactagcgtgaaaagcttagcctttgtggatgctgaacaagatggtagagcttatatacgtgtacagatcgaaccagatgcaaatgctacagcaccggctagcaaggaaaacaaagcataggcgggaggtcagaatatttacttttcttttcttcttttgcaaagcaacgtatattataaccctgtggatcgaacgaacgaatcgaatcgaatctgtcagtccaatccccttgaacaagctaagcgacctgcatgatccatggcatgcaaaactttttagataatggaaagtttttattgaactcagttaattatattaatgtgatacaataattttgaaaacacttccgatctctacgtaactgagatgcacacaaccgaacatacaaaaccacactaaaaaacaagaatgacatgaagtattgaggaccatcaatcaccacccatggcatgcaaaacaaaaaaagaacatctttcccgtcatcaatggcctaggttctttgttttgcatgtcaatatattagaaagaaaagagttttttgtcacacaatgcaatcggccagacaagcctatacccgatggttaagggtccgtctgactcatccgagacctagagagagagcatttttttttcttctttgtgagaggacaagaaggacgtatggcggtcagatacccaaaggaagtttggagtttaaaactccaactcaacagcgcaaaaaaccgcccgtccttattcctagtggcggagctagcaggaaatgctactgggcgagcgatcgccctcgcttgcccagagcgatcagtttccacccccccccctccttccctccctccacctctccacctggtttccttttttggcaccgcattacttttctattttagtaaatttatacacctaaagtttatacacctaaagtttacacatctaaagtttagataccaaaatttataagtcaaaagtttatatatccgattcaaatttgaatttgaatttaaatattttttttatatatagtatttctatacatctaaagtttatacacctaaagtttataggcctaaagtttatagacctaaagtttataagtcaaaagtttatatacccgtttcaaatttgaatttgaattcaaatatccgattcaaatttgaatttgaattcaaatatttttcatatatagtatttctatacatctaaagtttatacatctaaagtttatagatctaaatttatagatctaaagtttatatacctgattcaaatttgaatttaaattcaaatattttctatatatagtatttctatacatctaaagtttatagacccaaagtttataagtcaaaagtttacatactcgattcaaatttgaatttgaattcaaattttttatatatagtatttctatacataaatttttctaacttttgttttttaaaaaattttgtgtggtctactgtagtagaaagaggagaaggggaggagagggaggagcatagggggaggggggccggatccgatcgctgggcgatcgcccattagcccccctggagctagctcccatgcaagtcgggtggccacccgggctccaccactaacatctccattacaaatatcttttgatgttggaaaaatactggtatttatttgggcttcacgatatcgatggctccgcgcactgctctagatctcgttattggactcgtacgtcgttattggaccagcgctaggcaggcacgacgacggcgaggtgttcggcagttggcacggcgatgcgtttcctgaaggatgtggggcccaaaccgaaacacgcaggcagctatactggcccagtaaaaattgcgacgcgacggcccaaatgaatagcttggcccacttaatctggggtgcccacatccgagagccgaggtccggagtatgaaactccgaaccccctacgccgtctgttgaattgcttgatgcccgtctgatcctacctacgcttatactccctccgtccaaaaaaaaaagacaaaccctgatttccgtgtccaacgtttgaccgttcgtcttatttaaaaaaattatgaaaaaaattaaaaagataagtcacacataaagtattaatcatattttatcatctaacaacaatgaaaatactaattataaaaaattttcatataagacggacagtaaaatgttagcacgcaaacctacgtttttttttttaaagacagagtgagtaattatcaatcaacaaattaagcatgtactcgtatgatgattgatgcgtgtgcccgtgcagaatgatagccgcgccggcgacggcgatgcgtgcgtgtctggctgaagcaagcaagcggtgagcaatggctggaattaattaagcctggaacatggcggccatgtgatgtgactgtctatttctgttaatttctgcaactgatggaacgtaactcaccagcaatttgtctttgtcaacttatattaaactctactaactccaggaagctgccacaagaaccaaacaaaaggaaaagtaagcaaaacagtaagcacttcctctgtctcaaattataaaattataaggtctatatttttctagcacggcctttaatgacatactttaaccattattttattttatgttatgttttcaacaaatattaaattactataacataaaagtactttgaaatattaatatagtgatataacccgtataatacttagtatatatgattatcagttaaaagttatcgagtttgatttttctttaaaagagggagtactccttagttataagttatgaagtatactaataagcagtccgtcctgttggtgcttaatttgcttggtgataaactggtaataatatgcacagtttcagcactagagtatctgaatgtttgtcatagacagagaacaacaagatcatatgaccaaaacggagtgcttcagtgcaacagcaggtgactgtcaataccaatgaaattcagcaaacgagacaaagacaacatatattctctggacagttatatctttgcttcttaaattccagatttccactctaattaacaaaaataaaactacaaaatatgcatgtctttgctgctgagtttattataagttgacaacaactgaacagaggacaacaggatcatcagatgatcaaaatggagtgtttcactgaatgcgcagcagcaggtgactgttaataccaatgagactcagcaaacgagacaagacaaaaattctctggacagttacatatttgcttcttgaattccaggcttacacttcaacaagaacaagattaaagaatgtgtagggataacatgatgagttccagcactagacttgctgatctgttatgatagacaagaagtaaatagaaatcaccctggcatgaagcatagtggaagatcagttcgatcaagattcagagcttcagaatatttttaacagctcatcaagatgtggtgctacagaatatttgaacaggttgatcaacacaactgaatcctcttgactcaccattaatgtagaggctacagcatctctcccttctgtgtcaaagaaaaaaaatcaacacaacagcttagatattacagattcagtgcacttctgatgaatgaggcagcgtagattggtaataaaataaatataagagtatcaagctacctaggacgacacgaatacgcgtagtaatatttggagaaagtcaaccacgcgttccatgttaaaactaatccacaataatggtcaacggaagatgggtcagctgttccatgcagccatacgacgaatgcaagccactccacatgcaggtagctagctagtcactcctacttagcttcactcccttagcttgcttggaatgatcaccacgcactgagagtctgaaaaccaaccagcaaatcaagctttgtggccaccaggcgcctgcaatggcggagctcgtggtcagctcggccaagggcgccgtgaggtcgctgctgggccgcatcagcaccatgctcgtcaacgaggcacagctgcttggccgcgtccgccgcgacatgcagttcatcaaggacgagatggagatgatggacgccttcctcctgctcctcctgcaccagcaggccggcaccctcgaccaccactaccacaaccaatgcacgccatggatcaggcaggcgatggagctcgcccgcgactgccaggactgcgtcgagcagtacgcgcagtgcatcgcagctgggccatcctccaagagcctcctcctcggccgcctccgccgggtgtcccggcttgtccggagcctccccgaacgccacaggctggccgtgcagatccaagacatcaaggtccggctgggcgaggtgagccaccggcggaaggcgtatgacatttgtgccaacctcaacagctaccgtccacctgagcaggacaacggcggtgaacaggaagatgaagctgcttggaggcgttatttggcttctgctgaaccaccggccgacctgaagaacactgtgaacgaacttgtcaggtggctcatggaggatcaacctgcagggcttagaatcatacctgtggtcggaatctgcgtggatacaagtgcgattattgctgagagagtctaccagcactcctctgtcaccagcctgtttgactgcaaggcttggatcactgtccgtgattgtcaatctcatcttcagattctcaaagatatactatgtcaacttgttctccctctgaacaagttcaggagtgagatgattggctggaacgaggagcagttggtggaaaagctgcgctgctatttgcgaggtaaaatcttcctcattgttcttcacgatgtccgtgatgaatcaatctggagtcatataaagcttgccttcccagatgattgttctgctggtagtgccatcataatcaccacagatgatgataaagtggccgagtctttctctgcgtataaaatcttcaacccagatagccccggttatgttctcgatttcttccttagtaaagctatagctctgcttaaacatgaaaatgaaaagcagctaaggaaaatcctaccgtgcatgctgatccatcttgaacctgaaaccttttttatgaagatgctccttcggtacctgtattatgggagatatgctacgttacgactgcgtgatgcactgcagcatacgtcatcgctgcatgattattggcctaagaatatggtatacttatgctacaattatttgcctgataagtaccggagctgcatgctgtatctgtctattttcccacctggttgcagcatcaggaggaccagcttagtaagacgatggattgttgaaggcctcatcactgatgagcaagagaggagtgcactaaaacaagctgatcactgttctgtccacgcgacatggatgcttcaggcaagttcaggacctgcatagtacctgacttggttcacgatgctcttactgatctggtagccagaggaagcaacattacttctgtggacacagttttggcgccaccagagttggcccgtcatctttcaatccgcttcagcacgaagttgcacatgtctccatctgaaccaatcaatagtattctttcctttctcaagtccttgcattcatcatctcggcttgggctgcttaaagtgctagatttggatggctgcaaaggtttgaagagacgccacctgaagaacatatgtggcatatatttgctcaagtatttgagcctacgggatacagatgtcaccagactgcccaaggaaatagagaatctgatctacttggaaacacttgacatccgacagacgaagatcagtgtcttccccaggaaatctttagtgctccctatgctcaagcatttgttctcaggccatactgtctatccaagtgaagacattttcaggcagcaggaatcattctctgccatccacattcctcaccaaatcgggaggatgaaaaacatggagatattgtcccatgtcaaagtttcacatggtggaatgcagttgattgctgttggccagctactgaagctgaggaagttaggtgttgtcatccatgacacagataaagatggttttgacagtttgcttcatgtaattggcaaattgaacaaatgcctacgatctttgtcagtccagattagatcaccttctgctgctgatggaagcaatggctttgacatgagcatgatgtacagcacatacccgaggcttcttgagagcctgaccatctgtggcatcaaaagtggattgcctccctggattgaacatctccaccaacttactaaggttactctgcataatacctccctgacagagagtgctatccatgtcctgggcaagctcgtgggcttgtgctatcttaggctccgacacaggtcatacatccgaggcgacctcaccatctctacaagggaattcaaaaacctcaggttccttttcattgagggcccagacattgtcaacatcagtttcgatgagggtgcagctcctaggcttgagaggatggtctggcgtttcacgagaatggtttctcttgttgggattggtcacatcctaagcatcagggagctcgagcttgaaggagacagtgacctggagaagattggggtgattctccgtgacatcaaagcacaccccaatgaccccagtctgaagcacattccagcagcagggaactaatcatgcacaaggactggtgcctacggatgaagcaaactgaaaaaactgccgtggcttagatccattatgtgcctggacaaacaaggatgattgacattactatttctttcccactttgagctgcttgttgatgctgctgctcctactacttctgaagcacttctactgttagtatggaataaagatgctgaagggggcccttcttcctcttccatgcatggattgttggctttgttgtattgtagcaccaatatttagtatgcttgtttgtttgtctcctttcccaacagtcatgggttttcctgtaccattcattagtaaggcttttgaaagaattcctgtgtttatcttatcttccttgtacaagaaaaacttggtgttattgcctaaagcttactcttcctcccttgtttctgtacacagatatgtttctcacttggcacccaataattaccactgttgtcaataatcctttaacaagtaaacaccggcctagaagcatcatccctccaaatccaagcctcttttagctagcaacgaaaaaaaaatgcagctagctttctgacagaaattcagaatcagcagacatgtgagatgaagataaaaagggggaaatggtacgagtcctacatgttacagagaagtgccaaggtattgctgcgagacttttcatcaaaccgaacaaaaggtattcagacataagcactgtaaaaatactgagaagtgattcttctacatggaatcgccaaaaaaaaaaaagaagaggtgggtgaattttacctagggctgattctcttccctctccggtgagaggttgggctatgtgggccaaaaccgactgcagctcatggcccagtaaaatgcaccgcgatggcccaaatacttagctgagttgctcgcttcttctgaattctgatagtatgtgactcagtaaacacacgctccaatatgcacactgtaaagcattccagatattgatactgaatgaatacctttatgaaccaaattatatggagcatacaaagaagctgcaatgacatgtatgtgaccgttgatttttttgataaacatttgaccatttgtattattcaaaatttttgtgcacatataaaaatatttaagtcatgcttaaagaacatttaatgataaatcaagtcacaataaaataaatgataattacataaattttttgaattagactactatccaatgaccatatgatcgacctaccttcagctccaagcctccagctctgcgattaattcaattaatcatgcatccatgagcctggctgaatttgtattccagtaggcatgtgactccagtcaaatttgataaacaacacatcttggatgaatagaggcagcatctggtacacaacaatgtaaacaaagacagaaccaatcaatgttactttccagctagaatgcatacatgcctggtattattctaggttatcttgtctttttttttttttcagaagtatcattcatactcaaaacaagtcgattcctgacttgttcaaaatccacatggctgttggtcctagcagactaaattaaggatttcataaacaaacagaatagacaaatacataccaactacccccgctactatattacaaatcttgttcccaccaaattcagtgtaatagtttataggtgaggtgacaccaaatagtccgaacagagaaattggtggtaccaaaagtggggagaaatcacaaaatggaggttgatatgtaatgtgttgacgattcacattgcaagtcatgaattgatttgaccgtgtttggtgtaatgtaatggtaccttagaaaatctggatccttgtgattctgcttagcatgtggtcacatgcttgctgacttggtaatgctaaaaggagatggagctggggctcattaaatagatgccagatttctagtagtatactttccccctctccagttgcacttgcacctgttcaggttgagttcatccttcccacttagctgccagtagtggccatggtgtgtgtctgatgagcgagctgagtgagggagatcccggatatggacgggtttggcctgagctccacccactccgccgtgaagtcgctcgtcggccggctgaccgacgtcctctccgaccaagtgcagctgctaggcgggctgaggcgcgaggtgcagttcatccgggacgagatggagagcatgaacggcttcctcctcaatcatgcccgcaggggccgcatggaccaccagctccaggcgtggatgaaccaggtcaaggacctcgccaaccattcccagtactgcgtcgaccagtacttgcggtgcctcggcaccaccagccaccgctcgccgggtggcctctggggctccgtgcgccgtctcccccggttcgtcagcacgttgccggcgcgctaccggttggctatccaaatccaggacatcaagatccgggtagtggaggttagccagaggcagcagaggtatcctctccatggcacggctaccgagcaggagccgcagtctggcatggccagcgatcatagccagcaagctttccttaccggtgacagtgaagccgatcagcaggagcatcttcggaggcgtatcttggccgaagacgactctggcctgttcaaggaggctgctgatgagctcaccagctggctgacagtggaaggagatggcagatcagatctcagaatcatccccattgtcggctcccgtggcatgggcaaaaccactcttgctgagcaagtgtacaaaggttattcctcaaggttggcagaccacaaggcatggatctcggttggctccaaccaatctccacagcaagtactccgggacatactcgcgcagattgtagggcttcatgctaacaatctgcaggacatgggaacatggggaaacagccaaatcgcactgatgattcaggagcagctggaaggtaaaaggttccttattgttcttgatgatgtctgctccgagtcgctctggaaagatatcgaagcttctctccactgcggtaattctgctcccagtgctatacttgtcaccacaagcttgcctgaagtggcacagtcattttgtccttacagaatatatgatctaaggtatatccaggaggagcataaccgctccttagttgatttcttcctcgtgagagcagctaactttataagtgacaatggtcatggcaaagctagtctcaaggaggaggttcttcgcagcattttagtaaaatgttccccctgtatctttagcatgaagatgcttctccgattcctttatgcgaatcctaacaagaccctacaggaactgcatgacttcagcaacagcctgtgcttctgcagccctctgcatctgtcttcatggctgtccaatgccgagaaaatgctcacattctgctacaacgccttgccttgtgattacaggagctgcttgctgtatcttaccattttccccaatgaccacaatatcaggagaacgagcctgctcagaaaatggatcgcggaaggcctaatagctgaaagagatggactgagtgcatttgatgttgccaaccgatgttttgatgctcttctcgctcaaagatttgttcttcctggtgatgttggaaattcaggcaaggtaaacagctgcagagtgcacaatctagtccgtgacttcattgcctgggtcatcagagatgacaactttgtgtacacaaagctaccagtcgacttggctcaccgtcttcccatccacaatggagaaagactgcagcaggtctcgcggatcaaacttcgtgcttctcatttcgacgattgttggagcatgacaaggtgttgcttcacaacgaagtcagtggatcccttggctggcatatccatgttacttagatcaattcaggaatctgctcaactaggattacgcctcaatgtacttgatctagaaggctgcaaaggattggagaagtatcacctgaacagcgtttgcaagatatttcaactcaagtatttgagcctcaggaatacagatgtttcccacttgcccaagaagatcgacaagctacagtacctggagacacttgacatccggcaaacccagataaaggcattcccaggaaagcattttatccttcctgggctgaagcacctacttgctggttgcaccaattgtcctagcaagaaaaataatctcatggaaaaggaatcttgctcgttttccactgtgctcatgcctcaaaaaattgtgaggatgggaaagttggagatactatgctatgctgaggtttccagtggcctcactgggctaatgggcatttgtcagttacgacgactcagaaaattgggagtactcttgcaaggtaatgcagcttgtaatctggattacttgttccgacaaatcgatatgttggatagaagcctgcactctttgtcaatccggatggaacgactgaagttagccaaagacgatgctcgcaaaagggatgacatggtacccgcgtcatttcccttctcacctccaaagtttgttcagaagctaaacatcagtggcatcagaagtgcattgcttggttggattggtgacctccaccaactttccaagataactctgcatgagacttcactcacggaacatgttctcggtatcctgggacagcttggcagcctgcggtgcctcaagctccagtgcaattcaaccatgggtagcagtctatcgttcaggagtggagcgtttcggaacctcgtagctcttgttgtccaggacaataacctccttgacattatctttgattacggagcagctccaaggcttgagagagtgatattgtctatcgccgccattgactctctgtctggagtacagcaccttcagcagctgaaagagctcgagctccatggaagtgcaagaaacataggcgaggtcgaacaggccatagcaggacaccataataatccagttttcagacacgagcaatggaatgatcttcactgaagcttccgaaattctgaatgtctggtgcttgcatctgtgttctacaatgaagatagtaataagtggacgcaaagcaaacctcttttttcttgatgcatccatgttaaattttacttgtgttggattttcagtttgtttgatttatatgtatcctccacagttgccactattaagcttgttgcaactatatcttccggaagcatttctgttgtacaaaattttccttagtcttctcattaaaatctcctgtggatacatggcaaatatcaccagtgtacaattaaagcaattcacatccatttgcattagtatacaccaacgcaccatctagtcaaagattgcaccatgtcaagggtaatgctctgtttagttgattgcatgctaggcaaagaaaaatgcagcagaattcctgacagaaatccataatcagaaggcacatataagatgacccaaaccatcagtagtgctggtgggtgagaacggtttcagtccaatcatttcatcagcatctaagattccaacatgatatacagaaatccaaggtgtagctgcgaatctttcatcaaaccgaccaaaatgtattcagaatcagtattgaaatgaaaattttctacttggaactgcaaaaatggggggaaattacacctacagtacacgcgcgggtgtgaatcgtcccacgcattcggcggaggcgagatacccagtaaaatcacgattcacccggccgagaagaaccaaaattttcccctgaaatccgccgcggcacatgcagttagtcatccctctcgctccgatctcctaccaaagtgcaggcgattgatctaacaatcgaagctcgtaaggctactactactctactcacctgccaacgccggccagcagcaaacgtctacattgcatccttcctgcttgaacattcatctccgccgccgccgccgccggcaaagcggcggtgccgtgctcgacggcggtgaagagggtggtccgattcgttcgagaggagaaacagagaaggctgcttgggccgtggtgggctctattaaggcaacccctaaatgggctgggcctcatttgtttctgaaaccgaggtcgtttcgcgaaggagatccactcaatctgaaccgcacgcacctgatccaacggctagtagtgtcccaggaggttcggagtttaaaactttgaacccccgctggtagcaaagaacacacgccgtgcttccgtactgtacctcgccggagcgccgccgcatcctggccgtctccgaccatccggcccgtccgtcaccgcgccaccgcacgcatcggcgaagggcccttgagagctagctaactcctgcaaacatgagcatggttaggagtggagctagaaccaaatgtggttccaatcgtttgctttactctattttggaccgagtttaaattgatatgggtgtctaggtttgaaccgagggagtgcacatacgatgaaaatagatgaattatatctaaaagaatttttgaatcggttttctgggcacacctcggacacatgtagcttggcatctgagcatgacagcaagtgcagtttaacttcagatttgttaggattctgggagaaattttccagtcaagatggcactgatgtctgtgcatctcaaaattaacatagaactgaggcagttttactcaattcattaaccaccgatagatcgaaagggcgaaacagattgcttatgtttgccgtgaggtcgaaatgtggatggttaagaaagctagtgatgatccatctgccgggaagtacataagacagtgcggttctgaagaaacaggcggtaactgtaccaattctaggaatcgattggacttttgggttcgatttgcgttgataaagtgaatggtagtatatatattttgggggaactatattagattgccatctcttgtttctcttccatgtcacctaaatagtcactaattttttttaaaaaaaagcatatattaatatgaaatatatcactacacaaatatgtaatattaaattcaatttctacaatttacaaataaacataaattaaactaaaaataattagcatacattcgcagttatacttgttattttgttacaacttgtaaatgttgaatttgaacttacatatttgtggagtgatatattttatattaatatatcttttcaaaattttttaaaaaaaattataactattaggtacatgcaagaaacggatgaaaacaatttcctttttttttttttgcccagggagagaatttaatttgcatgcatgtatgattgaagtcctaacaatcaggtgttattagtcgcatgccaacttgattaaggctgagttcttttcctaactttcccaactcatcttatcgtttttcgcgtatatgttttttaaactgctaaacggtgtgtttttcttgcaaaaattttctatacaaaagttgctttaaaaaatcatattaattattttttaaaaaaataaataatatttaattaatcataagaaaatgtgtcgcttcgttttacgtgcgcgggagatgagttctcaatcaatctcacctctgaacacaacctaattacttgaactaatatccaaaactaaagtcaacacaaagataaatattggataacctatatatctgttctatcttgcatatgcatgtggacggacgtatacaattagcgggagaagctagatgcgtgtaaacgtaaagccaaaatgagagacgaacatcctaacaaccaccaattaattatcacagattaaagaaagacttgattgaccgagctaagtcagtcttgcaaatatattcacaagtgtttgcattgacaaattatttagtaagtatacgtactccagcaagctagcttttggacagtggaagagagacaacccgaccctatatatacattgtacaccgggaagggatattattatccttcaaaatctcatataagtgttcttaaaacagatcatactccttccctcccttaaaaattacagtttcagctagtcaataacggattaaaacagtactatgcctttcattaatgaaaaaaatgttgttgtttttttttgacaaatttctagactaaaactacagtccttaaaaggagggagtatataaatgcaaacaggaaggttgttgggaggctgggccaagctaggctcctccacagaatatatgatcatgcatgacgtacgtatttgctagtcaataacggattaaaacagtactatacctttcattaatgaaaaaaatgttgttttttttttgacaaatttctagactaaaactacagtccttaaaaggagggagtatataaatgcaaacaggaaggttgttgggaggctgggccaagctaggctcctccacagaatatatgatcatgcatgacatcattgattttgtgacaaatgtttcatcattcatcctattcaaattattttacaattataaaaatatttaattatacttaaaaaatatttgatgataaatcaagttataataaaataaatgataattatatttttaataaaacgaatgaaaaaacgtataaaaaatcaacagtattatatattaaaaaaaggatggagtagtacttgctatgtgtgtcctgacataataacacacgattgatgacccctcttaattagtccatatacccgcaatagttttaaaatttatccctagttcatggaagattattatctctgagattttccgcatcaattgcaagaaatgacaataggtatgatgtctaatgttcttgtcagcatgtgaactgcatggcaataaaactattaattagcacgtcaactctgcatggtcgtattagtgttacttaatcttttggtgcatagattaatgctaccagctgtacttaatttatattacctacatagcattttttttatataggtggtatattttattttgaaaagtcttcaccgtcacgctttggacgctgatttgtcgtaatatatattcataattactactccctccgttttttaatgtat

SEQ ID NO: 30663 - DNA, 3423 bp, Oryza sativa
atatatatatatatatatatatatataaatataacccatgcatatatatgtttcaatacatatatatgcatacatatatatatgtatatatatatatattatattatattatatgtatatatggttcaggccatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacggaaccgaaaccaagccctacatgtagtttaaagatatgattcgtagtagaaataattaacataacaagaatttcttaattaacagagaaacttatgccagtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcctgcggatattggtcgagcattgcaacgtttactctccgagggtcgatgaatccagtatcgaaaaccctccgccatcgggccctttgaatctccattctacaacgataaaagggagtattttattttatatagtctacttatatacaaggacctaattaattaaaggagacgtagtaattaagaattataattgaccgatatacttacaaagtccagcaactcataatagagacgtcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtcttccccggtcaccaacggctcgatctcctggtttggttgctctccaagctgagggactggtttggactttccaaaagatgctttcttcagtgttcgctcatagtccgatagcttgatggcctccttgacaggtgcagacatacccctgaagaagttcctgacactggggtctataggaatcttcttttctggccttcgaggcttgaattgtctcttgacttctgatgcaacgtaagcgtcaagctcctcttgcgtgcaatcggaccccgggtccttgttcttagcggtgtcaactttcgccttcttcgttgcccttgtgtgggcaggcggtggagctggggggcccttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtataggatcctgaggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtaggctccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgttcatgctctgtgatcctacctgccccgttgaggcgcagctgctacggtttcctgacgggctcatcattgcaggaggaatggtcggctggggatcatgggaccgatgtgcggccatgcgttcatcaaccttccttgctacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctgaagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattgactgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagg

SEQ ID NO: 30664 - DNA, 1188 bp, Oryza sativa
tccatcttcttccacttccgttatgatgtgccgaccctcaagcttcttcggtgcacctcgttgcccgcgtgcctttttctgtctaacggagggttgactaccactagcctcctcctcttggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcattgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaattcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagttaataatgtcatactaagtctaatttgcaataaaataatcttatattaaaactcaaataatattagaccactacacaatcttatatgataagtctaattacaggtctaataatcttaattaattgcattacaaatataacaatcatttatattattacgtcacttgcctgctccaattccttctagggctagctcttccactccggcttgacggtcgactccgacaacacgtcttttatgaaagatacaaaaagatgtattaggataaatgcaaagtaacatatatatatatatatatatatatatatatatatatatatatatatatatatatatatatatatatatatatatatatatat

SEQ ID NO: 30665 - DNA, 8965 bp, Oryza sativa
gcgcgggaggtcggccggcatcaatggcgccggcgagatttgcggggcaaatacgcccgtttgaacgcgggagagagagggaaaaatggggggaaagagagaggggatcgcggggaatatttccccccactttattgcgcgcggggacggcgggaggcggcgggattcgcggtggcggcagcgctagggcgcgggcggcgcggcgggagcagcgggaggacagggatgacaggtgggccccacccgtcagcgagggtggcgggcgggcccgcccgtaagcggcacgcgcgcggggaggaggccgattgggccgcgggggaaaggagagagagggagggaggtgggccgagccggcccaagagggggaagggggaaaaagactttttagggtttttctttttataaaattattttaactttgtttatttcttaataattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaagtgatttttatttcgggatgaatttatcaggacgtgacagcctaccaccatgattgtccgccagcatcgccctttcaacccaagcagcttccacagggcgctagtgtcagccagaaccattagggaggtcagcccaaccgcagtgcagctccgcgcccaccaatggcaccagcacagccagctccatcagcccaagccaagaaggagactggagcaaaaccagggtcctcctacaactgtggcgagctcggccactttgctgacaagtgcccgaagccaaggcgtgccgggccaaggtttgcccaagctcgtgtcaaccacgcgtccgcagaagaggcgcaagcaacaccagaggtcgtactgggtacgtttcctgttaactcaatccctgcaacagtacttttcgattctagtgcaacgcattctttaatttccaagcggtttgttgggatgcatgggttaagaaatgaggagctttgtacaccaatgagggttcataccccgggaaatagttcaacctcggtcagttatagccgttccgtgctaatagaaatccaaagatcaccatttctagccaacctcatccttctcgaatccgaagacctggatatcattcttgggatggattggctgaccaagttcaagggtgtcattgattgtgcgaatcgcacagtcacctttaccaaggagaaaggggaaacagtggtgtacaagtcaccagtctcaccgaatcagggaatccccttgaatcagattgaggtggaaaatccggtggtcacctaggagaagagttcgaggaaattggaagatatccccatagtctgcgagtatccagaggtgttccccgaggacctcactaccatgccacccaagagagagatcgaattccggattgatttggcaccggggactgctccaatttacaagagaccgtacagaatggcagacaacgagctagcagaggtcaagaagtaggttgatgagtagctgcagaaagggtacattcgaccgagtacttcaccttggggtgctccggccatttttgtggagaagaaggacaacacgaagagaatgtgtgtcgattatcgcgcactcaatgaggtcacaatcaagaacaaatatcctttgccatggattgatgatctgtttgatcagttgaaaggagccaaggtgttttctaagacatacctacgatcaggctatcaccaattgagaattcgggaagaggatattcccaagacagccttcaccactcggtatgggttgtatgagtgcacggttatgtcttttggactcaccaatgcacctgcattcttcatgaacctgatgaacaaagtgttcatggaatttctggttaagtttgtgtggtattcattgatgacattcttatctattccaagtcggaagaagagcatgagcaacatcttcgtctggtactcgagaagttgcaggagcatcagctttatgccaagttcagcaaatgcgacttttgggtatcagaggtcaaattcttgggtcacgtcattacagctcagggtgtggcagttgatccatcgaatgtggagtcagttaccaagtggaccccacctaagacagtgtcacagattcggagtttccttggattcgcgggctattaccgtcggttcattgaaaatttctccaggattgccagacctatgacttagttgcttaagaaagacgagaaattcaagtggacagccaagtgtgacaagagttttaaggagctcaagaagaaattagtgtctgctccagttctgattttgcccgatcagacgaaagacttccaagtatattgtgacgcgacccgtcacgggcttggatgtgttctaatgcaagagggcagagtggtcgcttgtgcctcacgacagttgcgtccacatgaaggaaactatccaacacatgacctggaagtggcagcggtggttcacgctttgaaaatctggaggcactatctgattggcaaccgctgcgaagtctatacggatcataagagtttgaaatatatcttcacctagcctgatctgaatctccgacaacgaagatggttggagttaatcaaggattatggcatgagcattcactaccatccaggcaaagccaatgtggtggcagatgcattaagcaggaagagctactacaatgctttgtgcaccggcggcatgtgtaaagaattgcagcaggagcttgaacatctcaacttggggattgtagaacacgggtacgtggctgccctagaggcacggcctacgctcgtggatcaagtccgagcagctctggtaaatgatcctgaaatagcaaagctgaaaaacaatatgagggtcggaaaagcccgagatttacttgaagatgagcacggcacaatctggttgggagaaagattgtgcgtacctgatgacaaagagctgaaagatctgatactcactgaggcttattagactcaatactccaccatcttcaggccttccaagaacttctcctgcctttccttgttagtaagcacatcttctgaagcatagcaagctagactgttgaactcatgtagatactctgtcaacagccacaaggtcaagtcaacaatatcgttctcacaggagcaaatgcagtgccggttgcatcttcaaggaagctcagcaaccagtttcaaagcagtagtggttttctttaatgccttagaacatttaccagagttatggaataaaaagatagactgtagtttacctatgcccttttctttctagccgttccgaatctcgggacgagattctttgtaaggggggtcgatttgtcacaccctgattttcgtttcaggatttataaattatttaataaattaccattagaatttatattaaatgttcattaatttacaagtgaagttagatgtgggaaatcaaatttcctaaatataaagcatggctggatttaattttattaaattctccatggttaattatactcaattttcggagctcaattcttaattttaataatacaaagaatatttcagtaattattcacatattaaattaatcattaaatgagctggtttcaattttgtaaatacttagagtgtccaagtatgttcaagaattttcttggaattatttgagcattggaagtatttttaacaattgaaatatcatctcattggttaatttatttggaaaagtaataataatcctcttcctagtcttgggcccttttcagcccattccctccttcttcagcccagccgatccagcagctcctctttctgtctctgtcaagtctgctttgtgtccctcctttaagcagtccttggaagaagaaccccagccagaagtctgctttgtgtccctattgctacagtaccatcttcaacctccaggcagagccgagccagccgtcccgtgcacagttgccgtcgatttcccctctaaatccggtctcctttctcgtgttatttcaaaattagtggaggggaaatattcctcttatcctcctctatctctttccccaaaaatccggttttatccctttgaattcgacgcaaatttggattcattttcgagtttatctctccaccaaaccctaggttttcccggcgcgattccttgcgttccaagcccgatctctctcttccatggctataaatagagtcccctccctctcctcttttggccgccacctctccgtctctccgccgtagcttgtagcgccgtcgccgcgttcgtcttctctgtccaccaccggcagccgctccagccgcctgtagcagccgcctcggccatcgacgacctgcgccgccgcctctctcggctccgcaaggtcaagctccaccccgtccaccccttcccccaagccaaaatccaccggagctttatcgtcgccgtcaacccgaagttcgctgtcgcgttttgatctccggcgaggcccttttgcacctcccgtggtcgccgaacctcgccgtttcctccggtggcatcacagcgccaagccgaaggccgtccaccccttcttctccgccggtgttcgccgtaaagccaccgtcacagtcgtcccgatctcgccgccgctcgaagctcgtcgccggctgccgttcatcgtcgctcgtcgtcgtgtaagtgtgggtaaggactgtcttgttctcctcttcgctttagtgctctcgctttccattgttgtgccatcgtttgtcgtcaccggctgtctcccgttgctgtttctcgtcgtcgccgccattggtgagttcgtcgtcgcctccactctctcccggagctgtcccttgtcgccggagcatcgtcgttcagttctcgttgctatcctgagccatccgccggtgaagatgttatcgctgacatcaataccatctcaagccattgcaaaatcaatataaattatgtaatctctttttattatatattattcttttttaatatatgtcatctaccaaatatgatctaatctattttcgaatgatggtttaatcttttatgtcagtgataaatcatttgtaaattgtttaattaatttggaatagtcttttctttaatatgtttaattggaattaaatattgtaaaattcgtaactaattcatatgaagtcagaatgaggccgttcaagtctctaaattcatctaaaaacatggtctacatgtttgtttacttttatgtactgtttatttggtttttatcagtctttttctccgttttgcgtgttagcctgtcgtttccgtcgttgcgaaggtctgtgtgtgcgtcggaagtgttcaagaaggctaattgaagaccaattattgcaaggcaagtcacacagctaaacaaccctttgagcatgttgaacctatttattagctattgttttatttcaacttatgcattcgaatgtcatcgggtggtgtgcctttcccaattaattatggccgaagatgactttatttttctatgggtaataaattgattagcttggaccttatatattggattggttcagctaaatgctatatatataattgcttagccatgcctagaaacattagttcattaatgggatgaatcgtactatattattatttatggttatatttaatggtagctcacgatggttaatcgtgttatgataattaattgataattaaaacttgataatggtgggttgtgagcacatggttttgaaggtcgtgctcatgacaattaaggaccgttcgcgagctactgttgtgagacattaaccgtaccaaccacaagccagcgtaggcaacggttttaccttttgtatagcatggttcattgcggggcaccagactgagaagcggtgagaagcccgtggtggtcgctggggagtccatgcctctggttattgagggggtgattatgatccaggaacggtgcgctgtggtggattgtgttgtatgaggggtactgtcacagtcccgtttcgaggtaccgtggtggtactgagagcatggtgacttgttttggggctatgtcttgtgggtacagtggtacacctctggccagagtaaaactattcgaatagccgtgcccgcggttatgggcgggttgagcaatgtttttcgtgattagtctcacacctctcacaataattattgatgctataattggtaataatttgcttagctcctggaatggagttagatctgtacagccgggtatggttgttctggatggttaggcctgtgtagcatgggtgtgctgtttagtgttgattaaaattgatgattaattactctgatgtttaactattcttaaatatttgctaaatgctgcttttgcaaatgagcttatattatgccatcctttggtatccttgtgcacttacatatttgctgtatgacttgcggagtatgtcatatgctcatcttgcaataatcaatcaaacctcaggtgaaaaaaaatgatccagaaggagaagacatttggcttataccccagttgagttgcctgtgggagtggagctgaaagccatcgctagaccattaattccgctgctgttttcttttcttttgtaagtatgtaacgttattattatgatggatttgtatattaaattatcagtttgtgtacctcggctgattcctagacgagggttttatacacaaataagttcggaaattattagtgaattttcgggcgtgacaatgccttaagcaggaaaagctactgcaacgcttcttgcactggcggcatgtgtaaagaaatgcagcaggagcttgaacatctcaacttggggattatagaacacgagtacgtggctgccccagaggcacggtctacgctcgtggatcaagtccgagcagctcaggtaaatgatcctgaaatagcagagctgaaaaagaatatgagggttggaaaagcccgagatttccttgaagatgagtacggcacaatctggttaggagaaagattatgcgtacctgatgacaaagagctgagagaactgatactcaccgaggctcatcagactcagtactccattcatccaggcaataccaagatgtaccaagatctcaaagaaaaattttggtgggccattatgagaagggaaatagctaaattcgtcgcactcttcaatgactgtcagcgagttaaagcagaacaccagagacccgcaggattactacaacctctttagatcccggaatggaaatgggaagagattggaatggatttcataacaggtctgcccaggacatcatccggccacgattcaatctgggtagtcgtggatcgacataccaaagttgcttatttcattccagtgcatactacttatacaggcaaaaggttggtagagctctatctctcaagaatcatttgtttgcatggagtacccaaaaagataatatctgatcgagggagtcagttcacctaaaaattttggcagaagttgcaagaagaattggggacccatttgaatttcagcacagcttaccatccgcagacagatggccagaccgagagggtcaatcaaatattggaggatatgttgcgagcctatgcgctcgattttggtggagcttgggataaaagtctgccttatgctgaattctcttacaacaacagctatcagaccaatctacaaatggcaccgttcgaagtattgtatggccggaagtgccgcacacctctcttctgggatcaaataggcgaacgtcaactgttcggaacagaagtgctaacagaagcagaggagaaagtcagaaccatcagagagaggttgagaattgcacaatctcgacagaagagctacgcagacaaccaccgaagggagctcacttttgaagcaggggattatgtgtaccttcgtgtcactccgctccggggagtgcactgtttccagacgaaaggcaagttggcaccatgtttcgtgggaccatacaagatcttggaacgaagaggagaagttgcatataagctagaacttccatccaacatggccggcatccatgatgtgttccatgtgtctcagttaaataagtgcttgagggtaccggaagaacaagctgattcagagcacatcgatcttcaagaagatctgacttatgtggagaagccaattcgcatccttgagaccagtgaaaggaggactagaaacaaggtcaccaggttctgcagggttcagtggagccaccactcagaggaagaagcaacctgggaaagggaagatgagttgaaggccgcccatctgcacctcttcactagctcttccgaatctcgggatcgagattctgtttaaggggggtaggtttgtcacaccctgaagttcttctcccaagcctaaatttaatttataaataaccttcagaaaatatcggtgtaaaagcaaaagagaaaccctaaaggaactaatgcaaataataatcggaaatggcatgtgggatttttcttgagttctacatgtcgaaatatgctaacaagatttttagtggaattttcagagctctagaaataattttaaccaattgaaaatgagcataagcattatttaatccctggaaatttatttctttccttttctttttctttttccctcccttttctttttgaatgggccgccgacccattctctttccctccccctccccgctgggtcagccgaaggccaaggcccagcagccggccggcttctccctcctaccctcggatcgccgacaggtggggcccacctatcgggcccgtatcccacctatggatgacgccaccacgccgtaaccgtcgcttgcgtctataccgtacgtgcgcgcccacgttgtccgacttgtccacctattccacacaccccggaaccaccggcccacttcctcgctagcgcccgcgttccgagatggccgggttttgaa

SEQ ID NO: 30666 - DNA, 4855 bp, Oryza sativa
  unsure (1)..(4855): unsure at all n locations
tagcgccgcccgcgccgccgccttcctccgccaccggccggtcgccgccggttgccgccttgcgccgccgctgcgtcgagccacgccgccgcgtgccatgggcgccgggccggcttgagccgagcccgtgcgcgccggccgcgagccgcctcccccgtccgatctaccgggcggtagattggggccgcccgttccgtcgcccgcgtggtcgcccgcgtggctgccatgttggtgccgcgtccgcaccacttgtgcgccacgtggtgcgccgcccccttcccggtccgtggacccggtccatcgcggaccactaccccgagtcactgccatgtggggtccgcatgtcggcgccgccccctgtctctccagggtttaaattattgcgcaataaatcatttagggcttttctgtttatactaaaatcgtagtgaatcttctaaaattcattgaaaattcatccgtgcttcgtttaagcccattcaagtctcagtaaatcaagaaaaatgcatagaatccattaaaaatggttttgttctctgtttcagtagtcttatggcctgtttgtattgtttgctttgtatgtcgcttagattccggctctcccgacgctccggtgtactttgaaatagtcgccaaggttcctccagctgcagagcaaggcaagtcatgcttgtcacttgaacatgttgatcctatattgcaaatgccctattgtttcccttaaatactgcattgttttacaatgttactatgggatgtttacctactgttacagccatgctatttttgtaccatgctcctttgttagcttgggatataacatgactagatattggactagggattgcttagccattcaactagcacacaatgggggaatcacattaatgcatagacttcaggttatgttggattagagccatcgtctttgtgttggtcaattaaaatataccatatggtgtgctgtgggtgcgtggttttgctggtcgcgcccatggctcttaaggaccggttcgcgggatgccctggaagaacttatcatacttaccactagccagcgtgggcaacagctgggcctgtagtgtagctttcctctagctgatgcatccaggcaagggtgggcgtgatggagtttggatgggccctacggcggcctatgcggcttccggattcacctaggcatgagaggggactgcccgctgccttgcgaggagtggcggtgaaacctgaggtgtgttgtgcttggttagagggggttatgcgaagggtcctgtcacggcctctttccggtctgtcgtggtggcatgtcagcgcacaaaaacgtgtcgtggggctgtgtcttgtgggtacagttatacacctctgattagagtagaactattcgaatagccgtgcccgcagttatgggcgatcaaccagattcgccgtgattagtctcaccctagtttagtctaatggaattgattagttcaggtggatggttgggcctgttgcaacgtggtgtagcgttggacagtggatggttaatattgattaattattacaactgttttactgctttcaactactgtttataaatgctcgctttatgcaaatgaaccgctctagctatcctttgattataccctgcatcatacccctattccggtatgacttgctgagtacggtggttgtactcagtcttgctctattttccccaaaaccccagagtttgagtatgcgtcagatggtggcttttccgaggagtaggcttcgtccgtgccgtcgaggatgcatgtagagtggtgttcccgctgcagttcaagtcaaggcttagctccagttatcctttatttttccgttgcatttatgtaagacttttataatgtttgtaagatgtggatctgtatgtcaactttgtcgtttgtgtaccccggccggtactggatgggggttttaatgcacattctgcttggaattctattcgggaatttctgggcgtgacaattccacaagttgctgcttatatatgttgattactaatagataacctctcaccacgtgaaggtggcgtcgggcatggccattccaatggacccttcagggacttaccactgcaggccgattccagcaggatactccaaggttgaagttgagttggtggaagccgcatacgaggacctcgagttggactaccctggagaaaacggtgagatacatctacgagacacaagccacgctattatactatggtgcaagtggtacatcatcctccctgggcgacaagcggtgtctcgtgcaccatctccttcggctccgccatctcctcctcaggctagtgcaccgtctcctccccatgctccagcaagcaatttcccttaggcaagatccttctcggctacttgtatcaaacactgaacaacgcgtcggccaagattgttgtcggctcaattgtcaatgcaggcgagccatggtggttgttgcaaacttggctaaatctagtagtcatgaaaactgtcaatcggccatccgtgacagaagctgaatttccaagattaaagccgattacagatgatgatgaagaagagcgcacctaccacaggtgcatgtcctatggggaatatgcatccacaccagccgatgcaggagcaaagttatcggctgagctgctcaaggactggttctgcagcttttatgaaggcttccagaaagatgcccgtgtttggttcttctatgaagattcatcacttctggaaaatccatcggacttcagatttgaagacattaaccataaaagataccaaaagtccaggtaagttttctcaactacaatcagcccatgcatcttacccgttggcatccaccaagggagaaacattccagtctcctacgaattctaccatccaatgagttcagctagacaacttggaatgggccaactcccaatcgacttattctttgccaacaagattcagtaccgaggaaaaatctcatcaactctgatgatggatcggctactcaacatcccaggacctcccttgggcagtattgagaacatagagctggcaaggttcaggagtaagaactttgacagatggtggggtgaatggtaacaatatatcttccatcaaccagcttctatgtacatgacagaactgttccccgatgttattccttaggtaaatctttactttatcaatcttacttgaacaattgatagccgacttgaaccttgactaatcttttcttctgacctacagacaatagaatcctctcctcctcaccagagtaacaatggcaaggatattgaatacgctcctggattaatcccaaatggaggtgtaccatcccttcctgtcatcggctataatgcccccaggtcttcaactcttcttcaagggctcatcagagaaccagccgatgctggcaagaagagaaaaaccagatcatcggctatggacacatcagctccggctcccaagaagaaaaccaaattaaggaaaactaagccagctgatgatctgcctgccctagatccatggaacacattatggactcctgccaaagattgaggtaactccaactgataagcaacctctcctcttctactgacgatcttataaggtcccacaaaacgcggtgccaattttcctttggtgtgaaaacgatgaactcctcgaagaggcgtgacacgaaggtacacataatctccttcgtcaaaacatagatctctacgacgatagtcggcataactcttatgacaagatggaccacacgcaatctttcttgaatgattntcaccttttcttctgcttcccttaggatatcagtcccgaaaacctgggacgttctccgttgatcccacaaaagcggagtgcggcacttccgaccatacagtgcttcgtaaggagccatctgaagactagcttaataactgttgttgtacgaaaattcagcataagggtagattcttatccaacttccaccgaaatctaaagcacaagccctcaacatgtcttccanaatttgattcaccctttcggtttgtccgtctgtctgcggatgataagcagtactaaagttcagcttagaacccatctcttcctgaagcttcttccaaaaatttgaagtaaactggctgcctcgatcagacactattttcttagcaacgccatgcaaacacacaatccttgccatatacaattccgccaaccgacttccagaatatgttgtctttactgggatgaaacgagccactttggtaagtctgtcgactatcacccaaatagagtcatggcctgatgacgttctgggtagaccagtgatgaaatccataccgatttcttcccatttccattcaggctgcaacaaaccggcatgtttctgatgttctgccttgactcgctgacaaatatcacatactgctacgtattctgcgatttcacgcttcatacttgcccaccaaaatctttccttgagatcctggtacatcttggtactaccagggtgaatggagtataaagtatcatgagcttctttcaaaattgcatcttttaaatctttgttgtcggggacacagattctctcacccaaccatacagttccttgctcatcttccaagaaaccgatagcttttcctcttctcatattctttttgatttctagaatatcaggatcattaatttgggcttccctaacttgatcaattagagtgggcttcgcttctaaggctgcaacgaaacctctactgacaatccccaaatttaatctttcaaattccttgcataactgcaatggcagacttgggtttccccgggcgttttcttcgtacattgaatagcctttctgctagagcgttgtacaacattagcctttc

SEQ ID NO: 30667 - DNA, 3566 bp, Oryza sativa
  unsure (1)..(3566): unsure at all n locations
gctttgtttccgcttgttttatggagtttattagagtaaacgccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattacctcgttcaccctagaataaacaaaaccccaactagtggacactctactcatggtaccactagcatgattttaggtggtttttcaactctagacttggggatattcatatcacctggacactttggaatagttggtttattgtggaattggattcacaccgccccctctattcaaaatccccaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgggctgcggcccggtagtcgagatgtcatggcacagggctggtgtcctgctgctagggtctcaatcctgcctacctgtcccggaggttccggccgtaggtggggttgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtaaaacctattcgaatagccgcgccctcggttatgggcaagccgagcaatgtacccaagttagtgttttaattcctaaaatttgctcaacaactaaaatgtggaatggttggcctgggttggcttgggatgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaacgctgtttactgcaaaacttaacccctacattatttccccttgtacttccctgcattaatcatgcatctgccggtgtggcttgctgagtactgtgggtgtactcattcttgcgctatctttctccccccttcagtaagagaagctttggagaagaagtcttaggtggagtcttggcttataccccagttgagcgcctgtgaagatggagccgtaagcccgctagtccgctgctgtttatttttgattgtcaggccttaagtgcttttgtaataatgtaaatattatcgatataataaagatgtgtcttttatatcatgtttgtatggtgtaccccggcttttcctgggacggggattaatacactagcgttcgggaaaatgcaattttctcggtcgcgacataggcccaccctgctgtcctggagtgaagcgcggtcgctggtgacttccttggttggactggaactgagctgtctttctcttcctgtccattttgttgcactgatcctcctggcggattgccttgtctaccagcttctcgaagtcagcataatccccggagatcaactggttggtcagctcgtcatccaggcctgctaggaacttctcctgtttctctgcgtcagtgcggacatcctccggttcatatcgtgctaggcgattgaactcatgcaggtactcggtcactgtcctgttgccctggtgaagtgcccggaattccctcttcttctgtgccacaaccccgtctggcacctgcgccttcctgaagctgcgacagaactccgcccaagtgacttctgtgcctggcaggtgggtagccatgtgattgtcccaccaagctgatgcgggacctcgtgtagcgaaggcgactttctcgtgatcattgcactgtagaagattgagcttcttttcaatggcatggaaccagtcctttgcctccatggggttggtggtgctagagaaggtgggtggcctgacgcgtagaaactccagcagcttggactgagggggagggggaccaaactgctgctgctgctgctcaggctgctgcagcatcctctggtgcatctactggtgctgctgctgcatctgctgcatcatggccaccatcatctgagtctgatgggccatcacttgtgcaagggtcgggttcttggggagcggtggcggaccattgccggaggcgctgttggggtacccactgtcggtgcgttcttcgccgttgctgccctctcctgctgcacagctgccattcctggtgttgaccatctgaaggaagagcagacggaggggatggaaaagaagaaaaacagatgctcaggaactaagctttattatataggaatttaaactgcaattgttcttatctgaattaaaacacttaaaacaacaaacaaatccttattaagacagccatatcataggcacatgatatcaaccgtcgactgacccacaagcgaacagacctaaacactcaaactaacagacaattactaagcaagacgataagctaagggaaaatgagcctaatgctcggaacagctcctacggtcggtggagtcgaaggcgtcctcctgctcgtcgccaggtccctctgagcgtctcctggggtctggcagatacgtctcgccactgcctggctctaagccactggagctactgctgctgtggtcgcgactgccactgggagtagcaggcaaccaacctccgttgccactggctggacccctggcggctgacgctggagcgaaggagagagcggatgcgggagctgacactggaacaggagctggagctgcaggaactgcgggaggtgctggaggagctgcgggaggaggtgggttcctgggtgcaagctgaatgcgcacgggtgcagtcgttgacttgcgaggcgtggtgcggatccggactcctccaggagcggggagacccttcaactaagcattctccttcttcaggcgcgctatctcatccttcagagctatgatcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30668 - DNA, 535 bp, Oryza sativa
atattagagttctcacaatttaatttactatctttcatatgctacttatatatgactattcgaatttttaaaaggtttaaatcatgcatgtggcatttacatatgttaattagagttgttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctgttttataaacacatatgtaagcgaaaatcatatgcagtgctataatctttagtcccggttcttaaccctaaccgggtttaaaaagaatttcgaaatagcgggaaaagatatttactcccggttg

SEQ ID NO: 30669 - DNA, 9612 bp, Oryza sativa
tatacatgtatatatatatatatatatatatatatgttactcgcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaatgtaattaagattattagacctggaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggtgtgtagggttctaatgtacgacatttacacttagcatacatgaattagattggtaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaggcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggttgcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaaaaacttatcaataaaggtaagatttagccattccgctagttgctgcttatatatgttgattactaataaataatctctcacaacatgaaggtggggtcgggcatgcccatcccaacggacccttcaggtctttaccactgcaggccgattccagcaggatactccaaggtccgagttgaattggtcgaaggcgcgtacaagaccctcgagctgtattaacctggaggagacagtgagccgcatctacgagacacatcccatgccatttttttatggcgcaggcggtacatcatcctctcttggcaacaagcggcgtctcgtgcaccatctcctccggctccgccatctcctcctcaggatcgtgcactgtctcctcctcgtgctccgccagcactgtctccacctcaggctccagcatcgactcctcaggatcttgcaccgactcctcctcgtgctcctacacctactcccccgcaagctcctcttccggcaccttcaaagtcaagggcccccccagctcctccgcttgcccacacaagggcatcaaagaaggcgaaagttgactccgccaagaacaagaacccggggtgcgattgcacgcaagaggagcttaacgcttacgctgcatcagaagtcaagagacaattcaagcatcgaagtccagaaaagaagattcctatagaccccagtgtcagaactgcttcaggggtatgtctgcatctgtcaagaaggccatcaagctatcggtctatgaacgaacgttgaagaaagcatcttctggaaagtccaaaccagtccctcagcttggagagcacccaaaccaggagatcgagccggttggtgacgggtaaagaaatgacgatagaacaatttattgctgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctgtattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattacagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatatgtatgcatatatatgtattgaaacatatatatgcatggtttatatatatatatatatatatatatatatatatataaaccatgcagcaacaggggcatgcaaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgataggtgtattaatggtcttgacacttcagcgtgtgaagatagggccgtggggtggaactggaggccatgcttgggatgagggaggccatggtgccagtgctggcggttacaccggtgtacgccgaatgagtatagggtcttcctggtgtgtcagctcaatgttgtttgaatacgacgacaatggcaaacgtgtgaaaggtaccctgcaaggagagggaggcaatggaatacccgaggtatgtagcaagcaatacttgatagatttgttcttaggaagtgattttccaagtgaaaacaatttctccactccttataggatctactctatcttattagaaacttatatttattactgccatgtctacccaaaatctaaatactttttgttgacaattaaaaatcgattatagcatcctggattcaaaattctatatatactctactctttggactactctttggaggagcggcttgatgtacgcatggcacttgtagcgaggttgccttgatcagaagggggtgaatggttatcgcttaattttaatttcaatgtatacaacaaaaacaaacaagcggcagaaataaaacaaataatcattctagtactgttaatctgttataatgctatgacagccctaaattaaccaccctaataaaaaaaagaagaccaaacacaatacttaaattcacaacaccgtcgacaatcacgcgatgctacaatgcgtgaacagtgaaatcagcaaaccactacaactgaaaatcattagaacatcacctattcaaatccgcttgatgtataactttcaacataagttatatacatatttaattttaatcaataaatacgaaaaacaacagatgaatgggatctaaaaaaattttagtctgaaccaggagttcagtaaaatctagatagattaaaaactaaccatagaactgcatcataggtataaactagagttcgctgcgtaatctaaaaaaagaactgagctcaaatctaatgattatatcaaaatctagaagcagtataagatgactacaatgaattccaaaatcacattgctaaaatggaatatggctaaatttgtttagcgttagtgatcaaatcatgctccaatgagattaaaaaacaccccagctctcgtaacctcgtttctctcaaacccttaaaataataatcttatgctcttttgtttctcgtcttatctctttttcctctccctctaccttctacatccacccaacccacaaccgccagatccggcatgccccaaggctcgacaccgctcggtggtctcccagacgatcaaggtctcccgcagaagatgaagagtacggcgggctagatccatctgactacatcgtggtcctgcctttctgagccgcaacccacagccaccggatccaagaagctcaaggctggccaaaaccggaacgggctcactaaaggccagcctccaccagattagatgcccatcgctgcgcatcctccactcccacctgatccgccttcacccctccgctgccagtgccaccctcgtgtcaacatcgagcatgctggaggttgttgtcgtcgctgccgtcatcgaaccgcaaacctagccaccgtcgccaccaacatccgacatcgtcctattcgtcgcccgctccgggtggcttttacttaaccagtacctataaattataggtacaagtttttctaaaaaaaaccgacacctatagtatttgtgttgattttcctctacaaccagcatatatagttacccaaaggtgacgtttttgtattctttttcatcctgtggatttagggaaaggtttatatgtgccggttttaaatgaactcacacctatgaggcttttgcagtaatgatgcgctaagggttcagtactgtagctgtagagaaagaaactattgacttaattaccttcggtggaaaggtgggtaaattttacaattaatataccatttaaagaaatgcccacgcaaatgaatggttagaatttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgagccggtgactagttcatttaatcatgatctaatagaacttatcaactagttgtattatagaatcagtagggactcttctttaatcgtggagttgtattaatttttccactgttttaattatgtaaaaacacagacaaatactcagtcgtcgattgaacggtttaatttgggagaaaattatttgacagaatttttatgctcaaatcatgcagattttatagccttaggataaagatctaaccgctggaaatatttgacataaaaaacaaactgaaaaaataaaagagcaaatttcatatatgattttattggaggcccaattttttttcctgagcccaaacacatgcccatacgaaggcccaaatttcttgagcccaaaccagaaagtacaacaaactgattctaaagcccaaattcaatatctaataaatcacatgcccaaataaacctagaggagcaatcactggcccaaaaatatagcgagaaaaaaaacaggaagcacaatttaaagctcaaataagctaaacaaaaacatgtcaaatatccaagaacaaactttcagatctactaaaatgcccatatccataaaactagcaaacttccatattgaattacccatagacatatactcaattaggtatatgctaatgcatagaagataaatttcactatagttacactgcaattacactaaaagttacagagtaattctattatagttacattgtaattacagtataactatagtgaaattacaatacacttacatgtcatatcaacttaacttacaaatgtaatattaggtctatagaattgtaattttatattttaaaggaaataataaatacatatttatttacacagtatttttatcaaaattacagtgcacttacatatcgtatcaactgaatttacgaatgtaattttagttatatagcactgtaattttctgcactaatcttagcgcataatcctacggctaagaaaacgttaaatacaatagaaaaaaaaaccactctatagacacagcgtgaaaaatcgaaaattttgaacagagatcgagtcacgtcgcgcaaaatcagaaatttcgcacggagatcgagtcacgttgactaccacgataccacgaggcatgtcgaaacacgggccctcatcctcatctcgcactggtctaggacgaatcgtagtgcaatatccgaaagaacaagtcaaatatcaaaaatctgttctcttgtgtcctcccctctcgatttctgtctcagggatagaaaaatctctacgtttctctctctcaaacagagataatgcaggcgcgaatttcaaaattcaatagttaatgtgggtcccacgaaggtcagtcaaaggactaaaaactgcatgtctatcaaagcccgaacataatcagcactaatctcaaagatgaatggatggcccaaaaaacgaatgatccatccatcctttttctgtcaacagccatatagcctttccgttaaaacaaacagcttgcagagagatgctttgtactaattaatcactgactgacaaataacctgatgcatggacgcacacaggaggagctcgacttccatggggaggtgttgacgcacatgtgcggctaccatgacaaccacctcatccggtggttgcagttcaggagcaaccggaacaggacgttcggaccatacggcaatcttggagaagacagagctggatggacgcggttcgaggtctccatggagcactcggggtccatcgtcggcttctgcggccggagtggcaacttcacggacgccatcggcgtttacgtcgccgtctggaatcccgagaggttctatgatagcatgcgcaggcagggcgtccgcgtttaccgggcgtcgcctctgcgcatggacctgcgtcaaatagaagaagagaaaaagaaggaagaagtggaacgtgggcgcctacagaaggagatcaaggaggggcgagaaagtcttcggaagttacgattgaagcttggagtggatgtgccgcagcaggatcaggaaatcgtgcagcaactggaacgcgggcgtcagggaaaacgccagacaatagaggagctgcaagtggagcatgagcaactggaacgggaacgagggcgcttgcttctactgcagcaagtggatgagcaactggaacgggaattgcgcagacacacctattgaaagagtcagaggagttacgctcccgggtaaaataaccgggactaaaaatccatcaggagcagttccggttatttttttttctcaaatcgatctgctccctaaatatccccgatcatattcccaaatcatccccaaatcaaagtagcatcacagatctggaaagaaatacatcacatattggaaagaaatgcatcacagatcacaatacatcacatcacaaaatctcaaacaaaaaatacatcacaaatcctaaaagaaatacatcacaactcccacatcagatctaatatcacataaatcacagatcaaatcca

SEQ ID NO: 30670 - DNA, 25978 bp, Oryza sativa
atcacgaaaggaggagttagaggagggagtttcagattacgggagttacagcatgccacaacctgaagttcttcctaagcagaaattaaaattaataaatcatctcaagaaaatttttaagtcaagagagaaaccgtaaaatggcatgtgaaatttttcttgagttctacatgtcaaaatatactaacaaaaattttagtggaattttcagagccttggagataattttaatcaattaaaattaagcacaagcattaaataatcccctggaaatcctttctctctttttcccctttttctctcttttttccccttgttgggccgtcagcccatttcccctccgcccgcgcgccttgctgggctggcccgaggccaagcccgcagcccacgtgccccctcctttctctcccggggtcaccaacaggtagggcccacttgtcaggtccttccacaacctccggacgccgtcgacgcccatgctgcaaccgcctctcccaccttcttcgcccctcccgagccacgtcgccaacgaacgagcatgccccgctttccccgcgccccactacccccttacccactcgcccgcgcccacgagatgcccgggattcgaaatctgaatcccgcctctctctcctctcacacctgccccacttcgacggccatttcgtgctcctcccggccacgtccgagctccccgcccctatataaacactccccacctccctctcctcatttttcctcctttcgccgctcactcccgtgcatcctatcgctcccgcaccgtcatacctcccaccgtcgccttttaaccgcctctggcggctgctagcagccgcgctgggcctcgctgtcgacgccgccgcgttcgccgtgccgcgagccgccgtgtccgccgtccgttcggccgaatccgcctccgtaagccccttttcaccatgcgccgatgagcaatgccatggccgacgccttcggcccacgtccatgcccttcttgaactctccctctctctctaatccatctcatttgtttcgccaggaggttccggagcttgtccgccggtcgtcgccgtccccgatcgctcgccgtcgcctcaccgtgctcgtacgtcgtatagaatcgagctcgtccgacgctccgatttacttcaagatagtagccgaggtccctccagctggttcatcaatcatgttgctcctaaatttgcaaatgctcttttatttcctttaaatcattcttttatttacctattgtactcaactttactacttgtatactattattcctttgctatcttgggttgtaatatgattagatgttggattaggacttgcttagccttgcttagtcgaactagcacacaatgggggattctcgctaaatgcttagacattggtttagcataactttggacatgtaccaccatgatggtgttaatcaactaaaatacactaaatggtgggctgtgggtgcatggttttgctagtcgcacccatggaggttaaggaccgtttcgcgggaaaccctggaagaatttagtgtacttaccacaagccagcgttggcaacggctgagattgtagtgtagctttcctctagctgacgtacccaggctagggtgagcgtgatggagtttggatgggccatgcgacgtctatgcagcttccggattcaccgtggcacaagaagaagctgcccgttgcctgctagggtgcggtgcgattggttagaggggattatgcgaatggtcctgtcacggcctctttccgatatgccgtggtggcatgtcggcgcacgaaaacgtgtcgtggggctatcttgtgtgtaccattgtacacctctgatcagagtagaactattcgaatagccgtgcccacggttatgggcggttgaccagattcactgtgattaatcccacttaataaattggcttaatgaactggttagttcaggtggtggtttgggtttgtctcaacgtggtgtagcgttgagcagtgatgatttaatattgattaattaactacaactgttttactgctttcaactattattcttaaatgctagctttatgcaaatgaacccctttagctatccttggttatatcctgtatcataccctctattccggtatgacttgctgagtacagtgggtagtactcagtcttgctctatctcccaaccctagagttcgagtacgcttttgatggtggctactcagaggagtaggcttggtccgtgccgtcgaggatgcttgtggaatagcgccgctcactatccaagacaagaattagttttattttaccttttcttttccactgcatttatgtaagacttttataatgtttgtaagacgtggatctgtatgtcaatattgtcgtttgtgtaccctggccggtcctgggaatgggttttaatgcacattctgcttggagttctattcgggaatttctgggcatgacaagctggtcttagagccgaccttgatcgtaggacaagccaaatggaaacctaagagccctccgaatcctttttattgcatttgttctgtgcaattggatttgtttcaggaaaattgggattcgttccttcggtttatgggaaaaatcttgatcgctcgttcaattgaaatttattaaagaggtcagtcaagggttttagtaaaattatttgggacttatttgacagtcagtcgagatttaatgggaggaatgcattaggtcctagctgaggtgtattggttgcaaagtttatttatgttgtgattattattatgtatctaatttccgcattactttattgctcagttatgtcagttatatttattcgttcatgcaaaataatatatgtacaaaattttgctcttatttgtttgttttacttgagtcctttatcgtttcgcttatatttggatttgagcatgcattgattctctctcctttgtcttctatagatggccagccgccccaacacgcaccatggtcaggacatggaaggtttcgttgctgagctcgtctgcatggcatttgtggttggtttcccagcagagctggagtgcaccaggatttgtcctctcagtagcaagttcccacaccaggtccgttgtgaggtccatggtattccctcctacctacccaacatggtggtgacagcttgtgcaggcatagttgatcatgcttgcgaggaggctgccctcaagatgatggttgttggtatttcttaacgatattactagaaatataattcccagcaatggcgcagaaatactcctggtatattatggttacagagttcatccgcaagcacacggatataccattgtagcattttacctgagaatattccaagggtatcgtatttattttatcccgtggaaagatcatgtagagagaactcaactaataatttatatattacttgtgataatcatattctaagcaaaggttaagataatccaagggtagagtgacacaagcattactactcattctcgtaatatattatgtgagctaagtagaaagaaaagagaaagataatatattcctatacttttaatatacgtatcagtgttctaaaaatcggccctaggcgccgcctaggcgcccattaggcgctaggcgccgggtagccgccgcgattaggcattcaatggtgcattaggcggttaaattacttaggttgtgttttattgctattttagtgttatatagtctaatttctatgcaatatgcctactaatttcttgaatttaactatttgacccgacctaggcgcccgctaggcgccgcctaggcggggcctaggcgccaattaggcgctaggcgccccctatccgcccaactagcgcctagcgccttcttgaaccatgatacgtatacatacattctagttaactgatatactagctaataccctctatccgatgccctcttggtacttcgagaagccacccctgactgccgagttccttacgacagcccgtgatgaccatacaaccagggctaaatacggaggaataccctccccaggaaattaacttaggattatatcaccatcagtggcccacctctcatccgcaatatgtaatcccaaataatatcccctaatctagacaccacgtctaaactaccaaatactactctaatatcattttcatgacataaagtaattgcataagcaaacattatacccgtaccaaagcatctcccagataagctagcggtatattcagtataacatgaacataatgtaaaattggtactcatatactcggaaagtatttcaataccataaatgtatatagaagagtattctaataaaagtacaaagcttacaaaagagaagagaaaagcaactagagccatacccgaactcttccgaaggcttccggactcctgatttctactctattactattccactagctagatactactaaactaaacttgagagaaatgagagagctattgcttgaggtgtgtgttgaagtgaagagagtgagctccttatatataggtagttatgatggttgtggaaggggaattttccgatgtaccccgcaaccgccatctggagtagatctggcgcgtccctaccaaacccctcatccaacggtcgagaaatgggttcggccgaacctggggccggcccaaccagcccacaatttggctgtggcctcctggacttctcttctccacagacatgtgaattttggcccaattcatcatgtcaattatgagttcttggcccttttcatacacaagtctggttctcgatatcgtccgattgatttatcgtctgagttgatgtcgattctcctccactttattgtcattctctgcaaatggttagtatacctaatactagtggaagtttattattctaacagatatatgcattgcaagcatcactagttctcctctattttggtaatattgacggtcgaaactgattgataacgaccgtcaacaaaaccccccaagctagaacctttgctcgtcccgagtgaaggacgaaaggaaacaaagacttggttgttgattaggagttgctattttgctgcatatctcaaagatacaggtgcaaggtatatgtactctctctcagattaaataatctttggcacggtggcttaccctctatccgatgccctcctagtacttcgagaagccacccctgattgccgagttccttacgacagcctgtcatgaccatccaaccagggctaaatacggaggaatacccgccccatgaaattaacttaggattatatataggcgcggaggaatacccgtactgagctgtcaccatcagcggcccacctctcatccgcaatatataaccccaaataatgatatcccataatctagacaccacgtctaacttaccagatactactctaatatcatcgtcatgacatagagtaattgcatatgcaaacactatacccgcaccaaagcatctcccagataagctagccgtacagttagtataacatgaacataatgtaaagttggtactcatatactcggaaagtatttcaataccataaatgtatatagaagagtatttaataaaagtacaaagcttacaaaagaggaaagaaaagctactagagccgtacccgaactcttccgaaggcttccagactcctgcttcctattctaattctattccaccagctagatactactaaactaaacttgagaggaatgagagagctcttgcttgaagtgtgtgggtgaagtgagaaggtgaagtccttttctagctgaactatgacggttgtgacgattggaatggtcggtaataccctccaaccgtcataggggcttcatctacaccgtacaaccaaaacctagatccaacggaggcgaggcaggttcggccgaaccacaaggttcgtccgaacatggggctggcccaatccagcccaactttggctggcggcctcctctgctgcttcacttcgtagacttgtgaattttggcctgattcatcgtgtcaagtctgcgttcttggcccattcatacacaagtctggttctcgacatcgtccgattgatttatcgtctgacttgatgtcgattctccttcactttattgtcattctctgcaaaaggttagtagacctaatactagtggaatattattattctaacatatttatgcattgcaagcatcactagttctctcatgttttagtaatattgatggtcgaaactgatcgttaatgaccgtcaacaaaacccccaagcttgaacctttgctcgtcccgagtgaaggacgaaaggaaacaatgacttggttgttgatcaggagttgctactatgctgcatatctcaaagatacaggtgcaaggtatatgtactctctcttagattaaataatttttggcacggtggcttacccttacccctgattcccacgagacactgcttctccttgccttgagcggttgaaagacagaacagcaattaaagcaccaatcacccgatctttattcaactcttgttccggaagttttcaaatgattttgaaaaacaaaaccaagttcctcaagtgattcactcagtctctctaagtgtatcaaaatgaattcctcaccaaatgttgccttgttgattcctactctaaggttttgatatgtggcgctcggtagggatcaatcatggtatacttgcattcacatttattactaagtcaaaaacttagactaaagcagataactaaacatactcaagatcaagatcgtgcataaagtgtgtgatatatggtgtaaatggtgcatgaagaaaataaagaaaatgcttctcctttttgatttactttcttaatgcttctcctttttgatttactttctttctcccaaaaatccttcttttattggaagtgggcatggctacaaaaatttcttttaacatcatgctcatgcttgatggagtataactttatttatttttttttcatttcataaccatgcctttccctcccctttctttttttttcaaaaggagctttttttctgagaagaaagcacatggaagcatggaaaatttatttttgtggtgttaacgaccgaatttggtaatatcaccatcagaaaagaggattagatcgaagcggagtcaaaggcaaagatcaattcgggaacagagtaagaatcggctgaagtccgagtcggctacggctaagatcggcagagttcgagtcggacgaggttagccgattgagttgaatccgtcaatacaactcggtgtacgtcatcgggttgagttgatatgcttcaagatgattgccacacgtgggtagagtcttgagaaggcaattgtatctattaattaggatattttatgtaatttccttagagatatgtttgggcaaatgtctgccgcaaagacttatgatatcttagagtttgttagagataagagtcgtgtccgatatggagatagtttgtaattctcgggtataaattgaccccgaaccccttgtaattatttaacacacacgttcgatacaatctcggcgcatcgccaccctttttctttagttttatttcgacgagttcttgctttcgggttgagctgcatcggtttcgatcttcaacaagaggtaaaacttgttatgacggcttgcgttctcgggattagtgcttccatttttatgacactctaatcttgtttatgtaattcgtcgagttatcatatatcttacataatctctggcaatatcgctatctaacctacaatcggctaacatctttcagtagaggacaaccgattaggttagacatcgacgttgatttagattatataagatatctaccactctatgaaacttctagcggcttgattgtctagatattgttcttcttttcatacttaatgctgcatcaattgagtttgatctattaagtcgtgcttagaatatcaactctagcctgccttctggttgccgattagggtagcatcggggttttagccaatcttacctgatttaactacatttgctttatgtgttttattgacatgttaaatctgccctttatgtcaagatcttattgcatctaagtatattaagcttctgtttgatatattctgcttgttttaatatcttaacatagagttgtatcggagtatttgctgatacatgctatatctatctgattggctacgctatgaacatatatagtcttgttgttaatacatatttcgatctaagtgatttatactgtctcggcacggtgaccgatctatcccaatcacttgatttaattatatatcgacaccaggattatatattgttaatatctatggccaatcgagtagatttaattctttattatctatttacaaccgccgatcgatttaaatatgacatcggctcaaagataaatgttacgtcatcggcacctagccgatcggctatcatttatggatttaaccacggtttctttgtctttatttcttgttgattgcaggatcaaatgaactggcatgctagcatacccaaaggcaagtgtaacatacctgaattctaggattaaggaatttccatcaaaactagttgaaagggaagttcttcaattttgtaaaccaaaaatttctattttaaacctaggtggagttgatccaactcttgcaagaataaaatttgagaacaaattaaaaactttttcatctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggataatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacatttacatgcatttaggaaagggaaacacatataagacataagtcctgcgaattatctaaaataattcatgcaagataaaatcatgggaaaatttatgtaggctctaatcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtaatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaatttaggtatcttcatctaccttcagaaaaatccacactaaattattctacccacaaattaaataattgaaatactaaagtgggagagagaaataatccttaaaatcattcaaaccttttgttcacccacgtttctgcccaaccctctcaccctagcctagtttgccacgacctggacccatttggcagccactctggctcgtcctcaccctgtgcaaatcttccagccggaccagagacagccgagagagagagattggcgccggctgtgtacgacgcgtggcctcgacgtggcagcgccgaaccgaggcttcaactccacccagctgcgtcaccattcttcacccaccatcccagtgccgatccaaccgagggaggaagctccagctctccctctccacctctctttcgttgccggccgccaagaagagggacatcgccaaccgtcgtcgagctctcttcatctctaactcatactcggtccattctcatctcaccatgacgaacaactttggttttgatcccattccatttcatcttctacagcagcgggaacgccgccatgtcatggtcgctctagagcgcgctctgtgcaccgccgcagtgacatcatcgccgttcccgcttatctggaccaagccgggccaagctgtcgcgccagcgtcttcgcctcgacctcctctccatttcccctcaagaatctcgaaggatggtgctacgagtgtggagatcgtccaccgtcttctccacctctggtcaccatcgccgttgccgaatccaccccctccggtgagtaccaacccaattccatgcatcagtagcatctctggggcctctctaacctcatggacacacatgcatgatagttcttggagctgattgagccatcgccgttcattcggaggttcttgccgccgccgagccgttacacgagccgccgtcataaacctagctaccccagccatgtctaccatcttggtgagcacccttcagcctatagaacatacatgcatgcacccaattaaccaatacatgattgtagaagtacatgcatcaccacccgaaaacatcctcctttcggactcgccgccggcgttactccgatgtccactgaccgagaaaagtagaggaatggaatcgaaataacatgatcttcattttgtattttggttgcacccccaaacgagccatcgtttgtcgccggtgagctcgagatcgagctcagccatggctgttctgcctctgtgcgtgagaatttaaacaactataaggtttaatgtgcaacttttcaactcactgacatatgaggctaggtctgcgggttgattcttagaaacctcagggatctttttgtatattgatctttcactggcagtggaccccttggaaacaaaaatctgaaattataaaaggaaagtacctaaaacttgtaaaatccatataaaattaaatatagctcattttaagatgatacaaatttctgtgaactcaccaaattgtgaactttagtgttatggaataaaaacttgcactcacagtacaaatttagcctctaaaatttatccaagttaaatcacacataaagcatgcacaaacttataaaatgcatacaaaattcatttcaactcattttggaacaaactcagtttctacggatccaccaacttatgttctcctataaagaaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctagtagagtgaattatagcaccctcttacagatcatggctctgaaccttaatttggtagaataggtactaaacacatagtagtggttaaacaatacatatgaaaaagtatatatatgcatggtagctccaaataaatccaaataaaacttgttgaaccagtgaaggcatagatccatccccttccaccaaaacttagtatccttaactcatataataatctccagattgatatcttaagtttctaacatagaacatcccctagcttataaaatgtgaagtaaagtaatttgaacactaaaattttataaactaagattagattagttaactaaaatactcattttatacaacactagcaagttagagcaagttctggacctaaatctccaaagccatgtacacatagggactatatacctagaacacgttaaaacttgtaaaatatataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattcattttataccagtacctattctctgtgcacaaatcatgcattttagaacattttggatttttcgcatatttcggtgtttaattgcataacgtgtactttgtatagatgattgcttaatcggtgaagaagtgatttaggtgctgacattttcctgattcaaggcaagtcccacctccctctctttgatcactttgaacctatcttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcttagccatgcttagaatggtcttccttgtcattatgggctcatttcaaacatgaaaattgatttttaattaatctggacagaactttaatacttgtgattttgataaataaaatggtggaaaacatggattttaggtttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagcccaagcttagtaaattatttatggtttagccttatattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggccccccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgcttttgcatgattattatttcgcatcatgtgggtaagtgtacaaactctgcagagttaaaactaatcgattagccgtgctcgcggtcatgagcagcgtgtggatatgtattgagtatagacttgtgtttattcttctaaatgatgaaatttaccttcaaattgtgatgagatttgagaatgatctccttgctgccatggatggcaatgaggtgaatatttatacatgattaatgcctaccttgatgcccaatatgtcaaatactagcttgctgaaattttatttgaaagtaagcctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtaatgcgggtattcgactgcttcttctaggacttgagcttaatggggtaaacccctagtcggtgtgcttgtggattgggtagacaagcttccgctgttctatatatttatttggccagttggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaagctgaagttgactggcaggctaaaggcccggcaatgtctccaatattcctctctcgaggcgtcggatatttcattatacttgtttgatgacttgaattatacatttcatctctcaattataatggaaggtccggagagcctacgacagcaagttttggacttgcactggagttaagcagatctcctaggcctcgtgttttatatcaacacgcttttggcacgcccagtgggaccgattagaagtcagaagtcttttctcatggacgacaagccgccgacatcaccgtccttggctagcccaggttctgttaaagtgaagatccagcagttagaccaatacgaggttaatgaaggcaacatcgtgaacattactccagacaagctgacacccgatcaaaagaaagattttgaagcgatgatgcagcaagcacggaaccagttcttaaactcatttatgcagacccgcaaggggacaatggtgcaaaagtacaaggtaagagaagtggctgatgtccccgggaccggttcttccaaggatggaggagtgaaacaagctccagatggctcggctcaaccgagcaacaaaggtgctgagatgattctcatggaaatcaaggtgacaactctcagggagttcaaggagttcaaggtgatggtgcccagggagttcaaggtaaaggccctaatcaagacggcaatgcaacacagttgcagttcaacaacttccaagatcaggttgactatgctgtacagcatgctttgatcaatcaatctggaatattaaccaatactttagcaaacatggtgaagtcaatggttgatggttcaatggccaagtatcaagctacaggaccagtctacttaccaggaggggtgttcccgaattatcagccactaatcaccgataatcaaccagttgtccagtcggccattaatgcaccatcggctaagccgatggcaccattaccagctcctgcctgctgcaccaccttcggttccaggccaattggttaatcctcgattgttggtgagagaacaatcatagcacagtggacggaatgtgaatcggctaacccaagacaaggttgcatctatgttcttacctcctcaacataccattgatccaacccagcaacagccgattcagcaaacaccgccaaggcagcaggttgtgcagccgattcaacaaacacccccagtccaacaggttgtgcaaccaattcagcagacgccacagagacggcaggttttgcagccgattcaatagatgccattaaggcaacaagttgttcagccggttcagcagcaaggcttagtgaatgcatcggctgggtttgcgatacctggtggtcagcctgtgcaacatagtgcaaatcaagttgtcctggagcacttggttcatcacgtacaaccatatagcacagtgattccttaagttattcctgaacatttggtgcgcaatattcagccggattttcaaaattacaagggggcaatttgaattataagtatcagccgccgtcaccgcaagttcaatagcaacaggcgggatcagctcaaccccagtttgttcctcaatacaaccaatttgagcccatgtcacagcagtctcaaggaacgcctcagcaacaaccatgggccgatttgattgcggatgtcatgaaggagcaatttgggcttaggccgaaagatgctggaaatttataccgacagccgtatcctgaatagtttgagagagttcctctccctaaccggtttaaagttccagattttttaaagttcttagggcaagatagcacatcaacttttgagcatgttagccgatttttagctcagtgtggtgaagcatcggctgtggatgccttgagggttaggtagttctggttgtctttgtctggatcggcttttacttggttttcttctttactgtatggatcgattaacagttgggccgatctggagaagcattttcacagctacttctatagtggggtacatgagatgaagttgtccgatttgacagcaatcaagcaaagacatgatgagcctgtgcacgattatatttagatgttcagagagatgaggaataagtgctacagcttaagtttgactgatgctctgttagccgatttggcttttcagggtatgattgctccaatcagggagaaattctcatctgaggactttgaaagcttgtcgcatcttacacaaaaggtaactttgcatgagcagaggtttgctgaagctaggaggaattctagaaaggttaatcatatctgtccttatatgtgtggatcggatgatgaggatgatgattttgaaatagccacagccgaatgggtaaggagcaaaaaggttgtaccatgccaatgggtgaagaattctagaaaagaggagaggtatgactttgacatcaccaaggttgacaagatttttgactttttactacgagagaagcagattcaacttcctgctagtcacacaattccgtcagttgaagaattgggcaagaaaaggtattgcaagtggcataattctgggtttcatactactaatgattgcaaggtcttcaggcaacagatccaagcggctatcgaaggaggcaaaattaaattttgtgattctaagaggccgatgaaggttgatggcactccttttcctgtcaatatagtgcatacagctagccgaacagccgatggaggtcgtacaagaggttttcaagtaaattcgactaagttcatcaataagtaccaaaggaagtatgacaaacagcaggagaagcattatgaggaagatgatgacggttttgatcctcattggggtcgtgagttctttagattttgttggaatgagggtatgaggctgccatctattgaagactgtcctggatgcggcaatactgcaaaaagttcaagccgatcgtataatagaggcaatcggccagggcagacaagggttcctgttcatcaaagattgggtcctgtaaatcaagattacggtcaagaggacaatgaaaacaggaaaactcaatggtgtccttctggtatctttactaagaatcagaagagaagggtcaaaagattgagaaaccgggaacgttttcaggaggttgaacaggaaatcaatcatcggctaaagagaacaaagccaaagcaggagtggcgcgttaagaaacaagctcctatagccgatgaggctgcggccgatgaagcaaagagattggccaaagggaaaaagcgttgtgactgcatcggttaacatggttttcacgttgcctgctaagtttgggggtcaagcaagctgatgtcgatgaggttgaggaggaatcggctaagttgtttttgtcgccagaacaagcagtcttcgagaaaccggaagggacagagaatcggcatcttaaaccactctatataaatggttacgtcaataagaagccgatgtccaagatgatggtcgattgtggggctgcagtgaatttgatgccttaagctacatttaggaaattgggcagaaatactgaagatcgcatcaagacgaacctggtgctcaaggacttcagtggcaatccattagagactaaaggaattctgaatgtggagttgacagtcggcaacaaaaccatccctacatcgttctttgtcatcgatttgaagggttcttacagcttgttgcttggaagggattggattcatgccaattgttgtattccttcaaccatgcatcaatgcttaattcaatggcaaggtgacaagattgaaattgtgccagccgacaggtcagtaaatattgccagtgccgatttggctctttgggagatggattgtcttgattgtttgtccgggaaagtttgggatgaagatattctaaaagtgtccgattctaatatatagccagttgaatatggagaacccaagcaattattttgagggcgtcgtggagggttcaaacgtctacaccaaggacacagtagatgatctcgatgacaagcaagaacagggttttatgtcggctgatgatttggaagaaattgatataggtccatgtgatcgaccaaggccgacatttattagtaagaatttatctgcagagtttagaaccaagttgatagagttattgaaagaattcagagattgcttcgcttgggagtattatgagatgccaggacttagccgatcgattgttgaacatcggctacctatcaaaccaggggttaggccacaccaacagcctccaaggagatgcaaagccgatatgcttgaacctgtcaaggctgagattaaacgattgtctgatgctggttttattcgtgcttgccgagatgctgagtgggtttctactatagttcctgtgataaaaaagaacggtaaggtcagggtgtgcattgatttccgaaacttgaataaagctaccccgaaagacgaatatccaatgccagtagccgatcagctggttgatgctgcctcgggacacaagattttgagttttatggatggtaatgcaggatacaatcaaatctttatggttgaagaagatatccacaagacggctttaggtatcctggtgcaatcgacttgtttgagtgggttgtaatgactttcggcttaaagagtgctggagctacgtaccaaagagctatgaattatatatatcatgatttgatcggctggttggttgaagtcaatattgatgatgtggttgttaagtctaaagaaataggagaccacagagccgatttgagaaaggtttttgagagaaccaggaaatatggcctaaagatgaacccgacaaagtgtgcttttggtgtatcggctggccagtttttgggatttcttgttcatgagagggggattgaggtaactcagaggagtgttaatgcgatcaagaagattcaacctccggagaacaagacataattgcaagaaacgatcggcaagataaattttgttagaaggtttatttctaatttgtctggcaggttagagccttttacgccattgttaagattgaaagccgatcaacagtttacttggggggcagagcagcaaaaagctttcgatagtattaaggaatatctcggctctcctccagttttgattcttccacagaaaggaataccttttagattatatgtgtcagccggtgagaagttaatcggctcagtcttgattcaggagcttgaaggaaaagaaagagttgtattctatttaagtcgtcggctcttggatgcagagactagatattcccctgtggagaagttgtgcttctgcttatatttttcatataaaaggttgaggcattatctattatccaatgagttcactgtcatatgcaaggccgatgtggtcaagtatatgttattggctccaattttgaaaggaagcgttggaaagtggatattttccttaactgagtttgatcttcggtataagtcaccgaaggcgatcaaagggcaagctgtagccgattttattgtagaacatcgtgatgattcaatcggctcggttgagatagtaccatggactttgttctttgatggatcagtgtgtactcatggttgtggcatcggtttggttataatttcccctcggggggcaggttttgagtttgcttatactattaaaccttatgcgactaataatcaagctgagtatgaggcagttctcaaaggattgcagttactcaaagaagttgaagccgatgctattgaaattatgggggattctttactagtaatcagtcaattggcaggggaatatgagtgcaagaatgatacattgatgatttataatgagaagtgcgagaactaatgaaggaatttcgactggttactttgaagtatgtatctcgggaacaaaacagtgaagctaatgatttggcccaaggggcatcagggtataagccgatgatcaaagatgttgaggttgaggttgcctcgataacagccgatgattggagatatgatgtacatcaatatttgcagaatccatttcaatcggcttctctgaaattgagatatgaagcgttgaagtatactttgttggatgatgaactctattatcggacgattgacagggtcttgcttaggtgtttgagtgccgatcaggctaagattgcaatcagcgaagttcatgaagggatttgtggtactcatcaatcggctcataagataaagtggttgcttcggcgtgcagtgtatttttggccgacaattctggaagattgtttcaggtattacaaaggatgttaagattgtaagaaatttggggcaattcagcgagcaccggcgtcggctatgaatcctatcattaaaccatggccgtttagaggttggggaatcgatatgatcggtatgattaatccaccatcgagtaagggacataagtttatcatggtggcaaccgattatttcaccaagtgggtagaggcgattcctttgaagaaagttgattctggggattctatatagtttgttcatgagcatataatctatcgatttggtatccctcaaatcattacgaccaattaaggttcaattttcgtgtccaatgagtttgttcagtttgccgatagcatgggaatcaaattgttgaattcttcaccgtattatgcacaagctaatgggtaggccgaggcatctaacaagagcttgatcaaattgattaagagaaagatttctgattatcctcggcaatggcatactgtgttagctgaagcattgtcatggatcgattcacatccctccttataagcctgtttatggccatgaggccgttttgccatgggaagttagaatcggctcaaggagaacggagttgcaaaatactttaacagccgatgagtattataaccttatggccgatgaaagggaagatctggttcaatcacggttacgagcccttgcaaaggttactagggataaggagcgagttgctcggcattacaacaagaaagtattatgtcacgcccagaaattcccgaatagaattccaagcagaatgtgcattaaaatccctgtccaggaccggccggggtacacaaacgataatgttgacattcagatccacgtcttacaaacatcataaaagtcttacataaatgcagcggaaaaaacgaaagacaacaggagctaagccttgactagaactgcagcgggaacaccactccacaggcatcctcgacggcacggacgaagcctactcctcggagaaacctccatctgacacaaactcgtactctggggttgggaaaaatagagcaagactgagtactacccactgtactcagcaagtcataccggaataggggtatgatgcagggaattatcaaagaagagctagagtggttcatttgcataaagcgagcatttataaatagaagttgaaagatttaaacagttgtaataattaattaatattaactatccactgtccaacgctatcccacgttgcaacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacatttccgtgcgccgacatgccaccacgacataccggaaagaggccgtgacaggacccttcgcataaccccctctagccaagcacaccacaccttaggtttcacccccgtccccagcgggcaacgggcagtcccctctcgtgcctaggtgaatccggaagcgacagaggccatcgcagggcccgccccgctccatcacgcccacccttgcctggatgcgtcgactagaggaaagctacactacaagcccggccgttgcccacgctggcttgtggtaagtacgataagttcttccagggcatcccgcgaaccggtccttaattgtcatgggtgcgaccagcaaaaccatgcacccacagcccaccatgtgatttattttaattaaccaacaccaaagcggtggcactaatccaacaataccattagaatcaacagcctaagccttaataggattttccccattgtgccctagttgaactaagcatggctaagcaatccctagtccaatctctagtcatgttataaccccaagctgacaaagggacatggtacaacaatagcatgctatgacaataggtaatcaccccatagtaacattataaaacaatgcaatatttgaagaaaaacaatagagcatttgcaatataggatcaacaagttcaagtgacaagcatgacttgccttgctctgatgctggaggaacctcggcgactatttcgaagtacaccggagcgtcggaagaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattgctataacaaaaagtccttaaatcatttattgcgcaataaaccccagggctgccgtcatcaagggggagggggtgcggcgccggcaagaggggcccacacggcagcggcgcacgggggggtcggtctaccgtggaccgggaccacgcgggtggtccaccgccggtccacgggatcgacgggccggatcggcccggggccgttcggacggtgcggcggcggactggctcggctcggctcggcacaaagccggccggacggccatggcaaggggggcggcacgcgcacgttcaccggcgacggcaagcggtggcgcgggcggcgacagcggacggcgccccggcggcgacagtgaccgaaggcgacggcgagcgcgggtgccggcggcgcacgggaatcggggaaggaaaggaaaggggagggagtcctcaccggaggggattgcgacgaccggcgacgaggagcgacggagggaggtcgacacgcggcggacggggaccgggacgacctaaagaacgaaaaggaaaagattagagagggagagaggggccatagaaggtgggaacgccggccgaaggcggcggacatggcgactctcaccgtcgcacagtgggaatggcactccggcggcgaacctcgacgaaggagggtggacggggtggatctcggccacgcgaacccgacggcggtgacggcgcggtgcggcggcgagcctagcggcggctagcggcagccggtgtcacatcctaaaaatccaaaaatatataaattgttgtttaattagaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaaagtttttaaaagtctcttttggctttgggccgaaagtcggcccaaaacccttccctctctctcttcgctgacaggtgggtcccgcctgtcggagtcgtcgtcttcgtcgcgccgccgccgcccgaaaccctagagccgcgccgccgccgttcccttccaaattcgatcgattctttccgtttccggccgaattgatagaggggaaacaatcttcgggatctcctctaccttttctcctttggaaacatcggctaaatcggtttggaaatcgttggattcgaggtcgaataggatcggcttttctctctctgagcccgatctttccttctcgtcgccggtcgccgtgggccttcgtcgccgcctcctagcccctttaaaaggatccccgagctctcctctacccgtcgccaccctcgccttcgcctctcgtcgccggtagagctctagcgccatgtgccctagcaccgctgtagccgccgtcgctccagccgtgcgccgccggcgtttcggtcgtcgtcgtcgctcgggaaggccaccgtcgggatcgccaagtcgtcgccgtcctcgtccgccccttcgccgccgccgaagatcgccggagcaccgtcgccaccgtcgacccgatcttctccgccgccttttcctcgacgtcgtcgccatccgttggtcttccgccgacgttttggtcatcggtgagttcgccgcgtcgcgctctacccgttggtgtcctccgttcgtgccaaagcgtcgccgttcgccggcgagcgtgcgccgtccgagccgtccaagccgccgccggagatgacgtcgccgctgacgtcatcgggacttttcgctgtgggccggtcgtggaccgatggatctcggccgtccattttggatcaagtcgatctcggccgtccgttcgcgtgaaccgccgccgtgcgcccggtccaccgaaaccctagccgctgacacaataaatcctcttttccttttcaaaaataattcattattgcgtcataattcaattaaaatttttctaaaattgagatctacatgttaaaaatatccacatgtactgttcatgcttgtttatgtgctgttttggtgattttgcttctttctgattagattccgtcgtttccggagagtccgttttcgcagcagaagagtttgaagagttccaaggccagcaaggcaagtcacccagatcccaaacaaccctttgagcatgttgatcctatttaaagctattgtttctattcaactattgcatttattttcgaatgtcattgggtggaattaacctattctttgttatagcccttttgttcttgattactttattccttgataccttgggttattataatttgactagttgagctttatttatattggttcaactagatattagatataattgcttaaccttgcttagaaacattagcacactattgggataacttatgattcactattacttaatgatggcttaatgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttacttttgtatagtatggttcattgcggggcaccagactgagaagtggcggagataagcccacgggggtcgctggggagtccatgccttgttttataaggatgtgattatgatccaggaatggtgcgctgcggtggattgtgttatgcaaggggtattgtcacagctcctttccgaggtaccgtggtggtattgaggcacatggtgacatgatgtggagttgtgtcttgtgggtacagtggtacacctcagattagagtaaaactattcgaatagccgtgcccgcggttatgggcgggtctaacaatgtctttcgtgattagtttcacacctctcatcataataacagatgctataattgataataatttgattagctcctggtttggaatggtatattcctggtttggagatagaactgtgcagccgggatggttgttcagaatggttgggcctgtacaacagggtatgttgtatagcgttggtttaatattgtttaattattacttaaccgttttattaaattctcaaatgttcgctaaatgctgcttttgcaaatgaaaccctattagcgcatgctttggtatcctgtgcacttgcatatttgctgcgagacttgctgag

SEQ ID NO: 30671 - DNA, 11476 bp, Oryza sativa
agaggaactatctacctctgtaatgaaaatttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgcatttcataatatttttttttgtggttctcattcaaaatttattccagtgttattagtactgtacatctattactgtactaatggctcatttaccagcaaaagttttacaatattgttttatttaatcttgctgcaataaaataaatttagcatgttgattttataactttcttttatttctttagaacctgttgttcaaaagtacaaaatttgtgaccttatttccaactatttcaacttatcttgcaagcttggtttactttatttacttacctttttaccttgattttctaactttatttaaattaatccaaaaacttgtgctattaattggataaatgccttaactctctcctttcacttgtctttagatgccgcgctacaagcctgagtacttgtttggtgttgagggatttgtccaggagttgcgtacgatgtcttttgtcataggatttgggactgcccctttttatgcccagattcctcatgatcgtcacgaagagaagtgccgagtcaaagtcaccttgaacagtaatagtgaagatattccctcagtgatgttcgaagctggaggaagaaactacatccatgcatgtcaggaggtggcaaggatcgccataggagagctccgcgatcgctacagtgatcagttggccgacactgagtatcgctaccatcctcgtcaaccacagggaagtgaccgtggcagctaccttgagactgaaggaattgagaatgatgctaccacaaggcatttggttgagatgctgtgggctatggatgaaacccgtgcagagagtgtgttagcagctcaagatcgtgaagatcagaatcgtggtaagatttgcaagctagaaggcaaagtggatcgtttggagaaggaactagccgcattgaagggagaagcaccaccgctgaaggccagggttcgtcttaccgcaaggaagagagctctatttgtccctcgctatcaattggcgccaaaggtccgtgtggtggagaaagaagttaccccagccctagcggatcctccggtcatcatcataagtgatgatgaagaagaagaatccaagcgcaaccattccaagattgagtgggtagctactcaagatgatgaagacgagccgaacgagccttcaatcgacctccgatgctcggaagaactagagtgccatgtctaaccgttgtcttagatcgttgtgttagtttgcttgttttaagtttggttgtgtgtctcgcgtgtgatttacatcaatggtgggaagtaagtgcatgcgtttgtttgcttttgagtgttaggaagttggtgagtttagtggtgtgagagtcttcagtttgtaataatgaaacttagttaagatcaataaaagataaagtaattctctgtcctaagtagttttcccccggtttctcttcttgtgccctgtccataccagatggtgaatactcgcagcaacgggaatggccccaacaaccccaataacaacaacaacgaagggaacccaacacttgcccaagttcttgctcagcagactcagttaatgaacatgatgatgcagcaacttcagaaccagcagaaccagggaaataaccatgcacctccccagaacaagttagcagaatttcttcgtgtgaggccgcctactttctctagcaccactaatcctgttgaagctggtgattggctgcatgccatagaaaagaagttggatttgcttcagtgcaccgatcaggagatggtctcatttgcatcacatcagttgcatggccctgcctctgaatggtgggatcacttccgcctgaacaggaatattgctgaacctatcacttggcttgaattcaccgctgctttccggaagacgcatattccctcgggagtagtgtctctcaagaagaaggaattcaggtcgctcacccagggatctcgctctgtcactgagtatctgcacgagttcaatcgtctggcccgttatgctccggaagatgtgcgcaatgatgaagagcgccaggagaagttcttggaaggacttaatgatgagctttcttacccactcatgactagagattatcctgatttccagaagttagtagataaggctattcgccaggaggacaagtacaaccgcatggagcaaaagaaacgtcggattgctcaattcaagacacaacaggggaataatcagaggccgcgtcttactttaggaccccagtctatgccacagggaggttcttcgtctgttgttcgtccgcagcgttagttcttcaacaacaatgctggcaacaacatccgcaatcaagctccacgccctgttgcagctccaacacagtaacagcctgccaagagggagcaaggcagcaagcccgtggtgtgtttcaactgtggagacccaggacattacgctgacaagtgtccgaagccccgacgcgtgaaggttgtccctgcccagagcaactctatcgcaccagcgccaaaggctcgtgtcaatcatgtcgctgctgcagaagctcaagatgctccagatgtgattttgggtacgtttcttgttaactcagttcctgcaacagtgctttttgattctggtgctacacattcattcttatctatgagttttgcgggaaatcatgggatggaaatagaagatcttagacgtcatttgatggttagtaccccaagtaatcaagcactctctttgaaacgtagcccctctgtcagaatagaaattcaaggagtatcatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttcggagtctttaaggtcaagactgaaccaaataactttggaagagattcctgtagtccgggagtatcccgatgtgttcccagacgatttacctggtatgccgcctaaaagggatatagagttcagaatagatttggtatcaggaacaactccgatccataagagaccttatagaatggcagccaatgagttggcagaagtcaagaggcaagtagacgatttgcttcagaaaggatacatcagaccgagttcatctccgtggggagctccggttatttttgtggaaaagaaagatcatacccagaggatgtgtgtggactatcaaaaataagtatccgctacccagaattgatgatttttttgatcagcttaaaggtgccactgttttctccaagatagatcttcgatcagggtatcatcagttgagaatcaaacaggaagatatacctaagacagcttttaccactaggtatgggttgtttgaatgtactgttatgtcttttggacttaccaatgcccccgctttcttcatgaatttgatgaataaggtatttatggaatacctagacaagttcgtggtggtctttattgatgacattcttatctactcccgaaccaaagaagagcatgaagaacatcttcgccttgcactagagaagctacgagaacatcaactgtttgctaagtttagcaagtgtgaattttggttgtcggaagtgaagttccttggtcacgtcatctcagcaggaggagttgccgtcgatcctagtaatgtggaattcgtaaccaattggaagcaaccaaagacagtttcggagattcgcagtttcttaggcctcgcaggttattatcggaggtttatagagaatttttccaagattgctaagcccatgacacgactgctttagaaagatgtgaagtacaagtggtcggaagaatgtgagcagagttttcaagagttgaagaatcgcttgatatcagctcctattttgattttacctgatccaaagaagggttttcaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtggttcatgcgttgaagatttggcgtcattatctttttggtacttgtacagaggtctataccgatcacaagagtttaaagtatatctttactcagccggatctgaacatgagacaacggagatggttggaattaattaaggattatgacatgggaattcattatcacccgggaaaagctaatgttgtagcagacgctcttagcaggaaaggctattgcaatgttacggaaggacgacagttgccattgcagttatgcaaggaatttgaaagattgaatttgggaattgtcagtagaggtttcgttgcagccttagaagcgaagcccactctaattgatcaagttagagaagcccaaattaatgatcctgatattcaagaaatcaagaagaatatgagaagaggaaaagctatcagtttcttggaggatgagcaaagaactgtatggttgggtaagagaatctgtatccccgacaacaaagatttaaaagatgcaattctaaaagaagctcatgatactttatactctattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcatcggaccatgactctatttgggtgatagtcgacagacttaccaaagtggcacatttcattccagtaaaaacaacctattccggaagtcggttggcggaattgtatatggcaaggattgtgtgtttgcatggcgtccctaagaaaatagtgtctgatcgaggcagtcaatttacctcaaatttttggaagaagcttcaggaagagatgggttctaagctgaactttagtactgcttatcatccgcagacagatggacaaactgaaagggtgaatcaaattttggaagatatgttgagagcttgtgctttagacttcggtggaagttgggataagaatctaccttatgcagaattttcatacaacaacagttatcaagctagtcttcagatggctccttacgaagcactgtatggtcgtaaatcattcaagaaagattgcgagtagctcagtctcgtcataagagttatgccgacaatcgtcgtagagatttgagttttgaagaaggagattatgtgtaccttcgtgtcacgcctcttcgaggggttcatcgtttccataccaaaggaaaattggcaccgcgttttgtgggaccttataagattgtcagtagaagaggagaggttgcttatcagttggagttacctcaatctttggcaggagtccataatgtgttctatgtgtcgcaactaaaaaagtgcttaagggtacctaccgaagaagctaatcttgaacagatagaagtccaagaggatctgacttatgttgagaaaccaatccgtatcttggaaatagatgagagaagaaccagaaatcgagttatccgtttttgcaaagtccaatggaataatcactcggaagaagaatcaacttgggaacgagaagatgaattgaagtcagctcatccgcatctgttcgcctgttcttccgaatctcgaggacgagattttgtttaaggggggtaggtttgtcacaccctaaaaatcctaaatatataaattgttgtttaattggaattattagaatttattttaaaagcctagaagagaagatctaattttaattaataagttccaatataaaatggggccagataaaatttcattaaatactttgcttaattctataattcctagatttttctgggatttatttgagctaaggaagtatttttaataaatggaattgcatttcatgaataatttaaatggaaaaagtttttaaaagtctcttttggctttgggccgaaagtcggcccaaaacccttctctctctcctcggcctaagtcggcccagtccgccgcagccgcgcgcgcgccctcgctcgctgacaggtggggcccgcctgtcaggtcgtcgtctacctccggccgccgccgcccgaaaccctagcgccgccgtctccttccaaattcggccgcgtctttccttctccggtgaaatctttagaggggaaatgatccttgggatctcctctaccttttctcttttggaatcatcatctaaatcgctttggaaattcgcggattcgatctcgaatcggattcgtctctctcctccgaaccctaaaccttccatcgcgtcgccggtcgtcgtgggcctccgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgttccagtcgtcgccgtcgcgtcgccgtcctcgtccgccccttcgccgtcgctgtagaccgccggagcgccgtcgccgccgtcgacccgatcttctccgccgcttcgacctcgacgccgtcgccgtccgttgtttttccgccgccgttttggtcaccggtgagtttgccgcgtcgcgctctacgtcctggtgccctccgttctcgtcgacgcgccgtcgttcgccggcgagcttgcgcgcccgagctgcccgagccgccgccggtgatgacgtcaccgctgacgtcatcgggaccgtccgccgtgagccagccgtggaccggttgatctcggccgttcgttttggatggatcgatctcagccgtccgttcccgtgaaccgttgccgtgcgcccggtccaccgcaaaccctagccgctgacgcaataattcctttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgtttttgctcttttctgtttagattccgacgtttccggagagtccgttttcgcaggagaagagtttgaagagttccaaggccagcaaggcaagtcacacagatcccaaacaactctttgagcatgttgatcctatttaaagctattgtttctattcaactattgcatctattttcgaatgtcattgggtggaattaacctattctttgttatagcccttttgttcttgattactttattccttgataccttgggttattataacttgactagttgagctttatatatattggttcaactagatattagatataattgcttagccctgcttagaaacatgagcacactattgggataacttatgattcactattatttaatgatggcttaatgatagctcacgatggtcaatcgtgattggttaattaattaatgtgccaactaaaacctaataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggagcaccagactgagaagtggcggagataagcccacgggggtcgctggggagtccatgccttgtttataagggggtgattatgatccaggaaaggtgcgctgcaatggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgttcgggtctaacaatgtctttcgtgattagtctcacacttctcatcttaataaaaggtgctttaattggtaataatttgattatctcctggtttggaatggtatattcctggtttggagatagaactgtgcagccgggatggttgtccagaatggttgggcctatacaacagggtatgttgtatagcgttgatttaatattgtttaattattacttaactgtctcattaaattctcaaatgtttgctaaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataactgtactctattatcaatttgttattgtgtgcctcggctgattcctggacaagggttcacacacatgtaagcgtttggaattttggatagaaattccgggcgtgacaagttggtatcagagccccttgaccctaggttatgccaaatggttatccatagaagccctctaaaaatattggaaaagtagaactgttctcctccccttctcttttaattaaaccaaactaatggcacatgcatttcataatattttttttagtggttctcattcaaaatttattccagtgttattagtactgtacatctattactgtactaatggctcagttaccagcaaaagttttacaatattgttttatttaatcttgctgcagttaaatgaatttagcatgttgattttataactttcttttatttcttttgaaacctgttgttcaaaagtacaaaatttgtgaccttatttccaactgtttcaacttattttgcaagtttggtttactttatttacttaccttttactttgaatttctaaactttattcaaattaatccaaaaacttgtgctattaattggataaatatcttaactccctcctttcacttgtctttagatgccgcgttacaagcctgagtacttgtttgtccaggagttgcgtacgatgtcctttgccataggatttgggactgcccctttttatgcccagattcctcatgatcgtcatgaagagaagtgccgagtcaaagtcaccttgaacagtaatagtgaagatatcccctcagtgatgttcgaagctggaggaagaaactatatccatgcatgtcaggaggtggcaaggattgccataggagagctccgcgatcgctacagtgatcagttggccgacactgagtatcgctaccatcctcgtcaaccacagggaagtgaccgtggcagctaccttgagactgaaggaattgagaatgatgctaccaccaggcatatggttgagatgctgtgggctatggatgaaacccgtgcagagactgtgttagcagctcaagatcgtgaagatcagaatcgtggtaagatttgcaagctagaaggcaaagtggatcgtttggagaaggaactagccgcattgaagggagaagcaccaccgctgaaggccagggttcgtcttaccgcaaggaagagagctctatttgtccctcgctatcaattggcgccaaaggtccgtgtggtggagaaagaagttaccccagccgtagcagatcctccggtcatcattataagtgatgatgaagaagaagaatccaagcgcacccattccaagatcgagtggggagctactcaaggtgatgaagatgagccgaacgagccttcaatcaactccgatgcccggaagaactagaatgccttgtcaaaccgttgtcttagatcgttgtgttagtttgcttcttttaagtttggttgtgtgtgtctcgcatgtgatttacatcagtggtgggatgtaagtgcgtgcgtttgtttgctttcgagtgttaggtagttggtgagtttagtggtgtgagagtcttcagtttgtaataatgaaactcacttaagatcaataaaagttaaattaattctgtgtcctaagtagttttcccccggtttctcttcttgtgctcctgtccatgccagatggtgctcactcgcagtaacgggaatggccccaacaacaacaataacaataacaacaatggagagaatcccacacttgcccaagtcctggcccaacaggcacagcttatgaacatgatgatgcagcaactccagaaccagcagaaccagggaaataaccaggcacctccccagaacaagttagtagaatttcttcgtgtgaggccgcctactttctctagcaccactaatcctgttgaagctggtgattggctgcatgccatagaaaagaagttggatttgcttcagtgcaccgatcaggagaaggtctcatttgcatcacatcagttgcatggccctacctctgaatggtgggatcacttccgtctgaataggactactgctgaacctatcacttggcttgagttcaccgctgctttccggaagacgcatataccatcgggagtggtgtctctcaagaaaaaggaattcaggtcgctcacccaaggatctcgctctgttacggagtatctgcacgagttcaatcgtctagctcgttatgctccagaagatgtacgcaatgatgaagagcgccaggagaagttcttggaaggacttaatgatgagctttcttgcccactcatgactggagattatcctgatttccagaagttagtggataaggctattcgccaggaggacaagtacaaccgcatggagcaaaagaaacgccagattgctcaattcaaggcacaacaggggaatagtcagaggccgcgtcttactttaggaccccagtccatgccacagggagggtcttcgtctgttggtcgtccgcagcgtcagttcttcaacaacaatgctggcaacaacatccgcaatcaagcctcacgtcctgttgcagcctcgacacagcaacaacctgccaagagggagca

SEQ ID NO: 30672 - DNA, 1002 bp, Oryza sativa
ttagagttaattcttattccatcgcatttaaatttaattcatacaaatatggtcgcaataatattttatttatttctatccttacctaatatttattttaaattatatttattttgccaatttatttttagggtttattcctaattaactattctttatttgcgattaatgaacttcgaaatcaaatccaaataaaataggcgaataaaattggcatgatgcaattaatttaaaaagttttcgaaggtccgtatttttagagttttgtttttattggtcgaattttcagggtgttacagatgctcaccaagcggcacggcaccggacggaggcgagatagcggtggtgctccaacggcggccgatgggcgacgagtgatggccggggacctccgggaccctggggaaggggatagagagtttaggtggcacggggaaggcgtggtgccgaggaaaacagcggccggaggcggcaaggaatggtgaagctcaccttgaacggggaaaagcgggctcccgtgggattccggcagcgaggggcagcggccgaggtgcggcacaacacagcgacgctgggggtggccacggcatggctcgggatggctgggagcggcggtaaacggcggccgaggcggcgaaagcggcggcggtctcaggttggcagtgaggagggagttttggtgggggatttggggaaaggagatgggggacgatgtgcggcgcgcgacggcgcagcacggcggcggtgggagtgttggtggcgcccggctggagtcggcggcggcggcaaagagaggtggtgcgcgtgacggtggtgttccggaggcggagaggggaaatggagtaggggccgggctgtggcacggcgccgcgaagccgacggtggtggcggattggcgcggcgttgggtggagcagcggtggcgggcgggcggagctcaccggaaaccagccggtgcgcgggagtggcgtggggatggcggtagggaggcgcgggtagctct

SEQ ID NO: 30673 - DNA, 815 bp, Oryza sativa
actttgaaaaagattcctatagtccgggagtatcccgatgtgttcccagatgatttacctggtatgccgcctaaaagtgatatagagttcagaatagatttggtcccaggaacaaccccgatccataagagaccttatcgaatggcagccaatgagttggcagaagtcaagaggcaagtagacgatttgcttcagaaaggatacatcagaccgagttcatctccgtggggagctccggttatttttgtgaaaaagaaagatcatacccagaggatgtgtgtggactatcgtgccttaaatgatgtgactatcaagaataagtatccgctacccagaattgatgatttgtttgatcagcttaaaggtgccaccgttttctccaagatagatcttcgatcagggtatcaccagttgagaatcaaagaggaggatatacctaagacagcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtcggaagtgaagttccttggtcacgtcatctcagcaggaggagttgccgtcgatcctagtaatgtggaatccgtaaccaattggaagcaaccaaagacagtttcggagattcgcag

SEQ ID NO: 30674 - DNA, 19642 bp, Oryza sativa
  unsure (1)..(19642): unsure at all n locations
tgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgctcttcatgtcctgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattttgaagggcttctaatctatccggatcgatgaccttctgcgaaattgcgttcatgaatgcacatagctntgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcctggcgtacgtccaagaattctcaatatggtaactcccaaaatatagagttctttttccacatcgccgcgtgacaatcttcgctctctatatgctggcttccaggcccctttccgaacactactttaagatctttaaccatagcaaacacttgttttccgctgcgatgtttagaattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtacccctggttgactgtccgataggttgctaagtgcagaccaatggttaatggtggcgaacaggcagcgctcgtaggttaaactcctcctgttggtcctcgtcccacaggggaacaccttcttttttccacagctgtttaagatcttcgaccagtggtcttaggtacacgtcgatgtcgttaccaggttgcttggggccttgaataataatcggcatcattatgtgcttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtctttcctggcgtactgcaacatctgaccaagatcatccgcaacgtcgttaccatcagcagctatttccttctcgcccgtttgatttccttcaaatccaacatactgagcaaagtccggaatattgtcgtctttcacttcaccttcttccatttcaacaccttgctctacgtgggatgtacaacaattatagcttggcatgaaccccgactcaaacaagtggaaatgaatagttctggatgcagaatactccttatgattcttacacttattgcatggacaacaaataaaacccctttgcctgttagcttcggccactctcaaaaaatagtgcacgccgtcaataaactctttggaccggcggtcagcgtacatccattgccgatccatctacatgagtcaaaaaaaccgcacacaaataatatttcttacaataatgacagtcatacataattataagatatcttttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcttaagccccggttggtattaccaaccgggacaccgggatctttagtcccggttggtattaccagccgggactanagttaagatctttagtcccggttggtgctccaaaccgagactaaagatcccggggggacctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgtatgaatgtccccaaatatgtgtgcatgcatatgtactgcttgatggttggtccatatatatatatatatatcctttcgtgggaaagatatccatacttcttgagcctttttttattcctttatttaacatgtggtaaaggaaacaacggcatctgctattttgaaatatcggaaattcctagctatcatatgctactttggagcattattggagatgctctgagagaggccaagtgggagaatatagctatcctcaccccattaccctatcaaaactgcgcagattgagtgtgtatacatatatctgctggtttttaaagagcatggtgacaaccattatttaacccttttccttatcatcacgattgaccccaatttttggctctaccaacggattgtagtttacttcaactaacatgtgatcagacaccactattttgacagtcttacatagttttggggaagtgctcgagccaagtgataaacatccaaaaaagccaagtgatctccaccattttttttcgataaaagatcatatattagcccggcttttgaaagaaagcccaaaccaaacagagtattccagggtatcaaatataaggaacgtgcatatactttttatgaacaggattctatcaaaggacaacatgacgagtgataggctagagaggattcctatggacgtatttagctgacttaagttaaaggcaaaactttatcgaatacatcaggaaccagccctcccttagtctgtcaggttgagtccggccttgagctttatgatgtacccgaatatagaggcatacaaaggacgggcagggttatcaccacctgtcgtctaccctactttctgtgtagcacacaacaaatgaagataacctctaacctaaacaccacacctacgttatcgattactactctagcctcggccaagaactatcttgtttatccagagtcttagtactaaagcattaagtataaatactaagcgacgaatccgcaccgatgagaatatatctcacttaaataaactaattaaataccataaggaaacttgaatacttactttttaaaagaagtatccaccgaggtaaagcgagagaagaaagccggcaactcatgcgcttctccggcactctgatggaagaattctcggagaaaactccgatatttgggacacaccttccggagctttccttcactctcttcctaatcccacatactaaagtagctaccatgatatgaaagtgagttgtactctactttgttgtgcaatttgagagtgcaaataccttttcgttttatagctcataattacaatgctttacatcggtgatagctgccgatgaaaccttcataaccaccattggggagtcatcaagagcatacacgtggaagcagatggtgagaggagccaaggtccgttcgagcgaccttatagttcggccgaccttttggcccacctctcggcctctccttcggcagtgaggttgcctggtggccccccctacatgttataccttggttaggctcaattgtaggtagttttgattgacatgtgaggcttccaatccatgtaatcatgtctgattgtccggaggttccttctatcgcttggtgggtgtgttttctaccgaaaatcacatgcatacatatatttaccaaagctagtggaaatggttagttataaacccctaccacaaagttttgaaattatattttatttcttttatgcaggagttgatggtaaaagtttgcacttaacgaccggcaacactatggctcggtgaataatcatacacattgagtgattcaagagaatcaattgaggagtaaagttatgtttttatgagcaaaacgaaaaaacccatgacactcatcaggagaagtggaggtaacttgaatcatggtcgttccattcgtcaatcacccaagatgacatggtagacaatttaagattcacaagtacaggtatgacttgaaataattattataccagtatcattacaaagggattcattgctcttgaaagtgcatctaggcccctaataattttggtgattaattacaatgcgattagagaggactaacatttttatttaagcaaatgtgaaggttgttatgtcctcgatgagttagcgtaatgcatatcccgccaaatacgttgaagtgatgtgttgcggcaaatgagcaaatagtattatgtatccttttctttttgcttgagtcaataggaaagccgcattaagagggatgatgcattgacatatgaggagtgatcaaagtgctcaaaatcaatttttaaaagtgtttctcctcagttttagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgttcgaaagtgattttcggacttttccgaaagtgattctagaacgatgtttttggttctggatatttttggacttatccgaaaaattttcggaatgtccgaaaattctctcgttgactttgctgttggtgctgaactggaatttttggacatgtccgaaaatctttcagaatatccgaaaatcacaattattgtgtataacaggcagaatttgggctttggctataaatagccccctcccctcacttgtgagggctgctggtcacattggatatttttgtgcccttggcttgctcttgttgagattcacttttgagccttactttcttgtttcccctctcacccatgttcgattcggatttggtgtgtgtgtgagagttgtggattcgagtttgtgtgagtgcttgttgctgacttcgtgaagatttgtgagcacttgcatcatctccgggagttcaatgcttcatttgttacttttggaggttgaggactcctaggcggctaggtgtcgctcccgacccaccgatctacatgtggttggccgggaaaagtttgtgaaggtcggatctcacctccgaaagggaagagatacccttagtggaaggaggagtgcttagtgcaatctcttgaggaaagggttagctaagacccgactcttagtgagctcctcaacggagagtagaatcccctcaaggattcgaacttcgagaacaacttcgtgagcttcatctttggtgactttacttcctccctctccactagctttgcttatttgagccgctataggtctagttgatgtttgtgctagcatattcttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagctaagattccttatgactatccccctacatctacatcttatgtgagtacatttagcggcaaagcttcatacttcaatggtacggactatgtcgcttggaagcataagatgaagatgcatttgaagtctattaatccatctatttggagaatagtcgaaaaaggctatgttttgcagaatcccgaagatcccaccaaggaggacgacgagaacgagcacaagaacgctcaagccgctaatgcaatacttagcgccttgagtgaaagtgagttcaactgtgtggatggcattgagagtgccaaagtgatttgggacacgcttcagaacttgcatgaaggcacgaatagtgttcgtgagtccaaggtggagatcctcaaggggcaatttgagaggtttgtgatgttggatggtgagagcccaagcgacatgtatgatcggttgagcaagatcgtcaatgagatcaagggacttggctccaaggacatgaccgatgaggttgtggtcaagaagatggttcgagcaatcactccaaggaactctaccttggtgaccatcattcgtgagcgtccggactacaagactctcacacctcatgatttgcttgggcatatccttgcccatgacatgctcgtgcaagagtccaaggatgtcatccaatacatcaaccaaagctcaaccacaagcatcaagaaggaagacttggcattgaaggcgaagaaagaagaagaagagaaccgcaagagcaagagcaaggcagagatcgatgatgaagagatggctctcttcgtcaagaagttcagcaagttcatgaggcgaagcggcttcttcaaggaggttcttccaaccactactccaacaagtcaagtggaagacactccacaagagtgtgctacgtgtgcaaagagcccgggcactttattacggattgcccccacctcaaggatggttcccacatcaaggaagataagaagaagggtgagaagaaggatgagaagaaggagaagcacaagcatagcaagcgggaacattatggccaagctcaccttgggatgatattcggctccgactccaagttaagctcaagtgatgaagaaggagctgccacgttcaccgtcaagccttcatcaccaccgagactcttcgaccactcaagtgatgaggatgctcccatttgcctcatggcaaaggaatctaaggtaccttctcctcacaagtcatttaatgttgatcttgttagtgatgaggaggatgaggttctggatgacgaattgtttaagtccataactaaggaatccctaccacacttgagtgagttacttggaagaattgaggaccaatatgcaactcttgagaggcaagaggctttgctcattcgtgagaaagagcggtcttatgaactcaagaatgagctttctaaggagagagaaaaatgaggcttaggtacggttttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgagccatcttgttccaaaattgtcccaagtaatgaaccatgtgtgagatgcaaagatattgatattgaagcttgtgctactaactctatttctttgagtgctttgcaaaagcaaaatgagaagcttatgggactccttcacaatggcctacttaagtgccatataggtagtaaggccctaaaggagtacctaggctatcaaagggacaacttcaaccatcagggtcttgggtatgttcctccactaaaaggaaaggtggacaagagtgtgatgatcaataggccccaaggtcttagcaattttgttaaggccaaaagtatccttcctaatgattatacttcacattgttcttttgatgcatcttatgttcttaggaagaatgctagtggtcgtgttgttgctaagtatgtaggcccaaggggcaagaatatttctatcaagagagtactttgggtgcctaacgcacttgttactaacatgggaggacccaagcaagtatgggtacctaaaactagaaattgatctcttgtaggaatatgtctccggtggaagaagttgggtgattgatagtggatgcaccaatcacatgaccggagaagaatcaatgttttcaactcttgatctgtcacgccctaaaaatcctaagtatataaattgttgtttaattggaattattagaatttattttaaaagcctacaagttaaactctaataatctaggaaaattttcaacataaaaatggtctagataaaattttattaaatactttgcttgttcctctattttctagatttttctaggaattatttgagcaagggaagtatttttaataaatgaaacaacatttcacaaattattttttaattgaaaaagttgaaaaatcctcccctaagtcgttgggccgatttcggcccaactcttctcttccccgcgcggccgaaccggcccaagccggcccagccgacgccgcccgcccctcctcctcgggtcaccgacatgtggggccccggacccatcttcctcctccagccggccggttgccaggccgagccgtccgagccgccgtttgcgccgtcgattccccacatcctcctctatctttccccctaaaaatcggagcaaaccgttgagtattctctccgaatcgaactcgttttcgagtttatctccaaaaccgagtttcgtttttcccgagtcgatttcttgcgggaggagtccgatctcttcaatccaaggctataaataggaccccctagtcctcctctttcgtttgccctctctcccatcctctcccgtgctccgtagcgccgccgccgcgcgtgtcaagccgccccgccgccggtcgaagtccagccgcgccgccgcgccgtttgcgccgtcgccgccgcttgccgccgccgccattgggtgcgccgtggtgagagaaagctcggccacccttcctttttcgtcgccggtcaccggagctctgccgccccatacaagccaagccgccgccgttgcctcttcgtcgccggccgtcgttgttcgtcgtttggctcgagggtgagtaccgttgggttcgtctcgtcgtcctctacgtgtacttgtcctccaaattcgcagccgatcatccaatctccggcgagcttgccatccgagccggccgccattgatgacgtcatcgtgacatcaccatcttttcttttttcccgtttttctaatagattaaatcttcggaaaatcataactaaataaccgtaactccgattcgagtggttcaagttgctaaatttttctaaaatcaggatctacatgttaaaaatatccacatgtactgtttatgcttgtttttgaactgttttgttaatttttgtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccgttcgcgagctactgtgtgaaacatttatcgtgccaaccacaagccagcgtgggcaacggctttatcttttgacagcatgattcattatagtgcgccagactgtgaagtggcgagaagtccacgggggtcgctggggagtccatgccttgttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaattccgggcatgacatgatccaaatggcacttcacaagataacatggtcttcggggacgatggaaagggaaaggttatgggattgggtaagattgcaatctctaatgatctttccattgccaacgttctcttgttaaatctctaaactacaatctcttgtctatttctgaattatgttctatgggttacaattgtccttttaccgatgttgatgtgaccgtctatagaaggaatgattcatcggtagtctttaagggtgttctcaagggaaagctttaccttgtggatttttcctcaagtaaagccaaacatgagacatgcttagtggctaagtccaacacggggtggctttcgcatcggaggctagcccatgttggtatgaggaatcttcacaagattctaaagtacgatcacatccttggactaacaaatgtttaattcgagaaagatagggtgtgtagcgcgtgtcaagccggcaaacaaattggagcacatcaccccgtcaagaatgtgatgaccactacaagaccattggagcttctccacatggacctcttcaggccaattgcttatctaagcattggaggtaacaaatatggtcttgttattgttgatgacttttcacgcttcacatgggtgttctttttgcatgacaagagtgagacacaagccatcttcaagaagtttgcaagaatagtacaaaacgagttcgacctcaagatcaagatcattcgaagcgacaacggcaaggagttcaagaacacgtgcatcgagagtttccttgatgaagaaggcatcaagcacgagttctcggctccatatttacctcaacaaaatggagtacccgagagaaagaataggactctcattgagatggcgaggaccatgttggatgagtacaagacatcggaccgtttttgggccgaagccgtcaacaccgcatgccacgccatcaaccgcctttatcttcactaccatcttaagaggactccctatgagctttataccggtaacaaaccaaatgtctcttactttcatgttttcggtagtaagtgttacattcttaataagaaggctagatcctctaacttcgctcctcaagtggatgagggattcttgtttgggtatgggtcaaatgaatgcgcataccgcgttttcaacaaaacctccggtattgttgagatcgcgcgtgatgtgacatttgacgaaactaatggctctcaagtagagcaaattgactcacatgtgttaggtgaagaggaggacccgagtgaagcaatcaaaaggttggctcttggggacgtacgtcctagggagccacaacaaggagcctcttcctcaacacaagtggagccacctacatcaacccaagccgacgatccctctacctaaagcttggatcaaggtgaagaaggcgagcaagtgctaccctcctcgcccaagaatccaccaaagtatccaaagagatcatcccaccgacaacatcttaagagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaaccctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagttttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcctcttccactcagccgcctcctgctcctgagcgcccttcctctgtggctcgtcgtgagccgtctcctttattccgcattttgcagagtctttttggtctttgctccgcggaggccaaaaagaactgccgattgcggaattcaacgaagaaaacggctcgcgacgtcaaattcctcaaggcaaggtattatgaggatcatcacatcgatatccctccttctcctccgggtttcgaggccgagcccgatgagctagaggaggaagagattgaggatccatttgctgggtcgcctcctgacttcgacttctttgtttatgcccatggctatggctatcctcctccaccacctccagaggatcctcctcaggccccccttcgcttgagtcgtcgtctcatcgtcctctctttttggtgtcttgatgccaaagggagagattatctatcatgtctttagggtcgagcacatttggcttttatttgtatgagactatgtgtgatttctaagttaagtttaatgctttgtaaactttattgtttaattatggatgcttgagatgtaatggatcttattatgtttaatgtggtgcaatgccttatcctctttatatggtgtgtgtgatgagatgtaattattcttatgcatgtgatgtgttggatgtgatgagcaaatgtgatatatttgttgtcttgtgagcttcaatgtggatgcaaagatttagggggagctctctacttgcttttatgcacactcttaggaggagctttcactaaacctttgcaccaaaaccttaaattatactcattctctcttgtgttctaatcgtattgtcatcaatcaccaaaaagggggagattgaaagtgcatctaggcccctaatgattttggtgattaattacaatgcgattagagaggactaacatttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaccatccagaacgatgtttttggctctgagtattttcggacttgttcgaaagtgattttcggacttttccgaaagtgattctagagcgatgtttttggctctggatatttttggacttatccgaaaaa

SEQ ID NO: 30675 - DNA, 2974 bp, Oryza sativa
caattcatgcacaaatgcaaatgaaagagaatactaaacttagaggtagtgcttattactaaccatttccacaagtcttggtgaatatttgtacgtgggtgcattatggacgaaaatcacccgccatacgacaaaatacatatctagacaatcagacgtgagtacacggattggaggccctacatgtcaatcataatcgcctacaattgagcccatctgaggtacaacttgtaggggggccactaggcagcctcccagccaaaggattggctgggaggtgggccaatggggttggccgaacccaaggtcttttgaaccacctttgcctctccttgccatctgccgacgcgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattagctattttttaaaaaaaaagattaacatgattttttaaaacaacttttatatagaaaaattttgcaaaaacaacaccgtttagcagtttgaaaagcgtgcatacgtgccccaaatgtcggacttctctccgaaggagtgctagagatgtcgacattcttccaaggagttctagaggagtgccgaagatgtcagctctctgtctctctatctctttgatcttgtacctcgttggatgcttcttttacataagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagcccttaccactgcctaggattggggacttggggtgtgaggcccagagagaggttaggagatgggaatcggttgaatggttgaaacagaccagaccgggtggtcttcacgggtggcagggaaatcttgtcttttcaaaacatttctcttcttgtataggctaaaaataataaaataattgacagagcatccttcagcagattaccatattttttttaggatgtactcagaccgttctatatttttgttatgtctacatgcaaaaaccacaaattttcaatgtgcggtaccaaattttgccaaacaaccaccctggaatgataattaacaagtatgaagtttgttacaatcgtctcaaacttatttgttataaagttattgtcaaagtatgaccattaataccatggaaaatgattaaaaaggacaattatcgttatattggagggaatataaatttgtttgtgcagttcattgatacaaatatgaaaaacaaaaattaaaatgcccagtggatagacctcatgaatgattttgctatatggtttatatatggaaagtggcgaataaatatcatggctagtgtagtgggcaccttatccaaacaatgcataaaaagatagcttgaacttgcagctaaattgttcctttattccacttctttttttttattctcccaacagtggactacgcatatctgggccacgttgattttttttttccgaaaatggccacgttgattcggtggtccaatttaatgcacttgcgagcaactaattccgttccataaaaataaaccgatataaaaataaatctattatgggatatgactgtcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactgactgtaatatgtaatcacatgataaaagtccattgaacatcctacaaacacttctagg

SEQ ID NO: 30676 - DNA, 2090 bp, Oryza sativa
cggatttattaagcctaattaatttgtcattagcacttgtgggttactgtagaactttatggctaatcatggactaattaggctcaaaagattcgtcttgccatttccatgcaaactgtgtaattagttttttaatcaatatttaatacaccatgcttgtgtccaaagattagatttagtgtttttgagcaaaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcgatgaagcttggcattgtttccgaccgccggttcatttctcctctaagttcagctcggttcctttccggttagtggtggatctacctcgctcaaattttcgttaaacaacttcttcggtggccttagccctcagggctgtgattggtggttcgcctgctgatctctctgtttcccttctcaaagatcgtctttctctttttttgtctgctccaaacaagtgggtttatggatttatcgtttgagatcttatacttgcaatgattttgttctgcgcttctttctttggagaaatggtggaccaaattggtagtgggaacttgatgtttagagtcgtgaacaagagaaagaatgggtttttgtggctcctaagaaacgtgtttctgattctttgaggcaacctggtcgttcttatgctcaagctactcagcagcgggttattcctatgaagagtgtttttgatagattaaaggagtccttgaaggtgactggcggtgatactccggcaatcactgttccggtgaccaaagttccggagactaagctggtggctaatcccaaaattcaaaatgttagaggtaatcgggatcaactttctaagcaagttttaaattctaatttaatttgtgggcgttgctcagagaagggtcattctttgtctgtttgtgttgggccctttcggtgccgaatttgtaagagttcgggtcatgctgcccgtttctgtagctcaaagcaatctccctctgagggtaaattgccaaagtctgtttctaccccccgcattaatgcagttgctacggtcctaaactcccggggtaattgcaatcttgtttggagacctaaaaagcttgcgccggttatctcgtagccttctcgccttctccaatctactgttgagaatattgttcaagcctccccagcccaaagttccatgccaatggcagacctcaaccctaaccctcatcgtttccgccatcaaggtcacattgtgcatttgggaggaaatttgcgtgtccctagagttgatctcaccatccctcaaaggcctgttcgagttttgtgttgctttggtggag

SEQ ID NO: 30677 - DNA, 8654 bp, Oryza sativa
tgctatgcatagagatgccctggtccatagtgggccgtttgtttatgatggagtgcattcggtaacttttgtgaagcatgatcaaggcccaaattggagagcatctcaatgccatagagagggttggttccttttcttggattaccaccttgactttattgattgggaccatctaaaccttgctacggctacatttggccaactttctttttggcttgaaagggatcagatcaaggggagagttctgataagggctaagttaaaggataatgattttgtgcctccaaaaattgtttttgcatgatccggtgggtatgggcggaggaggagaatcatggacagtttccgtgtttttgttggaaggggatttcattaacatggctcctgatgaagatctgccccctgcgggcccccaaccaaatcctaatggtctagatgatgatgatgatcctaatgtgggcaacatttggcagatggggcagcctcctgttggtccaggtgactgggatgatttggtccaacagcagcaagctgcagaggctgaggtagaggatgcttggggctaagactatccaatgggccaagtaatggaggtaaatcctgatggtctgcttgctttggtacctattgtttcagaggatgctagcccttctgttcctgctgttgctatgcctaatagggggaaaaaggttcaggacccagtccaagacccgaagatccaggaattcttagctaacttggataaactgactagaagtgaatatcctagacacccttatttttatccaatgtctggcctgaatgagaagattgacctcttgtgcaaagaaaagggaaccatgcaccaatttcttgcttctagttctgttcctgctgccatagatgtggtcaatccttttactgctcttgttttgcccaaaaagacaatgtttgatttttctcccttagtgggtcaagagacaagtgtttgggctccggattcaacaaagtctgatgttggccccctggaggcctagacccaagctgctatggaagtacttgatgtcatgcccttgtctattcagcctcccttcagcccagtttgtgaagcaccagctcttcctgtgttacctaaggctccaattaagaaaagagatgtcaaaactttgctttataacccttacaggaggcagagtgcaaggttgcagcagaataaggaggaagcagaactgcaagtggatcccagaatggacattggcaagccaaggggtaaatctgcaaagaaattgaaagagcttgcaggcttgcaggtatagcaaaaatctttgatgatagtagcattaaagagtctgattttactaaaagtgcctatgatgatattcattctgattcctttccatctgattgttctatctcattgttgcaaaagatgggagtggacatgtgcggcttaactcctgaggaggaagttgaatccagcatggggagtgagattttgggggggggaaagtgaaagaagaaagaagatgcccaggcctgacatggaggaaaaatgattttagttttcagatgtgttttagtagacctgtacttcccttttaattatcatgtaagggtctgtatttggaacttcccttttaattatcatgtaagggtctgtatttggacaagagcttttcagactttgtcatattttggttcagttgtatgcactataaggttatgttatttcaggctagttgtactagctctggttggtttctctttcaatcctgctttattcatgagtaattatataaatcttggaatgtgctttgctggaatattaggggaaagaatgcagagccaaaattgctctctttgagacagaaaattgaggactgtgagtgccaggttttttttgcattcaggagacaaaaaaaggatcattttgatctctcagatatcaggaagtttgccccaaaacgttttgattcgtttgcttttgcaccctctagtggtgcctcaggggcattttggttgtttagtcttcaagggtttttgtcggagctgtggcggaaattaatctgttctctgtgtttgttgatttcaatttgaggcatactgctcaaacctggtccttgacttgtgtttatggcccttgtggtggcccagagagatctgattttgttacttggtttaagaacattggcaaaatttgctataggacatccaaaaaatgcgtaattagctatgggacaccgtaaaaacgtgtatttgctgtagggcattgcaaaaacctggtaattagctgttggacacccacgacattattttattatttttggaggaataggagagagaaacagttgtgtaaatacggttatacccttcgattttttttctttttctttattcttccttattttttttttctctctaattctctttctctgctcttcattcaagcgagccccagggagagggagagcgtcgtgacggcgtggaccagtgcagcgcctcggctggggcggcgttgcgcggtcgtgcgcaagggtcgaggccagcacgacgcggcggaggtggcgcccgagctggagggttaggtggtgccggcggggttgggcggcgtcagcgcgcacgcaaggacggccgggctcagcgggcgcgaccacgccgggagcgcagcggctccgggccggatttgggaggctggaccagatggcgcgaggcggccgccaacggcgacgcggcgaggctcaagccatcgcagcgggcgctcttctcatgcatggaccttcagcacctgcaaacccgatgctgagcccaacaacgatgcccaataacaatgtcgtagcgggtatgagtggggacaagggtagatcgggcacgccgtgcggcagtgatgcggcggcggcggcggcagtggagctgagttgctatcatcaggagcaagggatgcataggcattagcagcagcaaggtgtggcagtgcagagtagcgttgggccgttgtttgtcttcgtcgtctttgtcttcgtcttcacgcagtggaggctgtcggtgcatcacccgccgcaggcgttggggtcggcgggaggtggtggtggggttgcgatgatgatgagcacggagccacggaggagaagtttgtggcagcgctgcgaatggtggagacggagatggaggcggcagcgagggcggtgccggtcgccgtcgtggtcggagttggcgcagctatgcgggagctagcgacggcgaggcttgtggcgaaggtgttgctggatgtggggcccacattggattcatttgagccaagggcaaatttgtctttaatgattgtttctctctcctattcctccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatgattacggacctatatctcttatggggctcagtttaaagttcctaaccaagctaaaggcaaacagacttcaaggggtaattctcaagctagtaagtgaaaattaatatggttttattaagggaaagacaatacaggattgccttgcttggtcttttgagtacatccatcagtgtcagcaatcgaagagggaaattgtttttttgaaattggactttgaaaaagcttttgatactattgaacactctgctattctttctgtcctgcaacatatggattttcctgaaaaatggatgcaatgggtgcaaatggttttctcttcagcttctttctactgtctgttaaatggtgttccaggaaattcttttaaatgtaggaggggtgtaagacaaggtgatcccctatcaccacttctttttgtccgtggagctgagctgttacagagagtaatgaataaagcttttgagttggacttaatctctaagccaattaatgaaaatgatgggagtgggttccctatcatacaatatgctgatgacaccctgatcttactcaaagcttctcaaaaggaaatcttctgtttcaaaactatcctgaacatgtttgcacagtccacgggtctaaaggtgaattttaacaaatccagtttgtatcctttgaatctttctcatgacaatgcttctttgctcgctggtattttgggatgctccattggttccttgcctttcacttatttggggttgcctcttggtaccactaggtctagagtggttgattttgcaccattggtggacagagtagaaatgagattgacagcaagctctatgtttttgcctcaatggggaaggttaacattgattaattcagttctttcttctattccaacttattatatgtgctctttgcaacttccagtcactgtcataaaggcaattgatacagcaaggaagagttgtctttggagaggcaacaacccatcctcaactagaaaagtttttagctttttgggacagagtatgcacacctaaagataagggaggtatgggtgtgattaacctgagagttcagaacattgctttgcttttcaagcatatggtaaaattatataatggtgttgagctgccatgggtgaaactgatctcacagacttattatgtttctagagtaccccatctggttttgaacaagggttctttctggtggagggatatcacatctctttcagatattttcaggggtatagctaagtgtacaattcagtcaggtgcaactgcccttttttggaatgatctatggaatgatgattttaagtgcacaagctaccctaatctgttcagtgtgactttgtataagaatgattcagttaggaccatgtgcctacggccaatggaggactcttttgttcttcccctctcagatgatgcatgtggagaatttttgcaactgcaagaggaattgaatcatctgcagcttcagctaggaagaagtgatgtttggagttttatttggggaacaggtatatacacagccaagagattttacaagctcaattactcttctttgcaacctcctaggcccatgatttggctgtggaaaccaaatgtgtcatgaagattgttcgcatggcttctgttctgtgatagacttaacacaagggatatgcttgacagaaggctttgtgcaaaagaagatgatgatctcacatgtgctttatgcaatacacaccaccagacttcatctcttcttcacatgtcctttcagtatggcttgttggcaatagctaggcattcattgggattgtaatttggaattctttcagatgattgttttggcaagaatcaggtttgcacaaaggggtttccttgaggttttctttctggcaacatggcatatttggaagcaaagaaatgggctaatttttcagaatattcagccttcattccaatcatggaagtctttgcttatgaaagaagttcttctgcatatgtacagaatgaaagatcctctcaagcaatctctttttgattggttgcaaactttataggattgctgtttttgcagtttttatttatccctttgtaactttgtacatattttttgatctataaaatttaaaactgctgggcatagtcctggcagtacttccagtcaaaaaaaaatatcattgtggttatagacccatgcactttgcaagtttgcatgtcatctaaatataaataaaatacttaaaaattttgacaacgtgttgcgtttttataggtcaaccttcaaacgtgtcaccgttggttccaatgacaggggcacataggtttcatgtgtttgcttacaccgtggtctcgggctcaccatttggaaaataaagaactaactcaaatattaatagcacaaaccacaacataaaaaaaatatctggtgtctttacgggtggttcaagtttgaagcacacgtaagatagcagcctctcgcgtcgtccctcccccacgaaagacccaggaggcgacgccctcaccggtgctcgtctccccttacctcctcctctacctggccgcacccgagcggccgtgcggccacaaggacagcggcggcggggcttcgtcctcgcgctcgggcgggggggggggagggggggctgctcggggcaggggaaccgcccggccagatctagcggtgggtcagccagcggcggggctgagcgatgcggtggcagtgacgtctggtggtggtggcggcggcgtttcgagcctagatctggcaggatggcgactgcggcgggggtggcgaggggatggcaacggtgaggcgaacccggccgcgctggctgcggagttctggacaccctgtggtggctcggagttcgtggcgatggcggcctagagctcgcggcgacgacggcaggtcgactgcgccgtgtgccgtcggagctcatcgacggcgagaagatgcaggagttgcccaccacgtggagtgcgttgatgcgtggctctctagaaccacttgcccgctctgcccaaggcgagggctccgatgacagcgcagtcgtcgttggtgacaccgcctggcggcagcggcggctggaagtgtggctgcagcggcggcgactgggacgcaaggaggcacggaggtgcggcacggctggtggctgcgtaggctggcgaggcacggacaaaggcggcatgtggtgacatgcggcgggcgccggtggcgtgcggagccaggccggcggggggcgccggtgcagtggtgcccacgcgctagcagaggttaagttggtggtggagcatcggtgtgtcaacggtggatggcgggtgaaaactgtaacgccccgatttttgttcgggattaaaaatcattaaataaagcatttccataaattaaataaaagttaaagcaatttaatcaagtgaattatggaggaaattaaaatttcctttaaaaatcattggtcgagaattttttgtaatattctttgtgccctaatgaactctctgaaatttcccgagaattttcggagctcgagaaataattttaatagcacaaacatcatttaactaattaaataaaaagaaaacaaattaaaaccctctttttgtctttgggccgccccggcctaatcccccttcccctccccgtggcctcttcctccctcctcttctctcggcctagcccgcaacccggcctgctcctctcctttcttgcaaaagtctattcccccccagctcctctctctccctggctgacatatgggaaccaaggctccacatgtcagaaccttctcctacctccagccgcccgcgggcaactgccatgccgcccacaccgctgccaaaaccgccgcctcccgtcttctgccttccgcacgcacgtccaaccgtgtggacgtggttgccacccactcctcctcattttcccccacttttccccaaaaattacgccggtttgacctccctcgagctccacgtcgccaccccacatcgccggccggttgccgcccgattctgcccctctcggccacgatttcccctcccgtagctataaaaacacccccccccc

SEQ ID NO: 30678 - DNA, 9607 bp, Oryza sativa
  unsure (1)..(9607): unsure at all n locations
gagagaaaaagaaaagaagagggagaggaaaagaaagaaagaaaataaagaaagaaagagaagagagaaaaagaaaggagaaggagaaaaaaaaggaaaggaggaaaagaaagaaaaagaaagaagagagaaagaggaagggaaaaataaatagaaaattagagagaaattaaggaggattagaaaatttaaaataattagaatttaattatagattaattatagtcgtagaattgcaaaatttaatataattatagattatttttggtaatctctataagtaatcaattcacggtagaaattcagatttaattactaggaattttagccgtgtattatatttaatcgtttagtcatagactaaattaaatcgtacaatattataagataattttaggaattcgtccgatatttagctcgcgatagaaatttctaacctattatacggatataatactcgggctgattaaattaaaaacttgtgctaataaaatatttataccgcgaaatagcttaggatggataaattaagatcggattagctctaattcacgaacaaaaataggtaatgtaagaaactgacttccgctctcgatatcttcgtggatttacttggatctttatttgaaatctaaccgaattcaaatcgtttcttcgcacgtaattttagagccagagggagttgcggatccgagcgaggatcaagacccacagaactacgagcaaggcaagtcatcactattctttaaacatgttgatcccaattgcgaaactattttgtttacaaataaaattgcatgcaatgatgaacatcccacttgtgattatgccatgccttgattattgtttatccttaaatctttgtaaccatgattatgtatgagtccctagtcaaccatgacaattgcttagaaatgctactctagattcatgcatgctcatatttagcaaatgctatatgcctgggcaattacctttgggaaggtaattgagatgcgacatgtggagacaggagcgccacattgccatgataatgatgacatgatttatcaaagggaaataaaattaaacaactatttttgactaggacggacggaggatttgggtggtatctggaaaaggctagtaccgtccccggtcaattaaagaccgagccatgaagttaagcatgaaacaacccccgtacaaccgtacttctcgaatgggtatagacctagcggattagatagccgagcggaggcagtatccctgcatagatggttcacccctgagtgagacaggtgcgctacggtggggcagccgttgaggtagggccgagaggcgtgccctacattggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttgagttcatggagcgggtactgccaatgcaaggttatcgaaaagctttgccgtgacgcgtctcatgtgttgagacgaggcttatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacctgtgtgggatgggatattgcatgatgatttttatgctgttggagccacttcctgagagacgggaaggtggacgtcctcagaaaaccatgacgattcaatggcgggaagctatccttgggatcacaatggatggtggacagaaccgtcgttgtctaatgtgaacactagtattaaaacttgatcagtctatgctaggtcttaggcttgtgaaaagaattacaaaacttgctttgtgcaaaagaaccatagccattccttgaataccctctatcatgtgcattgttgctgtggtggcttgctgagtacggttggtgctcacccttgcaatatacaaacttaatcagaggtcggagatgaagcttcggaggatccctacgcttactaccaggaggatgatgaagacgatggcgctcagtaggtcttagttacggtcgttacctgtggcaatggcgtgccgctgtcttaactccgctaccttatctacttctgcttttggaatgtatcccggaccgctcggtccgatgatctaagactatgcctgcgggcttatgatgtaataattagcactagactctcgtgtatgtgcatttggtatgttagctatgaactcgtgtgtaccagactacttgatccagggaaatggtactgtttacacgattgattcctgttacaaaaatgggagtccacagcatcccccttcctcctctcctttccgtcgcccttcgcgcgccctctcgcgccaccgctcaccgccggtggccgtgcaccgtcgcatgtcatgtctcggctgggccggctctgagccgtgcccgtgccctgggcgccctgccctgtggccgcccgtggaccacccgtggtctcggtccatggtgccgtcccggccgcagtggaccgtgtccaccgtgcgccctcccccttgtgtcactgacatgtgggacccgcctgtcggcaccggcttcccttgctgacgtcagcggcggtccttttcctttgtaaaaataaatattaatcgcgcaataatgcgttaataattatagaaatttatttaaatggctcaaaacttctaaaattcatatctaattcattcgaactccaaattgggccgttcaacttgcaaaattcatctaaaattgaggtctacatgattgtttacttttttatgtactatttgtttggtttttattagagtttttcctcgttttgcgtgccagcgagtagaatccatcgtttcggaagtccgcggtcgctaggaaaagagttcagaagatcaaagttaagaagcaagcaagtcacacattccccttgagcattttgatcctaatttacaaatgttttaccgtttgcaaataaaatttcatgtcttgctaattacatgggatcagggtttacctatctgctcgcttgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtcatggagttgggtcggccggggtgtccggttgtccagctgccggattcaccgcggcgcacgaggggactgccggctgccttgcgaggagtgcaggtgaaaccttagcgtggtgtggatggttaggggagagttatatgaagggtcttgtcacaatcactcgacatggtgacgtgttcatcatgggcacatgatgacacggtgacatgccggtggattgtgtcttgtgggtacagttgtgcacctctggccagagtaaaactattcgaatagccatgcccacggttataggcgatcaaccagattcaccgtgattagtctcacacttaataaatcgacccaatgcactgtagttcaggtggattggttgggcctgttcaatgtggtgtagcgttgttcagtcgagagttaatattaccttaattactcaactgttttactgttttgatcaataaaatgttctacaaccgcctttatgcaaatagccacaaaccatcctcgtatccccttgcacgtctgcatcattggtatggcttgctgagtacggtggttgtacttagccttgctattgttcccccttttcagaagtgtagtgcttctgagctgaagccgaagttagaagaccaaggctcagaccccagttgagttttgcctgtggagtggagctgaagccccgctaggatcgccttttttcgctgctgtcgttctctttcggtgtgaggactaagtgcctcttctgtaagtattttacgctttatttacgtttggaactgtatattacttgtcgttttgtgtaccctggttggtcctggacagggatttagtacacaaaatagtctagaaatttgggctaaatttctgggcgtgacaaaaacccagcccggccgaggccgggctggcaacgatggcactcgatcgtcattccccctactgagggtgttgtcgtgccgtctcaccccatctagtggtggctgccgggtgaaagccctgtcaaggtttctccagaccttgacagacagcagcggcgatgctactgtcgcttctctccatggagacgccgtctaggtagcacccttgccaaaacctcccaaacatctgttgcaagctcgttctagagtcatttcctcttgtatcggcgtcctagtttatacaagttggctatgtcgaagggcctaggggggagagcggttctattattctctctcaccctctcttcctaaatccctaagatgtggatagagtgtgtttttgtgtcggttgtaagggttgggttttgagcgatcctagttgtagttcctttgttggcttagcggcggtcggccaagcttagaggcagccggtccgatgctagtcttctcctgggattgtgtttggcgtcgtcagtgtgtgggtggtggtattcttttttccttttcctggttacgatgtcccaggattgtaatcttataatttttttctattgtatcaatatgaactttgcactgactagttcaaaaaaaaatcttgtgtctttaggtagaccaaacaatccaattagtctgtgattttttttaaaatatgctcaaataataaaagcaaggccaatgaatcagggaagcattcaaaaaaatcacatcccaaaagtaatggtgcatctttagttatactagaaaaaattatctgggcattgcaacaggtgaaggctattttattttaatcttattattgtccactctgaaattcattgtgagaattcgatgttatatggtttagttaaggtgagattcactatgggaatttgcttggatatataattttttagaaaattatgagctgcagttaggagtccgttcgtatcaagttagcatgcgagtttttttacgactccttctgtattttcattcaaaagtgaacgaacttaaaacccgacttaaatacggatctgtattttcaaaagcaaacgaactaaaaaccgactcatacacggatgacgtacaaaattaccggtaaaaacattttatagtagtagagagttgccaaacttaaaaaccgactcatacacggatgacgttcaaaattaccggtaaaaacattttatagtagtagagagttctaaaaacattttatagtagtagagagttcccgtctgtgttctcgctgagctccttgaatcgatcccaaacgggtgtctcctacactgtgcagtacaattgaactctaaggccccatgaatttagccctcacatcccacagccaatccattcattaacttatataaaaggtgattgacttttttaaaaaagttggcaccttaggtgtaacatctttatttatcatctcacgtcatttgaacttaaaaaaaatgcttgcataaaataaaacaaaaaataggaaatgccaataagagtaaagcggaccaattagggaaaatcttataaggtcttagaaaaaattggttcttccttttcaccaaaattggaacacccgttaccatatccattgcgtcattttttagtgtttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcaggggctagataagtattcgaattatgtcaatatgaatcagtaagagggattgttaacttcatggaacaactgaaacataattatttgcaataatagttttaaaaattttgttaaaaaagagagcccgtaaacattccatttgaataaaaactacttacttttaatttacacttacctgtttccaaaacaaagtatacttttcttttgaatgataagtcagatcatagttaatttcttaccgaatgaatattgtatagtatgtagtgtaaagccaacgaatagcttagaaaaagttacccaagcaataccgattaataccgattaagaaggtttttcagacaagtcacaatttttgaaatatagtatgaataatccggttgatggtatataagtctctaaagctgacaataagatacacgcccgcacatttgcgtgggttacctttctagtctaatttaagaaactgttgggaacaaactcgatacaaattggtaaaacacctggagaatataataataaacaaactcgacaaagacagggttttggtgctgtcaagcagcagcattttctggtttatactcaatttaaaatagcaaatcaacatacatatcatgggagggcaatgccaccatgtgcgccacccccgtccacgtcatgtgccatcccacacgccaagcatgccacgcaactagacgcactccggcttgagccagcaagccacaagcaaatacagacgcaacaagacaaggaaaaaaaacagaaaaaaaaaaagaaccaacaagaaatgttccatcagaaatagacttcaaaaccattagttcattacaaacaatctagatcagtcatatgctgaacccagataagagataaacttgatatatccaccaatgaccaatcactgtagggactttagtgttgttcttccaagtatatgaatcttgtatggatcgatcatcgatgtcggtgaccgttgtagtcaattgaatctacctgcagttggaattatagaagaaatatatcagatttgcagaaaagaagttgtgccctttcaatatgctccatatatgataagttcacaatgcactataaaaacaggttctagtttttgacctcctggtataaaagtttgaatatttggtacaaacataatgtctgacatatgtacatgtctatataaatagaaggctactgcagaacactataccattccaacagaatagattatatataacgacatcagcacggtatcttagttagatctgatatttttaatactagataggtaccagatctagtaccgtggtacctgatacaatacccataggtattatatttggtgccaatgataccagatgatactgcatggtactaaatcctgctacctaggtaccatgctgacatcatgatgatgtcagctattccgttagaacagtgtatcgttttgtagtattatgatataaataccatgcaattaaaatatcagaagaacaaataattttgaaataaacattttcatgtttaaatttatctaaacttggtgaaaggattccataggttatgaataaaaataatatagatgcatatgggttgcacactagtaaactagaccatatagcctttgcttaccgtactactaagtaacctagttgaaaacaaaatggctaattctgtgtatcttttctacacctccatcttggtgtgcgcacataattgttgctgatttactatgcagataaacaaggagtaccaaatgacagcaggccgccattatagccagcactcaaaagttagccacttagcttcaaacagtcttatcatttttttttttgccgaactaatattttggtgcgacttttcatcagatattttacagtgctggaacttcaaaagagtgcaaaaatagtttttctaggggaagtattgagaggttaaataactattcctgaatcctgaacagtgccaattaaaatgtagggcctgggtactgtgggcctgctggtttcctattagttggaaaatacagataagaatagtttgtttccttgctaatttggtttccctcagatatattcacatgtattaaagataaaaattacattgtagatagagttttatcttgtggggccaagccaagtaatctgtacaaaaaggtagagtgctagcatgtataactattactagtaagcaagcaatgaagatgaattaacctagtctctccccctttctcaaaattgttcatccaaatctatgatctcccatcatgtacatacatacatacacatacacgcacacacatatatatacctcactatgttacctctcaattaacactaaaaacatttctagttcccaaggtccggagaaaaccacgcaaggaaaattaacactaaacattttacaaattgcacttgtattcttctcttaccaacctgttacaaccaagaatcgcatgcctagtggtattgctagccatgcaattcatttccaataaatccctaaatttcaaataggacctttactttatttcccactatacaccactgtcctccataacttcatttggggtttctcaaaaaaaaaaaaacttcatttggaaaaatcaaccaatgatggaatcagcatgatcaacaaaataaagaggaaaatataataaagcagtgttgcagtaacggaaacaaacttgaaatggaattctgttatactagccatgcaaatctatagaatattttttgcttattggcttatagaggtatgtggatagatttgacctgagaatagagcctttgggcaaggccttcttatagtattgcgctgactgccgcttgtagagcaatgactgatcatagccaccttctttctgaggccacactaggttatcccaccaatccttctcacagtatactatgggtcttggttcatgcaatccttggacgtcaggcaggtgtctaagactacagcagcccctgatcatgatggcctccagcatgggagctgacattatttttgcctcacatatccctttcaagctgggaagctcatgcaggtggacgtgcttcagctttgggaaatcaatagcatcattgcttactgtccccttggagtttgctgtgttcaaagggaaaacatatatgaggctggtgcagtacaggatctgaatggtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30679 - DNA, 655 bp, Oryza sativa
gaggaaaagaggaaaaagaaaagaggggaaaaggaaaaaaagattttcatgggatttaaataatgcacatgctcatttttaattggttaaaattatttccaaggctctgaaaattccactaaaaatcatgttagcatattttgacatgtagaacccaagaaaaattccacatgtcgattccgattattatttgtatttttttaatttagggtttctctcttgcctttaaacaaataatttcttgcaacaatttattaattaaattttggctagggagaataacttcagggcgtgacaacatgcctcctcaggaaggcagcgttcgcttggtccgatgatgcggagcgcgcattccgggcactccaacacactatcacgtctgccccaacactgcaacttccagatttcgcgcagcccttcatcatcgagtgtgacgcgtcgagtgcatggtttggtgccatcctgcatcaaggcgctggaccagtggcgttttttagtcggccgatagcaccacgccatcctcgccttgctgcttatgaaagggagctcattgggttggttcaagcagttcggcattggaggccatacgtctggttgcccatttgtggtacctaccgaccaggcaatgtgggtctattgagagtgcatttatttg

SEQ ID NO: 30680 - DNA, 4032 bp, Oryza sativa
  unsure (1)..(4032): unsure at all n locations
nnnnnnnnnnnnnnnnnnnnnnnnnnnnnnnnnnnnnnnnntttgctttctcttcttttcctgttttatcaacagttttaatctggccaaacaacaatggaaatgcatgctaacgggatgaattactatcaatgtatgttccctcacctctatatctctttttccttttcccatttcccccttaatcatgtaacattctaacttctcatttctatcaacaaaatggctatagggtagagctgctctaccttcttatgttaaaaataaaatcattttgagtacctccaaaggacacacgaaatagtatcaaatttatattaacaagagagtcacatgtcgtcactattttccccttttgaccacttccacttgttcaatgatccgtgaatgtgcatatactatgcgtagctaaataaacccaactaatggagggtcaattcatttagttatcatgcaagatttttagtttaactatttcagatttgcatagggtctagggtttagggacctcattaacaacctctcccctgctgatttgttgctttgattttttactgaaaatttgcctagctggtttcaacagagtcctcttctccggtcatctcctttcttcacggctgatcacaatctaaaaaggtgtctttctggtagggttgctactgctactccactggatctgacatctgggaggggcgcaccaaccctaaaaaaagctacagcatttcctctgatttgtgtttatattgcttgctgtttctcctccaaccccttcgctctgcgatttccaaccaccacacgccggccatcaccaagtgcccacatgtcaaccgagttctccagctttactgttaggttcctatgcacaaatccatccatatccactagatagagcaaacaaatgttttgccatatgaaccctagcctaatataaagatcccttctgattacatttttgggttcttgcaattatcagttttttacggcctcactcactgccaaatgatttctcctgccacaggattagggaatccatgcactgcagttgcccgcggtttctcatcaccaaacatatttgcaggtacagtttactaccgttgtcttctacgaataacggcactgacaataaaaaaaaaatactatactgatatgaactgaaaacaatcttgctaagtgtaaaattataaacccagaacaaacaaaatcaattgttattttatttgcgcctacaaaaggatatgttatattaataccttttcttagcaaatttattctagatcccagccttcgtcatgcacaaagttctatacgatctttttccactatcaatatcgttttacatattgattaaatttctcctggtacatcaccgtatatattaccatatccatatacatcgattgtaacgcaggcctatttaacatgtcttataagttaacacaaaagactatggtgcccatcattacatagtttatagctagcgatgcgaaagtaattaaggctagaataaataaaataatctcagaggcgattagagcagttgctacccctctactgtgatcactatttttagacaagctcaagtcctccaaacatgatcagtataccacacggatcttaaaatatcacagcacagtttgcaacctttatagcaaggtcttaccgaccagtcctctaaccaatatatgattttgttcccactctgtgtaattgtaatttaaagttattccttctgttaaacctcatatcatagagatcatgcttactgtttaaataccttcacaaagaaacatatatcagaagtacctaaaaccttgctatagcagccattggctcttcttcttcatcgtcagccgcagtgcatgcatcacttagcctaatcttcttcacctttacttattattgtatccttagatttctcagacgttgctttatcttcccgtgcaaacacacacacacacacacacaaaacccaacataaatatgtattcacagattcaatctgcaccttgttttgcatagttatggatccaccaacattcttcacgatctggatgaccgcggcaaatcagcactgtgcggtaaaatctaagacaaaactatcctattcaatatataaagtatcctatatacaacaatgttaatgtatgttctttattggccagtgtattccacccgcaattgtgcaagcatatgaactcaaggacggtcaaaaaagttggtgacagcacatcaccttaaggtctacattgaactgaggaaagcatctaacaacatgtacatgacagcaggatgggcccagtttatagaagcaactggtctgcaggttcaagagcccgccgttttcagggttttatcaacctcgaagatgcatttcatcatatttgcaaaggacggttatcttagatgcccagttccagacaaacccagagactctgaaccgaccagacaatcgtttcgcacatcaagcccacaaggtaaatgaaccgtatcttacagctcatctcctggcaaaacaaaaaaaaaaaaaaacatcctggtgtatactgccatatctgcatccattagcctatcaactttattacctactcttgtcaatttctttttttttaaaacattatttcacttgcagggaaagccactacaattacttcgcctatccaatgctgcatcaaagggaagctaaaacatgatggcacatccacttctgcaagtacacatggttcacttgatattctcaatatattcatcaccatctcttttcacctacactgctatgttcattcacatcccttgtaacaggcaacaacaggcgcactatcagcgaaatgtgtttctgcaccaaggacatcaggttatcagctgaagtcaagaactacatcaaagatattgcgccattcctccagccctcagacaaattttatgtgactgccataaatgcaacattcatgaaggaagggagagtggtaaaatcactagctcattcctcttttctgcactatacacttaaaaactaatgttctgtttttatccagtacttagtaaaggaattttcaaagaagtacattgcaccgcttgcacgatgaaaagacagcacaaatcaaggtacgaattcctggacacccctcatccaccatggttctccacagatgctacaacttgaaatcgggatgaacccgttttgtgacaatcaacaacttccagattggaacaatttgcatattccacttttacaagacagatcgcctggaagcaacggcagatgtcttgtgaaggcaatatgcatcggctacaacctgtcatcctcctgttatcgccaagtgactctgccagggctttctaaatatctccagcctgtttctatgtttattattagcgccctttatagcctttctatagacatctaattaccttgtaaatattgcacccaagctagcatgtgtgcctctcactagacaccagggtcgaacaacatctccagtgctgtaatcagttattttggtcgtagctatatgcaatggacagcctatgtgtatctgttccataccctttaatgccccgtcggtccttcgtattataccatccatggttcactagctgctcgatattttcgcgctgttacatactatgcgtgtgcaattatatgcagggtgcacaaaaaaaaaaaaaaaactcatcatgtcgttcctacacagatgcattgtgcacaggcggcgcgccaatggcgcgccccagcatctagtgcaggtaaaaccgcggggtgtgtatcactgcatcgcctatccgtttctaggcaaaactcagataatcacgttgcctctgctgcaagtcacgttgcctctgctgcaagtctgcaaccaagacttggcttgctgcaagaaaacagtatggctccctgcaaatatgcatccacaagagaacaagagatgcacatctgggaaaatgcctatagatcaacaagagagcatttttggagaacaaataatgcactcacaatagaaccacattggctggtcggtaggtaccacaaatggg

SEQ ID NO: 30681 - DNA, 4496 bp, Oryza sativa
  unsure (1)..(4496): unsure at all n locations
gagaaatccggccgcctcccggcctcgtccgtcccttccttgcccataaaaagcctcccctgagactcctctctcttttcccccactcgccgccctctcccgtgctctccactgcgcccgcgtcgcttaccctgccgtccgccgctcgctgcggagctccggccgcacgccgtcgcagctagggccgccacgctgtgcattcgccgccgctagcttcgccgtcgtgggagctatcctggccgccgctcggttgcccccctccgccgccgcaccgctctccctacgccaagccacacgctgccgcttaccgccgcctccaaccaccgctagccatcgctagtgccgtcgccgcgccgctccgttgccgccgttggccttgcgaggtcaagggccggctcgtccaccccgcgcaccccgccgtccgtcgctcgccgtcgccgttcgttgtcgcctccttccgcgccggccgaaccctggtgaggcaccccctcccccgtttttcctcttcctctccctcctagcgccgagccgcgccgccatcgtcgtccggcacttcgccgccggccgcccgtgtcgtcggccgctcgtgtcgccggccgccgccgtcttctcgccggtcatggccgtcggttgccgattgccgccgccacatcggctaaccagccggccggtttgaagccgcgccgagccgaccgggcgtctccccctccccttgagccactgcccggtggggcccacccactagccggtgccacctcctcccctttgagccactgccgagtggggcccgcatatcggcgccgcccctccccttgttgatgtcatccggggttatttattgcgcgataaatctatgaaggccttttctttattagtaaaaacacacataatcttctaaaattcatatctaattcatccgagctccaattaagtccattcaagtctcagtaaattcataaaaatgcatagaatccattaaaaatggttttgtttcctgtttcagtagacttatagcatgttttgcttgtgtgctttgtttgtcgcgtagatttcggccgtttcgtcgacccgcggttcctcgaagacgttgctgtggtctcatcagtgcgagagcaaggcaagtcatgcattataattgatcatgctgtacccaatttacaaatgtcccgcatttctaacaaatgttgcattattttacaatatcatgtgggatgggtcctactactcagccatatattgtttaccttatgccattgataacttgggtattaaaatgattagatgttggattagggattgcttagccatgcttagttcaactagtacacaattggggaattacattaatgcatagactttgattattggtatagctttggattagtgccaccgcaatggtgttagttaattaatatacactacatggtgggctgtgggtgcatggttttgctagtcgtgcccatggcgattaaggaccggttcgcgggatgccctggaagaatttatcgtacttaccacaagccaacgtgggcaacggctgggcttgtagtgtagctttcctctagccgacgtacccaggcgagggtgggcgtgatggagttgggtcggccggggcgtccgtttgatcggcttccggattcaccacggcacgagaggggggctgcccgttgcctgctggggacggggcgaaccctgaggtgtggtgcgatcagttagaggggattatgcgaagggtcctgtcacggcctctttccggtatgtcgtggtggcatgtcggtgcacggaaacgtgtcatggggctatcttgtgggtacagttgtacacctctgattagagtaaaactattcgaatagccgtgcccgcggttatgggcggtcgaccagattcaccatgattagtctcaccctagttagctattgaactggtgtagttcaggtggttggttgggcctgttgcaacgtggtgtagcgttggacagtgattggttaatattgattaattactacaactattttactgctttcaactactgtttttaaatgctaggggtatgcaaaagaactttagcctcccttggatatatcctgtatcatacctcctcttncggtatgacttgctgagtacagtgggtagtactcagtcttgctctcttttcccccacactagagttgaagttcttctcagttggagatgtctcgaagaagttggtttcgtcgttgccgtcaaggatgcctgtggaatggaatcgcccgctgcaggagtcaagtcttcaggcttagctcgcttttatcttttctgctgcatttgtaatcttttatatttttgtaagacgtggatctgtatgtcaacaattgtcgtttgtgtaccctggctggccctggacaggggtttaatacacattcagcttagaaattctggttcgtgaatttctgggcatgacacgtgtcagggacgccgcgatgacgccaaacccttggatgaaacgccgatagtatctaccaaggccgaggaaaccgcggaacgcccgcaccgaatgaggggtcggccagtccaataccgcttggactttctatttgtccatggagacgcattccccggagatggtgtggcccaggtaggccactgatgtgacgccgaaaaaacacttggagcgcttgaggaagaggcggtgctgctgcaacaagaacatcttgtaagtttcaacacttctttcaaggagggacatgttatctataagggcaaaggagagcccgggtcccaagacaagctaggaccctggcctccttagccttcaatcttaagatgtagatcttgtacatttccacgctcctctcaaggacgacgtaccgcttgaggttctggttagatcaatcgaaactaaccgtggaggctctggttgatcccttttgatgagataaatccaatggcctaaaatagcaggtttaccaatttaaatgaaaatcaagggttagatgtttttgtttcttgaagtttaatcggacttttagtatataagagataaccataattgcaacaaatagtacaactagcacccatgagaaaaaacatttggtcattaataaaaacaaaaggagatcaaatttcatagaaaaattaattccatatgttaccgaagatctcagtatagttttataccccaaagttcaaacatgcaaataaaagtcctcggcttttgtccatgcaagcaagtcttaaaggaccacctagatgatttgggataggacataaacggcttacggatgctttttctttaggaaaaaagtatatagttagaaagaatctttaagcatcataaagattattaacattttaacatttgaaaaaaaaagatgcgggcttctctttaatataactttgcttgctagctactaccctatatgatttgcacagacaacaatctgactgcgcataaatttgtgcgaaaattagttggtcataatatcaatgatatcaaaccgtggaaaataagccttcagcctctgcgttgctaaagttatgcttgacaagaaatcttctcgtttcttacaagtaatatgcccatgctaatagtaatatgcctgtgctaaattctacggtgcaattatatttgtctttaataatttttcaaatttcatgttagcaaaaaatatttttatatgatgtgcatttgaactttaattcaattcatatcatacatcaaatatatttcatgtaaagttctatatgatattgcgtggggaccataaaactttacaatacttaattatatataatcagttcagtatacaatataaaagggcaatatacgcttaaaaatatgttaaaaatatagaattattccattatttgttgcagccacaaaataaagcatatgatacatatatagaatataccctgcaggtaaataactatcctaatgtttagcatttgcagtacacttaagaaattctcgtgcgccgctaggaatgttgctttcgcactcattttgctagtacatcaatagatgtacaaaaattgttgccttaggccgtctatcaactactgtagactcatcgtagaaactacagagaagagggaactatatttgtgagcgttggatgccaagcgtactttagattccttcatgtcccatctagagttgatttctctttggcggtctatatgccttatctttttattatacggtggaaataaaggagggctcggatcgagattttctgtgcgatgtcaagcaccttttttttggataatgtcacgcgtctcttttaatttttgccacatgtttgataaatagtttatttttggaatttgtttgtattcatattaaaacggatagtccattttaattttttttttatatatgtacgagcatagtatactttgtgatgtgtacgcacaaattatcgcgtgtgtcggaggtggcttgcggcaaggccctagatcctgattccaccaaatccaaccgtcgtcgcctccatggcggatttgcggaatcg

SEQ ID NO: 30682 - DNA, 3930 bp, Oryza sativa
cgatatatggtttaaactttaatttgttctctagaccgtatgaatatggattatacagtctatatgtcttatctttttattatacagtggaaataaagaatggggctctgatggagatttcctgtgccatgttaagcacgttttctggataatgtcacgcgtatcttttaatttttgccacgcgtttgataaatagtttaattttggaattttttgtattcatattaaaacggatagtccattttatttttttatatgtatatgagtatagtcaagggcggatccaacgtgggtgcagagggggactcgagtcccccctacacccacaagacccatggataccctctggagcacccccttcaattttttcatcataaatgataaactaaaggtctctagatggctggagattgaataaactatgtaattgagcacccccaatttttttgttcctggatccgccccaggtatagtatacgttgtgccgtgtacgcaaaaattatcacgtgtgattttttatataactgaatatcgccaatacttgtataatcagacatggattttgaccactttcttttacatatttgccaaacaaaaattatatttctaaaaaacaacaatcatgtgaattaaactgagtacatgcaggaatgcagaaccatttaaaggtcgtcctcacctcaagttgagaccaccctgaagctcatccctcatcaaagttacgcaaatacataatccaaatagcgtagttaatgagttaattaatgcacttattatatggttcatatagaccaattcaaatctaaatttcaacaaacttaacaaaaagaacacttgtacataattttaggtactgccatccaaacagaattcagttgtcattagagaatcctagaagtaatatttagtgttgtcgtgtgctgcacgttgatccatttcaggttgttcacataaagcaaaaatgttcggtgataccagagagtttcaggcctgctgtccagtaatttgaccatatagctggatttatactaccagcagttagcgtgggctctaatgacaaacataatgggagagttgtgcgggtatatgctgaacataattttcttcaagcgacaacaacaatatctactgtactggatgaatcatttagaatgcaaaacatcagtaaatagttaaactttacaggagcacaggcagattccatgaaagcaaatttggagagaaaccggctagggtttaggcggatcaggatcagtgcatcgtttgagggtttagtgtgatgttgatattcccttggagatgaaacaaggtattcagtgttctgagatgaaacaaggtattcattgttcatctattagcatttaggatttacctagctagcatggcccatttagtagccacttctgcatgtatgaagcactgtgaattgcctcaagccaaatgtcacaggctattatatacatttttcgttgtttgtattaacatcatatgataactacaaacatgtgatataattattatttccgctacaattatttaatattatcttactgtttgggtttaaattggtgtacaatttttacatgttgcaacccaacgcgcaggcatttgtttgctaacatggaaatttaagtaagacaatagaattgcaccgtaggaaattaaaagttattgacacaagagaatgtttccatgcctcaccttggagagagatggcagcacgcacgatgggcaaggacttggcagtgggtggtgaatcgtggcgtgagtacggatcggaggcggaggcggaggcggttggttgtcggaggagatcagtgagccgtgacgatgatgacgatccactctgccggccgaggatcagttactgccaacatgatatagttactaaagacagccattcatctcaaatttcatacactctcacggctataacctggcaacttgacagtacctgtgatagagatgctcacattcaaaatgtagcaagcatcagaaaatgggacgactaaatgtattatgatagttctgataaccgaatagctctattatgatagttccgaagcacgcactatgtcgccgaaaatagaagaacagagacaaatttttctaaacatgtaaattataacagcaccaccaaaaatagaagaacagagacaaatcattcagggtaaattaccattgattctgagatggcgatcgttgccaataacaatgaatcattgtgtttactgcattagttttttttcctaaacatgtaaattatgtcagcaccatattattgaatgtgacgacgccgaatattggcaccatattaaaattgaaagatcgacggcgtcggggacatatgggaagagaggtgacatattagggatgggtgaggggatctgtacctttctgcggcggaggagatcatcgtcggtggcgatgctgatcggttagatgggcggaggcgcgcgagcagcggggaaccggccggtaactgtcccggcggcgcagaccgatgcgatggtcggaggggcggcgggcggatagggggtggcctcggcgagcggtgggcggagggggtggcggcggcgagatggagcgcgtgattttgctgggggaggaggggaggcaatccgatctggatcggatccggagagtggtggggagccgttggattcgagtcatcggatattttcgatcgtcggatgtctaatgagtaataaaatcatttgttactatattatagggtacatgtcagaggcagccagcagcaagcatgtgatggagaacaccggctacgaagaacgtgaattgattccaaagcatctagcacagaagaataaataaagggtcctccgtgacaagaatatggacaaaagtaaaatttgttaacagagaaaggtacctgaaattaattaaggtcatgtttggttggaaaaaaattttaccccgacatgtcacatcggatatacggacacacatttgaagtattaaacgtagtctaataacaaaacaaattacagattccgccagaaaattacgagacgaatttattaagtctaattaatccgtcattagcaaatgtttactatagcaccacattgtcaaatcatggcgcaattaaacttaaaagattcgtctcgcaattttctggaaactgtgtaattggttttttttgttagcaaatgttttgttgttggaactaaacttagtttccaaacaaaatttttcacgctgtcacatcgaatgtttggatacatacatggagtattaaatgtaaaaaaaccaataacaaaaagggttaagtccgatttaccccctaaactcttgcgaaagtacgctgtaccctcctaaactataataccagacatattacccccttaactatttaatccggacacttaacccccccccccccccccgcgaccaatttcggctggttttaccgtttgatccgacggggcacacccacgtggcaaatgatgtggcattaacatgaaaatacccctaccctcccacacacacactctctctccctttctcccgtgaaaaattccccaacccaaacccctaaccctagcggtgaaggcgaagcttggcggcgcggctgcgtggtgaacggcggcgcaggtgaggctctgcggcgcggcacgacgctcgcaaggcagcgcggcgctgcgcaggcacgatgctcacgcggctgtgcggcacacatgcggctgtgtagcaaacagcgctcgcgcggcggcgaggcgcacgcgcggcagcgcagcggcgcggcgctcgcatggtggagcggcgcttgcagggcggtgcggcacacacgcggcggcgaggcgcactcgcaaagcttcgatctgaatgcaaaggtgcagatggaggccaacgctgctaggcacaaggaacatatggaagtaatagggaagcaaaaggatcctggaa

SEQ ID NO: 30683 - DNA, 2145 bp, Oryza sativa
tgttgtatgttaagctgtgatcttcctgtatatgcagtgtactagcatgtaatcagtactgatatatgtcatggaggctatctgaaccagcatgtttctcaatttggatggtcatgttttgtgcaataaagtgtgtgtgcagttagtataaatcaatcacaaaggctatttggaatagcacaaggcaacatatgcttcaatgaacattttcaaccagggaatgtttttcaacttaattaaatcacttagccataactttggcattaccaccaaaataagcatcactagccaatagccacaagtttggttttacaaccaaaagaaactggtcatcagagtcacaaatctgacattacaaccaaaatatctatatatgttatcaggccacagtcagcctcctaacttgaagttttttccttggggggccttgagttgctgttgttactggaatagcatggccaaacttaggagaatgctacaagaagagatgtgttagcaatcaagaaagcataggaggctattctaatagtaattacatggtaaaaacttacaatcttatgtgcaacagcagcttgaacttgaactaagtggtctgtggtaaatgcccttttcttcacttttgaggagctcttcttgtcaataggcctagattgtgcacttgacgaagcctgagtagtgcctgtatttctctttgcacaagttgtcttgttgtgtccaattcccttgcatcttctacacataatgatagtgcccacttttgacaccctggttgctttgggtttttcatgtggctcccttctcctctccttctttggtctacctggcattttaacataggaaggtgcagcaggcttgggtctcttagatactggccagctatgaatgccttccacaggctcaaggcaatgttcatatgttgacatgaatgctttcactgagtagcaggaggcaatatattcatcaaggctattggttttgtagtggatgcaagcaatagcatgacagcaagggagccctgctaactgccaatatctacaagagcaagttatgctttgaagattgactgtgaacctttattcatgatgtttcacttcaaatttgtcatttccatttgaaattgcatggcaaaatccagattctgtaacataagcattgagtttcttaagtatgtttggacaaattggtcctatccacttctccattttggtcctatgctcatgtatcctaaccatgacttttcttctgatagcttcaagcatactgattataggcagaaacctagcctcaacaatccatttgttgaaggattcacacatattgttgtcaaccgagtcacaatttgatcctaacttgaaccatgcccggctccagtgacgaggatcggttttcatgatagcctcggctccttcccttgtgcactgtgctagctttgcttttgctaacataaatagaggcctacatggagctttggcacacctccaaaaatttttttgccattccctattcttgaacttcttcctccaattggcataaatgtgcctagaataatttctatgctcagctttaggtatctaggtctcaacaacattaataattcccttttgttgatctgatatgaccacccaaccatcaccatcaccagcaacaagatctttgaatagcaaagcacaaaaccagtcccatgagtcattggtctctttctccactactgcccaagcaattgggtacatctggttatttgcatccctccctaatgcaaccatctagtccaacaactcttctacaattggttgatcccttgaaaaagcaaccatctagtccaacaactcttctacaaccagcaaggaatcctttcttacaagcattaagacatacatagattctttggaacacaggagttggactatcactatcaagagtgactactactgtactgcctgggttacttcttagtagctcaagttggtagttaaatatccttgaatactcacaccttgttgcatcataaagtttcttcagaacatgtgcctttgctctcttacactgaggaacgctgacatttgcaaacatttcttcagaaacagtagaaatcatattcttgatactccatgttgggttatctctaatcatctgctcatacttctc

SEQ ID NO: 30684 - DNA, 34973 bp, Oryza sativa
tactccttttagtgatcaactgaccatcactgtcctcttcaaatgaatcatttgcactactgtcatcataaggtgttgcatttccatcatcctcaatctgtactagtgctttctcactcctctgactagctctttctccacaaaacacatcatcgagatcagcaacttgaccatccttcagcttcttctgaaactccttaaatgatttcatgatctcatttgcttcctcatcctcctctgaagagcagctgtccctacctaaataatcactatcagaatcagaatcactttcagcactataaggaaccaactgatcactatgtgctaccatttgtgcctcttccttgtccttcttagcaagattatggcactgtctcagtgactcaatttgtccctgagtcttatctggtattgatgttactatcataacaggcttcttccctttagtatccacttcaaaaatttcagcagcctcctcatctgaagaaatttcttcaatttcatcttcaaaatcactgtcattatcacttcctacatcttctacatctgaactgtcttcttgtgcaacttgtgtctcaacatatatatctgcaacctctgcttcactagtacagtctgacatcagttggcaaacattatcgtccaacaaaacacaaagaccatccttcagttctttcattgggaacaaccaatgcaaaagcattggttcctcaactgcacaatggtcctttagatggcccttaacctctggcaacgaaactttgtcacggtcaatgtgtgatattgcttcagatccaccacagtaatgcttttgcctaccatcgtatatgaactctccattataggggaaccatacaaccaaaaagttctgaacatccatcgcaaagactctacaaccagaaaaagcaaaccactaatcatccatccacaattaaatactcagaaattgataaagtaagctcaacatcccactgggcagccataaacaaatcaacaaatgagagaatcatatgagcatcccaatctcactgtcctaaattgacaaataaataagcagctcacaactgaaggccgtgccacgccgccgcacgagcgttgtttgctgcacagctgcgcgagcgtcgtgcctgcgcagcgccgcgctgccatgagagcgtcgtgccgcgccgcagagcctcgcctgcgccgccgttcaccacgccgccgcgccgccaagctccgcctccaccgctagggttaggggtttgggttggggaatttttcacgggataaagggagagagagagtgtgggggggggaggggaggggtatttttatgttaatgccacatcatttgccacgtggatgtgccacgtcggatcaaatgggtaaaaccagccgaaattggtcgcgggggggttaagtgtccggattaaatagtttaagggggtattatgtctggtattatagtttaggggggtacagcgtactttagcaagagtttaggggggtaaatcggacttaaccctaacaaaaattatggaccctaatgagaagtttggttgtgttcttcctcctaattttactcgtatctctatcttttgttattatggcattgtttagttcccaaaaacatcacatcgattctttggacacatgtatgaagcattaaatatagataaaaagaaaaactaattgcacaatttgcatgtaaatcgcgagacgaatcttttgagcctaattagtccatgattagccataagtgctacagtaacccacatgtgctaatgatggctcaaaagattcgtctcgcggtttccaggcgagttatgaaatagttttttcatccgtgtcaaaaagaccttccgacatccggtcaaacgtccgatgggacaaccaaaaatttttatttcaccaactaaacaggtcctatgttaaaaaattgggtttattggatatgggttataaggccctgcttatacttggtcaacaaaagaggagataaggatgtgatctatgaaatacttgataaatgcttggctaatgttgaatggtgtgataaattcccgaacaggacgtgcttatcaccttcccttacttttatggggaccatgctccaatttttattctgcttaatcccaattgcaggaaagttggtggttaatgaaggaagagtttgaagaatatgcaatcaattcttggaataagtttaggaattgttcttttgtcaccaaaaccaaatttttgagtaccagtctatccgaatgtaataagaaagaaaaaagagcctctcaagcatcaaattgctagtacagaagaagaaatccttcaaatgtatgctagctatgttaggcatcaaatggaggataaggaaagagagctttttattttttctggaatactaaggaaaatgaggtaatgacaagtatgattgattgttttttttaccatgactgaagaaaatatattgtttgccttcttgtggttatagcagcttgctgaaaaaaggttgtgtttctgtctacttctaacacccaatgtttttactctatgcctgaatatatgcaaaagcttgctgatttccataggctaagagcaaaaaaaacatttggtgtgatgcaaaagctttctgatttccagggcaaatagaaaaaaaacattgtgtgttggaaggagacagacgacgacaaacgggcatttccagtgaggcaatgtaagcagactgctgctcagcgactcaatatcgagaacctcggggtagtacttgatgccacaccgaatccatgtctccacatgttgatcatttcgataactacgatcatccgcccattcatatgtacaacgtagccgaaactcattcaaggagacggcattgctatggaacaagagaaagttggtggtgaaattctcaaatctgctccattcttcctcggcggcctcaaagtcgtccaccgtgaaatacccaaactccttctcggctgtgtttagttcagcgcaaagtttgtattttggttgaaattggagatgatgcgactgaaaagttgtgtgtgtgacaggttgatgtgatggaaaaggactgaagtttggatccaaactttgaatctaaacacaaccctcgtcgatatcgaattatcgataaagggcgtggagcaccagaggtctttgatttcgggggggcatctccttcatcttcctccacacgcgcgcggcgtgtgtggaggaagatggaggagatccggatgggctgatgcagaggaagtaacccggcaaaatcagtggttgccacttgcaagtgaaccaaaaaaaaaggaaaaaagaacactgatcttaaacaaaaattaatcaagaacaaacttcgtgtcaaaaagaaaaaaaaatcaagaacaaactacacaagcagcacaccgcatgtcgtccatgacagaaatatgtcaatggccaagccacattccaagcaagaacgaactgatcatcagaaaagcaacaacttgcatagagacataatgatccaaaactatagttgatgttccctactatatgagtactaaactaatatgtagcgccgtatattagtcgggcccgcgagaagtcgacggctcgcactcctcgactgccaccaaattgttggcgaaatgtgctacagtactggtactggtgtttaacttcaatccatgctttctgttttgatttcttcttccctaaaataatactctctccgttccataatgttgcaacctaggatgggatgagacccatcctacgactacgaatctggacatacatgtccatatacccatcctaggttgcaacattatgggacggagggagtagaactgtgggagagatcgagagtgagaccacttgaattttgagcatgatatcgcctgacaccgtgtttagatcccaattttttctttaaacttccaactttttccatcacatcaaacttttctactcacatgaacttcaacttttccgtcacatcattccaatttcaaccaaacttctaattttgacgtgaactaaacacagcctgagttgatccatccaagattctaacttcattctctctgcaatctgtagatgaaaaagggatcaaaactgatgtggtagcctactgatgtcagataccttagcgcctgttgtcttaaacaagagttcctggccgtacacattcttgaagtttgcttcgtactccataaaagtaaaatgttttccttttattaaaaaaaaaacgaaactctaatagtgacatgctacctaagtaagttttttttttaagaaaagggttgcatggatccggcttatgtagaaggccacaaaacgacatgttgccaggttcacgctggtgatataccagcttcacaatcaccagttgagaaagcggagaaacttggtcacacccagaccgctactgaaaactataggtcaaaagcttcataactactccctccgtcccagaaagaagggattccgggaagcccaaggtagttttaggacaaagagcaaaaggctaaactaccctcagtactagtacacctaatcattaggtacaaataaagtattattactgccacacattaataaaacaggagtagtactccatactcaaacacacaggcagacacaaggcgtcaaggtgccaaataatttgaatgaagaggttaagcgccacttcattggcgggatgtaatacaaatttagcacaccccaccacaacaaaccctacaagtttcaaatcagaagttaacctcccactttatcacttcataactctgcaaaaacacaagtttccctcccactttatcccttcatatctctgcaaaacacatccatgggtttagatctaaatatagcattagatgatggagatgaacatgctataccaaacctcaatgaagcagtggctgaagaagcagcagtggctgatcaggaggatgaccaggttggaggtgatctccagggaggtgccaaccatgagcttcctggaggtgatttccagggaggtgtcaaccatgtgcttccttttgatctcaacttgtatgcatctgaccaccaaggagaaatacatctaggtaaccttgtaaacatgaatagaaaacaattgatcttcgtagatatggcttgcataaatcactctaaaatctttgccatttctctgtaaaaatgatctataacatgtgcattgatgcaattgctatcttcttggaacaaaattggtctttgataagtttgagaaaacaattaggatttgatttttttctttgatatttaccaactcaattctgtcaagagttgagcataatgaaattcatccccttccataatatcagaggttatactagattctagatatgctagattctgcatggatagtttcctttatagtactggtattgacctaaattgtctgtagctcaagcaacatcatcttaatataaagtaggaataaacatgagaattcagaaagcatgagcactgttttcatctatgtgtaaaatcatgaactagaataataagcaaacaatttatatatatatatatattcctttctaatgttttcagctagtactatgttaggttgtacctccaatgttgtacacagagctctaaacttcagcatgaaagtttgtacagaaacaaacaactcattcatgtatgacccaaatatcagtataccagcaaaataagataaaatcacaatcggaagatttgataagaaatgtgtaacacatttggggaaaaataatcatgagcacttccatcagtataactactactgagatggatatgtctttgaccaattaaacctttgtcatataaaaggacacataattcaacaggacatcaaatatggaaccatggatcaatatagaataatctgcatggcaaaaagtattgtttttgtacatggtactcacatggtatttgttattgtagacgatgttgatgtcatggatcaagttctgcaagtaaatggaggtcacaaccataatgcctttccttttgatctcaactttgatgacgatgaggaagacctacaataccatccaggtaagccctttaaccgacatgactatcagacttaaaaaaaagataaaatgtggttttacccaaaggatcattgtagaataatattatttatctgaaaccatgtttttaattagaagttagtaatattatatcatgccaactacctacaatagtccaaccgtgtcatttggttgtattagttgcaataacaattcaggattgtaaattagacatttcagcacatagtaaatcacaaagaataatgagatttaccaataaatacattgatatcttgtatttacatacaattgtcatgtcaatcggttcactaccacagcaatctgaaagaaagcacataaactaaattgtccaatgtctctgtccctcttagatgtgatatgtatggttaaatcatattacaaataaaaccatgtggtgaacctaaaaagttatgccataattttgaaatcatgttgatcaatgacaataaaatattaaaattctgaattggtacatatgactaaccttataattgctgttgtagacatgcaagagtacggcgtgtatgcgggtgatgtggatgttgttttcgaacaagaggagttggatgattcagatgaggaagatgaacatcaaaacaaaaatctaaccaaaatacaaaggcaacagatatatgcagcattggctggaaaaactaacaatggaatcctgagaaaaaatgctacaactgaagttgcagcaatgtttaatgtgaaaagggctagagtgcaagctatttggcgaagagtgaagcaatgccgtgcccagggaataccaattgatgtaaggtctaggaaaaaaaagaattgtggtcgcaaaaagaaagaaatcaacctaacagatgttgctaatgttcccttgcaacaaagaggcactttacggtcatttgcatcagcctcaggtataccaaagagcacactacataagatgttgaaagaagggctactaagacgtcactcaaatacactaaagccattgttgaaggaagagaataaacaatcaaggctgcggtggtgtctttccatgttagattggcatactttgccaaatcaacccaagttcattgatatgcgaaacattgtgcacatagatgaaaaatggttcaatacaactaaaaggacaagaaccatttatatggtccattgggaggatgatccatacagacctgtccaaaacaaaaattctatcgataaagtgatgttcttagcagcaattactaggcctagatacaatgaagaaggtatctgcacttttgacggcaagataggattgggcctttcaccagaaaggtaccataacctcttcatatatgcatttttacttagtgatttgatctgaaaattaattgttaatctaacttgattattatactacttaggaaccagcgcaaaggacaagtcataatagaccaagggggactctagtcaccaagacaatcaaggttgatagaaataccgtaaggtcatttctgattgctaaagtcctacgagctattatagcaagttggcctccagaagaagcacacaacactatatggattcagcaggataatgctccctctcatgtcccagtggatgatcctcaatttgcctatgcagtttcccaaacagggtttgacatccgactcatgcatcagcctcctaattccccagatatgaatgcactagatcttgggttttttgcgtctctacaatcattaacatatagaaggatatctaggaatatggatgacctaatagataatgttgagcaggaattttaagcctatgatgacaacaagctaaatagggtgttcctaacattgcaatcttgcttgttagaggttatgaaagctgatggaggaaatggatacaagatccctcatatgggtaaagagaggctagagcgtctagacattctccccaatacccttagttgtgattttgagctatatgataaggtaacaacagcattagccaaccaagtgcagtaaatcatgcaatatgggaaagcaatatcatggcttcagcttttggttaaatgtcaggatgtacatgtgataagttaagatcagtgttgcgcaagtaaatgcaacaaaccatgtaatgtgggaagttttatgatggtttcagcttttgaaatatgtaatgtgggaaatttatcatggtttcatattttggccagatttcaggttgtatatatgacgatctaatatcagtattaggagtaaatcatgtcatgtggaaagtttatcatgcttgagtttctagctaaacttcagattatatatatatctatatgtaagataagcattgcatccatcatcgtcatattgttcgtaatgttaggaacaaatattaatttcattgagcacaataaaccatcatattttacaataattctgtaggataccattcataagcactcatgtaataccataattacacatgcttccatatacaaaaccaaaagtttacctactttcacatacttggtcaggctactaattataaccacatgatctcatgtactaccataattacacatgcttccatatacaataccaaaagtctaagtgctatgttaggccatcattcataaccaccaaaccggcacaaaagcaacacataatttaagcattcatctaaactttttactcttaaaacattccagaaaattctttaccgatttttccaaggcatcttcatcttgcatgagttcttctaggccactatcatcgtatggatcttgcgcatatcccccaatgaccatgccaacatcatcgtcgctatccttcatctcctcactgttcccatcctcgctgctcccctcctcgttgatcacatccttagcttttccactcatatcctcgatgttgatttgcccgacgagtgacttctcgaacagggccttgtggtcgctatcatcttccaatattgtcctgcaaaggataaaacacaataccaatacaagatgggatcagttgttagagacttggacttccaacatatattaaagtatttggaattgtggtgtaaaggtgaatctatcaccgaatgaaactaaaatgtattttgattccattatataatggtgcaacatgtgaacaatcaatgtctaaaatgaagtaaagaccaaagggactgatcatggcaatgatagctaaaaattagagtacatcagtgtatatatgtgtaccctacatccagtgaattagttttataaccttcgaaaaagagttgcgctcaataaatgttaagcatccaggctatttctcgtagaacaacagcaagatcatctagttaatttaattggctatgaatggcaatatatgaaaaagctactcctaactattcgtgggtgcagttggatctgttggagcaagctgaagctgttcagggcaaggttccagaactccttattcattattctactcttagtgttactagtagttttaaaataaacaggtcaagtaacagcagctagctagctagctgcagccagcaggggtcccaaattaatcatgccatgccatgcaggagggaacaaaacaagtgtgacaagcagcattcacggacaatagtctacacattatctgacctcctgtaaagtagttttagctcaactgaaaaagaggggaacagggtgtagtgacctaaaaaatgaggggtggagtgaacccaaagactaatatttgcttgtagcatttaggagttggatcctttcaactaatattgtggacatagagagtattatggattatcgagggtaagctttgtaagtttacaattttcccatgacttctttgcctacaatcagtcctttttttaaggcaaaaaaaccttatcaatcttctaatactttttcagaggcccttgtaatatttaactccacctactttctactttctactttcttaatactttctaatatttaattatctcaagaaattggtagaaactcaacatatataattaatcgtccaccggaaacatagattggtttcaacatatataattaatcccatattaacattgcaggagattatatatactcataatgatatgcaagagaatacaaaatttgatggaacatgaaagttgaaataactgctaaaaatatcttctaaatttttcatgtttcaagcacgcactgaacaatattgtaacgagctataaagaaagcgtgccaaccggcacacgaacagaagaactcggtcttgtttggtgccgctgaattgataacttttccagaccctattccattgcttaaaacaagctattgcaaggaaataaatcctaattacaagaaaataaatcctaaaatgaacaactaaccatatagagctactactaatgaacacacaagggttattattaacagtatgcaaccacaccctgtgcatctgtgctacatccgccattcaaagcagttttcattgcatgacaagaatgtattggtggcagggagatggagcgggagataccttttgtggtacgatggattgttcacctcaccatgagatatgcttgatatactttccacaactggaattaaaccacgcatatcactgccaatgtccccaattgttggcgccggaatcagaaaaggagggcaaaaagccacctcctccggtgctgtcccctcctgcatcagatccgcgggctccggcacctcctccgccgttgtcccctcctgcatcagatccgcaggcgccgccacctccttgtgcatcacatccgccgccttgcaaacctccaatgcttttgccgcatgtgaaccgcctccacccctggcggtcgccaccaccttgcgaagcttcgatattgctaccgcattcgatccgcctcctgccgtagcctcttgaatcagaaccgcaagccggcacgcctcctccgccttggctcgcgtatctttaatcaaaactataaaccgttccgccgcttccatgaacgctgctaccgagccgaatccttccaccggagtcgcctccttcatcggatctaaaccctcgcaactgtctgccaccacatccgagcgcccgcatcctggtaaatgcagaacgtcgaagggaaaagcgggagcgaggggaagcggcgtggagtggggagggccgtgcggggaggatcgggagggagatgcggagggggtaggaagcttgctaaggtctcgcatctggacgtcgcggctttgatttggccgtgcgggaggatcgggagggagatgtggaggggaatacgcgaggaacgagagagaggaatagtacgcgagagagaagcggcgattccgggaaagggaagggataaggtttctgtggtgtgagaggagagagagatcggggcccactattgcccacatatgatgcgacacagataaaatatctggtgttttgtgcacgaatcgctttttttttgggacaaagtctccccccccccccagaaatcgctttttctgggacggagggagtaccaccacaaagaagaggattatttggaaagacaacgttagtggcgagaataaaattgtctctggaaaccatattatttcttgtcagttacaaggtccggcaaattgcagctagtgaaacaaatttaacagctctatatttgaaatcaactctcatatcagctagaaggaaaaaaaaaacatcaaattttagtaggagatgatcccagtttagagcatccctgcatacacatcaaacaaacaaagccattggcacctaaaagcatatggctagtacttaggtcccgttcttttctccaacaagagttggttgaagattaagattttcgtggcacgcttttcaaactgctaaaattgtgtgtttcttatattaatctattttttaagtttgtaataattaaaactcaatcaatcatacgttaataccacatcgttttacgtaaaaaaaacacttaaccttcatcagaagaaaaaaaacactaaaattggtttaaaaaaatcaaatctttttgcaccgccgccccccaccccgccacacacacacacaatgccgtggaactaaacaccgcaatagacgtcatcacgtgggattgggggcaacccggtagcccgaaccgcgtatcgtcgccgccatgacgccatcgatcggctgcgacctcggcgacgccaaccgcatcttctcgtcaactccacgacttccacgccaccccacacggcacggctgctggctcgatcggcacatgcccgcccaacatgtgcaagggcctgatgactaatttggctttatgggatttcaaccttggctgtgtctagatttctattttttttctttaaacttaaaacttttctgtcacatcaaatgtttggatacatgcatggagcattaaatatagacgaaaaaaaatcaattgtacagtttgcattgaaattgcgagacgaatcttttaaacttaattgcgccatgattagccataagtgctacagtaaccacatttgctaatgatggattaattagccttaaaagattcgtctcgcggtttacagtcgaaatctgtaatttgttttttgttttgttattagtctacgtttaataattcaaatgtgtctgtatacgtcaaaaaaattttggcaccgaactaaacacgccccttgctaataagtttgcaatggtaaaggctcggtgtgtcttattatttgctatatagggtgtgtttagtttacgctaacattagaagtttggttgaaattgaaacgatgtgacggaaaagttagaagtttgtgtgtgtaggaaagttttgatgtgatgaaaaagttggaagtttgaaaaaaaagtttacaactaaactcggccataatacccgaatacattcgttaagatatttttcccccacttaacctctgggcagttcatgtttcgtttacactgcgtgatggttcaaattttagcaactcaaaatatgatcacaatttttgtatgcaattctcaacaaatacaccaactataaactttacatttggcgtgagtagtaagatctcttattgcataaagaatggaattacaaagttacccatcttctcttttctctcaagctcttccttttcagcaatctgttttagcgtagtccacccctttcttgcccgcttccttgaactaccagacatctgagcagaaccaattgctacaggtttatttttcatactatcgtttggagctgacttggtaggcattgtaggggccttgccagtaactgaacttggcatctccgctttcttgttctgaatgcttcttgtcttgagcagttctgcagaatccttatggtccgtcacatccaccactttgttctttcgaggagtaacaaaacttgatccaactgaaaattctgctttcgaaggaacatcgggttggcatattgcaattttgttagcagaaacaggctcagtttcatgcgtacttttttcatttgtgattgttactactattttctgtgagacattttcctcatcagtagctgatgctgactgattcagttccaccgatgaagacgctacctccttctccatagattcgtcaagaaaattgggtactgggctctcctcatactcgttctttacaagatttcgttgtttcaacccagatgttgactctagttgtgagactgctccttgagaatattccaagccctcttttatagttactaatctcttgttatttatgtcccctttcaacttaatgctggtaacatccatgccaactggctttcttaatgataacaagcccttcataatattctttccgctgccccttattaggttttggtctccacagaaatggcacaggtaggaaatgctgttctggcaagtgtttaacttcttgcgtcgctttgcttttcttttgttgttctttatgcggatggtgcagttgaagcctggctgtaagactgtttcacacctgcaaagtttagagaatgtttcttcagaagtcctatagagatattggtctaatctaaagtagtaatgcttatgatccagacaaatgggtacgcacagtagaaaaaaaaatagcataactaggaaactgaactaccaagtacactctgtttcacattataagatgttttgggttttgaatagattcatacatgggtccatgtatgcgcttcatatattccaaattcataaggatgttagtgaatctagatgaaggatggagaggccaaaacatcttatagtgtggaactgagggagtacatagtatgtttcaccgcctacaatcaacgactcgagcctggcagactggtggatgacggcgagaatgcattttcagacaggctacaggaacatttttgacactgtcttcgcactaatttgctggttcctgtggaaggagcgcaatgcgcgtgtgttcgagcagaagtttcgaagcacagaacaattagtgtgtgaaatcaaagaggaaatccttgtttggaagacagcaggagtattcgcaacttgtaatggcgatagtgaataatttgtaagacccgtagcatgcaactttagcttactaggttggggattttcctcatccatctcgacagcatactgtcgttgtaagcttcaaatgtaacgaactacaagattttcaaaaaaaaaaaaaaaaaaacaatcatttgtttgaacttagtggacaaggttacagggtatgatgctctcatgaactagcagtttttaagccgtgtgaaacagtattgcaacaacagtggttgccgacagataacagaataaatataactgaaaaaaaatactacctagtgacttaatcagttcaagccaatatgaactgttgctttgtgaataggagatttgcacaaatttggttagaacttgagtaatcaatcacaaagagaaagtttgagaatgatatgcacaatgcaaagcatggatccaactaaataaatcatatgaataggtttcgattttacaatatacctgtaaaataggtttcgattatttgctataaagaacttcaagacttggttatctgtatctcataaaactgattcatgaaatgtatcgatcgagttcattaaagctacatatcactctgtcattctcactgatagacaaatgttgcaccaataaaaaaaagcaagtgcaaaattatatgaatagctgcactaacacgactagatagcatcaaaaggctgcctgatacttctatggtgcataggaaattaggaatataggatatagtatctagccgggcaggtccttaaactggctaaaatgctgcttagcataaaactaccgcaatttcttagaggtatgagggggattatgatactaataatatctgcaatggttaaattcaagggaaggggcagattttgttccttcaatatcatgcaacaatttgagagacgattaaccacaaatcagtagaagaattgagtactttgccccacaacacacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccaccctggcctccccgcccgcccacgccgccagccgctgcaggtgctggaccctcagcagggaggccgcgtcggcgcgcgtcttcccggagctctcctcgcggagcgacacggcctggttcccggccctgggcggcgccgccggggcatggccatggccaccgcgcttcttccccatgtagccgccaagccgcaaccgcgaggaagacaaccggagggcggcggcgcgggagggagtaggcgaaggcggcggcggcgacggcgagtgggtctgggtcgctgtgggccggtgcaagggccagttgggccgcgccgccggttaatttgtagtagtagtttctttcaggaatagtaagtctttttttttttggggtctccctcatctctttgcccttggtcaaatcacaccccttaaccgtaaaatcggatataacccctcccccaacttcaaaaaccggtgtaaattgactccttcggtgtttctaaaagtggttttgttcacgtggcaagttgacttggtccaagtatgctgacgtagcggcctagtcatcacaggaattaaaaatagaagtaggtcctgcatgtaaatgataaggatgcactcgactaacgcgacgacggttgcgggaggccaacgccgcggctaaggggttggcggtgagcagcgacgaacgcacgaaggctggttcggccacatgtgacgactaggcagtggacttcggtcgcggagatgaaatcggcgacagggtcgtgggaagggacatgctcttgctagcatgaagcttagtggagcttcgctgctgtgcccggatttcgagaagaacttgttgatgaggccatcggagagggccaaccctagtgaagtcatagtattcctcgacatctgacgaagaagagcagtgggaagctggtttgaggagtaggcggagataggcctgcgaggggaaggaagctaggcagccatgcgctggctttggctcgcctcgagctcacagtgttggcaaaggagacgacatcatcggttggtggtctccgagcaaggcgaggtggcagaggagaggaggggccgccatcgcttgtctcctctgcatcaccgcccatcaccgccagagctaggcccgaaggtagatccaactcagcggattatcccaacaatgatggccttggatatcgcaacgacggtggcggggacctcgggagaggcgacgagcttggccaactgcgggggagctcgtccgagacgaagcagatggagtcgaagatttcgaaagacaccagggttgttgcgttgaggaatgtcacgatggccttgaggaaggttgcgaccgcgctggtcagctgcacgaggcggcagcaccgggccaccatagtcgaggggtagtagatcttgtatgccccaaacatcgcgcccatcgcaaggaggatcctactgctggcagtggcgggagaaggccacaaggcaatccatggtggcggctcgccgaagctagggttagatgcggtgagcgtactgtggccgtctctcttttagatctatgccactataaatatgccattttagataaatgccactactattcgcaatatcaactactccctccgggttgataatacttgtcattttggacaagggcacggccttcaaaaagtaactttgacaactattatctattataaaacatatagaaatttcaacaaatctatgattttattgaagtactttttaagactaatctacacatgtggttttcatattttaagataaatattttagaaattatttgtagtcaaagattttaaagtttgactttacccttgtccaaaacgactaatattatcagcccggagggagtactattaacaacagaattttgcatcagattcggagaagaaagaacaagatcaaagcggatttggtgtggaatcgagttggatttggagtcggactgcacatcggctggacactgtattggctgcaaaacggagtctaagttggtcaagctgataaggcaaacggccgatgcagccaatatggtatgacttgggctcggcatgggcctaaattgggtttaaccgtcattgccaattagagatagagctcatttaaggaaattacatctattaattaggttatttatgtcggttttgtgaggtttggtaagagaccatcgtatatggtcttgtttgtattttatctttagaaaggtttgagtcgtgtccataatggactggttttgtacttagggtataaatatgaaccccaggccaatgtaaaaggagagacaatccaatacaactttggcgcatcgccaccctttttgttcttcttttcggcgagttctctcgacaagaggtaaccgtctcgatggcttgtgctatcagggctatcatgtcgctttagatatcttagtccttttatcatgaccatctgctatcatatgtcttagttaatctagtcttagtatctcgatttagctctatcggctagttttcgctttagggctcttgccggtatcggctaaatcgtcttactagataagtttagctaaggcatctaccatcctgaaaagtgattgattgcttgattgtttagactctaggcttcttttcctactttgtgatgcattatccctagtcttgtcttgaattctagaaattaacctagaatcaatcataatttaggatagtgtcgatgggggatacccgtagaccggataaatagggtattggggtacgatggtacgaggatctacgtgatacgacttctagcaaacaaggagacaaagattatactggttcaagccccttatcagataatagtcctaatccagtttatatgatattgatatggaaatccactatttatatgatattgatatggaaatccaaattagtttcattaaatcaataattgaatatattttcataataaatttgtcttgggttgaaaatgttattatttttttctacaaacttagtcaaacttgaagtaggttgactttgaccaaagtcaaaatgtcttataacttgaaacggagggagtagtttctatagcaccacaaagttgacaaaaagcagaaccttacataagggctttggtcgaaaattcgaggaggcccgcggtgagcgtgacccagaggtggtgtcgaggctcctctcccaccgctgccttcccctccctcccagctcgccggccgcctctctctccccccctctccctcctaggcatgtgaagaaaagagaagaaagaagaggctgataggtggggctcatatttttttatttatttttattgactaggatgccacgtcagcggaactagatatctctattgctatggaacctaaattgcacagttttgtatagtttagcggtgaagatttccgatattggggtttagggatgtcaaatgaactcaagatagagtttagggacagtaaatgacttaaagttctaaatatgggctgaaacatatatgtaatctgagtttctcataggctgagggcctgacccaacccaagcaagaaccatccgactcatccgagctagagagaggatgagcagcatttccattgttgcattgccaatttcttttttttttcctttttgtgatctcatggattgctgaaccactctggctccttgcttattctagccaaaaagaaaacgacaccactggttgcatatgcctcacccgtgacatcaccaaacacacatatggtagacatgaacgatgacaggctgataaaaaattaacagggtaacacaagacccagccatgaacgatcgacgaacacatacacaccagccagtgaggcgagcaagcagcttgcgtggcaacgaaagcgaccaaacgtcacttttaccgattggtacgattatgtgaaaggcggcatggcctatatcatccattggccaccaaacccggccaaatcatcgaatcaatcaggtcacgtacgtaggtgaggcagatcgagataggatgacgaccaggctaccctaacttaacttaaatcagaaagacgtgtgtcactaacgtgtgggttttacatgtgagtaatatttgtctccctattttaagttagaagttagaggcatagttattagaaatagatcgaaccgacagtccgaccgaaaaaaactctgagccctttaccggtttggtttgattagaagatcgaatctattgtatatacggtcttttaattgaaccaaactaatgagggctctggtttcggtttttttctactggtccgatcaggtgggaggatatgcacaacagtcaacagctcaagcacagcgaaagctagcgagcgcgtggcaaccacaggccggcaagcacgacacggctaggattaagctgttgatagcggctaggattatgcatggagatatgctcgaatattgtcagaaggttacaacgagcaagggacaatattgccgtcgcgttcgcgtgccatcgttccgatcggactttatctcgccaccctttcgtcaccccgtctcctgtcttgggcggcttttatgctgcagatcacggaacttatgctgcgatggcagtacagaaatcgaattccctccttgcaaaaaaaaaaaaagaaaaaaagaaaaaaaagaaatcgaaacttctacgattacaggcaatttgtatttacgggctgctatgcaataacagaccatataccataattgaatatgaatctcttcttaatttctagctaatcaaatctttaataccgatttcagggttagaaccctagctcttgattgggccacgtggcaccacggttagagcaccggccgaattctcggatggagaagggcgccacgtatcccacctctccatcagccgcacgatagtatatcaacggtgtaaaatacgtccagtggacctaaatgtatattgcaagttttaagaggggttttttaaaaacttcgtcatctagaacagccaggaagcagatgaaaaaaatcctatagggaaaaaaaaagaatctaataaaaaaaatcaacgagcagttagccccgtcccttgcctaattccatagttttgtcactacgcatagccatttgattaaaaattcagtaaaaaaatcttcccacattgcaatctttgagtgtttgttccaattgaagataaatctggaattaatgcatagcgaaaaatccgaaaatgtggtgcggattgtaaagaaaaaaaggataaaaataaaaaagtcaatcttgcctgcccgcgagccgccgccatctcccctcccacaaatcgccatcgtcaaccatcaacaggcaaggagagccacctcgatcctaaaagaagcttcttttaggatggggaagagaagggcgattgcagttggcaacgccacacgacaaatctggtcggccgacaaccaccgcgcacaacgccatctcctctcttttctcccccttcttctgccggattcgtccgtcactcatcgtaagacggtgctgacccgttgagccgtaaaatccgaggaaatcgacgctggaccacaagcagaacttccgtcggccaccacccacgctgagcttcgctgcaggaggtgatacgtcatgaggtggagaatatgagagagaaatgagcagctcaacatctgcccgcatgcctgtgggcagtggcgagaaaagaaacaaagggagaagaacgacaacgtcttctctgttctctctgtccgcctgtgtatgctttccgatgcaggctgcctgaggccgtgatgacagaaaaaaaaaagagaaataggaacagcggtgaaaaatgcatcaggattcaggaggactgaggggagcacacctgtccactcgatgcactggtcactgggcagaggataagactatactcctacagttgacgagtatcaataagtaaatcagtatccttcgtgtagttatgatttttcgcatccaactttaattgtccgtctatttttcttaaaaaataaaaacataagtcacaaataaagtactattcatgttttatcgtctcataacgcatggtactaaaaaaaattacgcatggcttgtttagattggtaccattttaaagcatactattttgggataaaatataaatatgtggatgcattttgttatcaaatattagcgatgcatagagaattttgaacaacacatttagcctatcgtactaaaacttaaaattattgtcaatttatcaatttttttacattacaaaatttttggaaggttcatttgggcactaaccaaaacatgcctttaacttgccacatagtataaaacaataaatagtatgtatattcaatgtataaatatagtttatacaggctatatagatggtgcgccaatggtgcgcacactttcttaaaacacagtacatgtacacactcataatacgcacgcactcatctctatgaaccccaataaatgcacacaagcacaccctagtcctatgaacacctccgaatgactaggccggcatatcttgagattgacgatatcaccacggacgcatctctgttgacgggtacatcgtctaccactgaaagaataattagctaaacccgagtgggctggttctaccataaaaaacttacccagttgagttacacataaattcacctccacctcacccattaattcaatgtggctccttgcaggttgtgctaggatgttttatagtacttgctctaaaaggtttgttacgtactccctctaccgcagaataacatcattttttggccaatcaatccaaggtatacacatttaattggaatttagaaaaaaaaaggaattgataaggacaatagtggtatttctccccactactaatttgtaggagaatcgttagaaataaatttgtttgggggcggaataaatagaacaatatttttttaagttggtgagaaaagttgtgtcattataagatctataaaattgattgaagttaggcataggcattaagagactatgtgattaagtggacaaattaaatgagatattatgattggttgagataagatagtcgttaatcaattgctatattttgctatattataagacaaattttgaataaaaactgttatatttggaatggagggagaattttattttattaatgatcttttttacgtaaaaaaaacactacggtcgttatttaaaaatgtccatttgcaaaacctatttataaatggaccatggtttatttagcggaagatgaggctcaataatttatgctttaaaaataagtatatttcaaacgatgttacaattacataaaaactctttttaataaatccaacataaatagatgaaaatatgataatttttaattaaataactccacatgttgaattaagaatgtaaggaaattgacctaatcctactaaaaatctttcgaaatttctaaattgatgtatgtataaggatgggttaaaaagggcgtgccaaatggctcgccgattttctagtcaaatcatctcaagctggctggttaccgaccaactattagtccacgtggcagggataacttgttagataaatatgagattatcatcaaggaaaaaattgtaaaagtaaaaaaaacaaaagtcatccagattctagagtcttccgaaccatcctcccccttcaagtaaactatctgccccattcaatcaaaccaaatacaatatccatttctacagataaacgcatagagatttttcggctagcttcacaaggtggtgggctagaagatctaggttcaaaacctcacccttctaattatttaaaattagatcattctctaatatttgcatatttttatatctatttctatatatgtcttctccgatcaatcaaattgaacagaaaagtttagggaaaattgaagagaaacaaaagtgaaggtgaagaaaatgtaaaaactaatggagaaaacttccaccaataagctagaggtgaactgccgatgtagctaagatgataatttctaaataaactaaaaaagcatgtacgtaaagtttcgggaaaattgaagagaaataaaagtcaaggtaaagagtaaaaactaaaggagaaaacttccaccaacaagctagaggtgagctgccaatgtagctaagatgataatttctaaataaactaaagaagcatgtactaggctctacctacgaatctttattgatggattgtggagattatggttatcccatatctatatggcggttatattccagctggatatacggtaccaaatacagataaaatatctttatgaggactcgggttaggttctaaacttgtgtgtctagaaagtacccgggattctagccggttacgattgtattttatctgtaatcccatattccgttaggatatggactgtaccttgtattacggatcccttcccttatataaggagggtccgtgtgcctcttggggcacgattcttttttctcccaatcatacaatcaataacacactcggcggaatcatccccggacaggagtagggtattacttcttgaataagaaggcctgaacctgtataaaatttcttgtctccaaacccatccactttcttagcttgatagccacccccttttattattgtcgaaatcttgtttcgacagttggcgcgccaggtagggacggcgtcaagttctcaccgactaagtgcgatgggttccatttctggcatcgacgacttcgccttctccctcgggcaggcgttccggttcggcagcctcaacttcatcaccaacgacttcggcaagatctctcttctttactcggattcaaaccagtcggggagaaaccaggtccccgtgccgttcggtattccgaactcagccgaggcctactccaagatcatctctcctgagtcggcttcaaaccactcggatgagatccaatctactcttccacgatcagatcaagacgatgggtcctatccctcaatcttgatgaaacttcctgatgacttggccgccgtcttcacagccaaaacatctcccactcggagatctaggcgagctccggcatcggccccgatccagtctagatccagggaggttggcgttatactccagcctcttgggacagtctcgacggaagagttggatggctacctcagctcccccgacgtcagttctcgaccaaccgagatcctcgactacgacgacttcgacaacttcgacgacagctatgaggataactacacgcctctcttcttcggcgtattcatggctgacaacgaaacggaagaacagcgccgagcccgagaagcggaccaagatcgcgtacgacagaagctgaacgtcgccgactagaggaagagcgacagcgacaggagcgagaacgactacagcgtgagcaacaagatcgcgaacgggttgcaaaggaggctgaggatcgacgacaacgcgccttggaatccgggcgatgagcgagagaactcattgggcaacaagacgtcgatggaacagcggtctttcgcaccccccagcagaacgcggttgcagcaatcactctcctcgacaccctcctcaaggaagacgcactcaacctagccgttcatgttgtcaacatcttgaaccagacgaagaccatgatcgctgcctcggttccagccaactccgcaggcacccgcaccccgactggtagccgagtccctcatcatcagccaagcctcagcgtcaccggcacaggatctagtcgcaggagcaggggtcacgaagaacgatctgttcactcgcttcccgaacgtcacagggagcgccgagctgaacggcctcgttctccacctcgccagcgtcccgtcgaccttcgcgacacgatcaaccagcgccgtgcagcacgacgtcaccgccattcaccaaatcgctacgacgacgacgtggatggagtagctgccttcactaatgacctgcgtcgagtggattggccagtcggctttaagccgactaggatcgagaagtatgatggcaccaccaatccagagtcttggctcaccgtctacggactcgcaatccgcgcagcaggaggagacagcaaggccatggcaaactatctacctgtggccctagcggactccgcccgatcctggctccacggactaccccgtggcacgatctgatcatgggtggaacttcgtgatcacttcatcgccaacttccagggcacctttgaacgccccggcacacagtttgacctctacaacgttgttcagaagtctagagaatcccttcgagattacatccgacgcttctccgaacaacgcaacaagatctccgacatcaccaacgacgtcatcatcgccgccttcactaaaggcattcgccacgaggacctagtcggcatgttcagacgtaaacctcccaggacggttaagcagatgttcgaaaaagccaacgagtatgccaaaaccgaagatgctatcaccacgtccaaacagtcgggcaccacttggaagccaaagaaggacacgccgactgcaggggagagcggaagtaacaaccacaaggatcgcaagcgtaagcccgaagaacttgtggcgaccacctctccatcttcccgacaacgtccccgcgtcaacaccttcgacaagataatgaactcccaatgtccgcatcatcccaactccaaccacgtggccaaagattgcttcgtctacaaacagttcgcggagcaatacgtcaagaacgcacgcaaacctgcagacggagatcagggcacatcaaagaagaaagatgatgaagacgatgccccgactggttttcaagatcatcgcaaagaacttaatcacattttcggcggacccctggcttatgagtccaagagaaaacagaagctaacagaacgggagatcaatgcggttcagcctaacatgccccaatatcttcggtggtcagagacagcaattaagttcgaccgctcggatcatcccgaccgagtggtccacccggggcggtaccccctagtactagacccagtggttcgcaatgtcaagctccgacggactctcatcgatggtggcagcgcactcaacatccttttcgctaagaccctggacgatatgcagattcctcgcatggaattaaagccgagtaatgcacccttccacggtgttattccaggattgtcagctacaccactcggtcagatcacccttccagttaccttcggcactcgggagaattttcgcacaaaaaatgtctgtttcgaagtcgctgatttcgagacatcatatcatgctatactcggacgaccggctctagccaagttcatggccgtcccgcactacacctacatgatgatgaagatgcctggtcctcgaggggtcatatcactacggagcgacatcaagcaagccgtcacatgtgacaaagaaagttgcgagatggcttaaacccacgagaccactctcgcccgcgaagagatccgactggccgcgtccacggcaagcgagggagaagtgcctgcgaccaagctgacgaagaccaaagaaagtgatgccaagacgaaaaagattcccttagatccctccgatccttagaagactgctgtaataggtgctgagttagattgtaaataggaaagcgcgctcatcacctttcttcagaataataaagatatttttgcatggaaaccatccgatatgcctggtatccccagagaggtgattgagcactctttacatgttaaggaagacgccaaacccatcaagcaacgactccgccattttgcacaggacaggaaggacgcgatcaaggaggaattaaccaagctgttagcagcaggcttcattaaggaagtccttcatcccgactggctggctaacccagtcctggttcggaaaaagacggggcaatggcgcatgtgcgtcgattataccgacctcaacaaatcttgtcccaaagacccttttgggttacctcgcattgaccaggtggttgactcaacggccggctgtgagttactcagcttcttggactgttactcgggatatcatcagatccgactaaaagaatccgactgcttgaagacctcgtttattacgccttttggggcctactgctacatcaccatgccctttggattgaagaacgcaggagcaacctatcaacgcatgattcaaaggtgtttttcaactcagatcggtcgcaatgttgaagcctatgttgatgatgtagtcgtcaagaccaagcagaaggatgacctaattccggatttagaagaaactttgacaagcatttgtgctttcaagatgaaactaaacccggaaaagtgcatcttcggagtaccgtcagggaagttgctcggatttatggtatctcagagaggcatacaggccaacccggagaaaatcaacgccatcctcagcatgaaatcgccaagctcccgaaaagacgtccaaaagctgactggttgcatggcggcgctcagccagttcgtctcgcgactcggcgagcgggggatgcccttcttcaagctgctgaagaaaactgacaatttccagtggggacccgaagtacaaaaagcctttgaaaacttcaagaaatctctcaccactccaccagttttggcctcgccacatccacaagagccgctactgttatatgtgtcggtgacctcccaggttgtgagtatggtcctggttgtcgagcgtgaagaggaaggccatattcaaaaagtccaacgaccaatctattttgtcagcgaggttttagccaactccaagacaaggtatcctcaggttcaaaagttattatatggtgtcttaattaccgtcaggaaattatctcactattttcaaagtcactcggtcacggtggtcacatcgtttcccctcggggatatacttcataaccgcgaagcgaacggacggattgtgaagtgggccttggagttgatgtctttggacatatcattcaagccacgaacttcgatcaagtcacaagctttagctgatttccttgccgagtggaccgagtgccaggaagacatgccagaggaaaagatggaatattggactatgcattttgatgggtcgaagaggcttacaggcactggagctggggtcgtcttaatttccccgactggagaaagattgagctacgtattgtggatacatttttctgcatcccataacgtggcggaatacgaggtgctactccatggattaaggattgcaatttctttaggcattcgccgattaatcgtccgtggagactcttagttggttgtcaatcaggtcatgaaagagtggtcatgtttagatgataatatgaccgcttatcgacaagaggtacgcaagttggaagataaattcgacggactcgagctcacccatgtcctccgacataacaatgaggcagccgacaggttggccaattttggttcaaaacgggaagcagctccttcagatgtgttcgtcgaacatttttatgaaccaaccgtgcccagaaaagagacaattgaagccatggacactcaaggtgtaagcatgatcgaagccgactggagagaaccgtttataaaattcttgagcaaacaagaactccctcaagacaaaaatgaagccgagcggatttccaggcgcagcagactttacattattcatgagactgagctgtacaagaaaagtccatcaggaatactacagtgctgtgtatctttggaggaagggagacaattgttgaaggatatacattctggtatttgtggtaatcatgctgttgcacggaccatcgtcggcaaagcttaccgacaaggttttttctggcctacagctatgtccgatgcggacaagattgtgcggacatgcgaaggttgccaattttttgccagacaaattcatttgccagcccaagagttgcaaaccatcccgttgtcctggccgtttgtggtctgggggcttgacatggtcggcccatttaaaagggcagtcggcggttacacacatctctttgtggctatcgacaaattctccaagtggattgaggctaaaccggtcatcacgatcacagcagataaagctagagattttttcatcaacattgtgcatcggtttggggtacctaatcggatcatcactgacaatgacactcaattcactggtggagcatttaaagatttttgagaagacttcggcattaaaaatttgttatgcctccgtggcacaccctatgagtaacggacaagttgagcgtgctaacagcatgatactgcaagggatcaaagcacgagttttcaaccgactacgcccctatgctggcaagtgggtagatcagctgccgtccgtactttggtctttacgcactactcctagtcgggctaccggccagtcgctgttctttttggtttatggcgcagaagcaatgttgctgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcgaaatgttcgattgcgagcctttttagtcggtgacctggttctgaggaaaattcaaacaacacaggatcggcataaattatctcccttatgggaaggaccgttcataattgctgaagtcactcggccaggttcttatcgactcaagcgcgaagatggtactatcatcaacaattcttggaatattgaacaccttcatcgattttacgcttaggcatttcgtttgtatctttcctctttgactgctaacttcaagtttttcctcgaagttttcagtcggggggctactataataataatggagtgtgatttttatcaattcaatttgcttacttgatgtatcagtgccctgtttgatttcttggcttagtcgatgaggactgaaagttttttaacaacttttgcgggttttaggctcaacaaggtttgacaaaaacttttaagaaatcaggagctaagttaagatatcatgcacagcataaattcatcagtattgtacaaattgtgcctccatcatcattaatcatcaagattatcggtacattaatcagtatcagtcttttcatcatcagaaatatcaggaccagtcggtcgaagatcggtgtcctgaaatctctcaactacatcagcagcaattttgtcagccgctttctgcgcattactgatgaggtcaagagcagcttcttcgctcgtcccgtccgcaaagccatcaatggcgtcaatatcaactctcggataaagggatttagtcatcgccaacgccatgcttgctcccatacttccagcttctttgatgttcttgaaatatatatccggagcaactctcagcttgtcgaaaatttcagaagcatcaagtgcactcgggccgttgttattgaggaacatcgcttgaacaattggggcagcagcgttagcaacctcatcctgggctccttcaagttttttgatcttgccaaccaggacgtcgaattgagcttgagatttgatcttgcggtctgcatcgacagattcatattaataagtcagcatatggaggataatagcttttgaggtattgattgttgataccttcaacttccttcaaagccaggtctctttgtcttgccagttctgccttgtcattttccagagtttgaatttgcttctccaactgagatatcttggtagcttgcactacattgattactgtaaatcaagattgcaaagataacagtataagtcagttgggcagagtttgtgcaaacctttcgatgagccactcagttcaaaattggattcctggagctcagcaattcgattcctcagatcatgctcatttttcctggcaagctcttttgtctcgtgcagcagactcctggtggtttcaagggtcccgagatgagggactagcctctctaaggttgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatgcggggaatttcttcttcatcactgatcattggccctaatgtatccactgacagaggttagacaattggtcagagttatttgggtcgacatggtttcagacaaagtgttttacccgtaatgatttctagacgaggacgagtagatttggatgcctttaaaggagatccagatctctggttattgctggcgtcttgaccgcgaaggctgtctgcttgagctccaacttctggaatctcttggcttagccctgcgtccgactggtttccagtcgggggctcctgattaactccggcttcggcttcggccgactggtttccagtcaggggttgatcaccggattctacattatcggttgccggctgattgtcactcggacggtcctcggcagttggcccggtttctttggaagaacttgcgtccacgctagtcgggtcagaatctttcccagacggatctatatcagatggtttcttgcaatttgattatcagtattattgccgcaatggatgcgcatcaatacaagagagatcgttatatgagttgtacctagaagacttcctgatctttggcgcagggcgactggatgttttcttccttggagtagcctgttttggtagtttcttggttgtctctcggtctccaggcctcctggtagtatcatcggcttcgtcgtcacttaagaccagcttcctctttcgagagtctgactggccgactggatcagaagcacttggttgagtttcagaccaaaatcttggtcctccgttcccttgcccagtttggtggcggggagatcggcgttgagcgattggtggatccgactttagcaaagcaaattcctgggtgtaatatctttcattattaattgattcaacaggaagacaagatcatattttgaggaaggatgaaatgtttgagagcataccggtggaggagggttgaatgcgttgaatggcacaacgggcagcagatgtgagtagctgacaacaatagcgtttgagaagattttgtacattctttctttcatgaccttaaagtcaagagaatctggatcttcccgatttggatcatgcttgccatcaaactcaaaagctgtgcgggatctttctttgattggtgctaaccgacacttgataaagtgccgggtgatctgctctccttgaagaccctgttctttcagctttatcatcctctccatcagttctactgcctgagcagcttcatctcccataggcaatgagttccatgtgtcctagtaaaccggaggaagacagcagtactcggggagtacgggcttaggattctgaacacagaaccagttcgcatgccagcctttgttcgaggtttttggctcaaggttcctctgagttggaaatcagctcccccaacaacgcacggcttgcttttgtttggctggggcttgaggaagaagatgcggcggaacaaagcgaaatgaggcctaatgcccataaaagcttcgcaggcgtggataaaattggcaatatgtactatggagtttggattcaagtgatgcaagctaatcctgtagaagttcagaatgccccggaaaaatctcgaggttggaagagaaaatccgccatagaagaaatgagcaaataccacgatttcgtgtgtatcgggggtcgggaatgcctcaccaaatgccggtcgccacccgatgatctcttttgctggaagaacgccgtgtgccaccatctccttcagattgtcttccgtcacatcggagggcgcccactgactctcgaagctttctctttcttccgccatgaatgtgaactggatggattgatttagttcgagatatggctggaaagggatggggaatcggagcggtggatgcggggagaaatcttgtgaagtttttgagggtggattggagcggattgatgaaccctagtttgcccggcgcaattttgcactgtagcaggaaatggggaaaatggcgagagtctcggcggggaagacgaagagacgtttttcacttcggtattattagggtatccggagtactaatgggcctggacctgtacagtacttcagcccaattatgttttcagcgtggcccgttgtgatccctagggacttaggcgctttttgctttggcaatatgtgctcacaatgatgtggcccgatactgttaaaatcctttttaacgtgattcaataattctttggaattattatgatgcacatgaaaaggtgcccgatagaaaggtgttataccatttttgtaagcttttttaggctacaagagctgttgggttaatttgagatgactggtttattagtaatcattctcctagcatgttatatgcttattttggttatgataagggtcacagcctaggctgttagactcattaattaccatgattttctgtcatgtttgggggatcattttaagagtttcttgctcggattcctaccaaatatatctatttttgggccttttgagtgtttgtcactcggcccttcttgtattttttgtccttgatatattcaagttgagaagcagtcgtctaggtatcttactaagtaccatgcgtgcttcgctataaaaccactcggttcttgactatatgtttagtttttcaactaatcacatagtcgggggctacacctaattaggtgcatctactcgatgcaccatgttttattttcgcccttcacagtttttgatttttagtactcgacaagctggagcaagttgaattgaagcactcggattattgttttttgtttcaagaagactattttggtcaactgcgaaggtctcgggggctactgtggagattatggtttgtcacgtcctgataaattcatcccgaattaaaaatcattcgctaaaaggaataatagaattaattaaaatgcgaaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctccctttcctccctctctttctctccctctc

SEQ ID NO: 30685 - DNA, 1601 bp, Oryza sativa
ctccaacatcgcatcagcgcgttccacgccgtcccctcctccgctcagccgctgctgcctgccatcatcgtttcctcgtcaccgttcgtcctcgccgatcgacgtcccgtcggtcgcccggctcgtagtctcgcggcgccgcctccgtcatcatcatcgctgcggcgtgttccacgccgtcctcgtccccgtgcagccgctgccggctgtcctcgtcgcctccttgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtccttgtcctttcggtgtcgcccgtgctcgttgtgcggttgtcggccccggtacccgtgtaccggtgtcggtggtcgttcacgcgtgcgggtggtgaccgtgtagtgtccgtgttagtgcgcccgctcggtagccgcgtggtttccacgtgtgcaggccgtgtggtgcttagtggagtccgtttgtcggccactcgcctcggttgacacacggggtctgcttccgtcgacccggggaccatctctgtgtactcggtctaccgcggtcctttaggttgacatgtggggtccgcatgtcaacagcgcagccttcctgtctcttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgctttctttttatgtattgttattgcttctttataggcttgtagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagaccttattattgctattgttattattaccttgttcaccctagaataaacaaaaccccaactagtggacactctatttatggttccactagtatgaacttaggtagatgctgtcacgaccggaaataacccaacgggctttcctgacgtgcgtgcattaatccttgtcccaggaggcaaggtacaccaaaagttgatacaaatcagagtttaacaagcggcagcgtaaatagttaacttattacatgggcagcgaaggcccagcacacacagagacaaacgagaaac

SEQ ID NO: 30686 - DNA, 16438 bp, Oryza sativa
agagagggaaaaacaggggaaacggaagaggaaatcgcggggaatgattcccccctcattatggcgcgcggggacggcggaatccggcggaatccgcggcggcggcggcgctagggcacgggcgaacgccggaaacgccgggaagaaagccgatgacaggtgggccccacccgtcagcgaggggggcgggcgggcccgcctgtcagcggcgctcgcgcggggaggagccgatgggccgcgggggagaggagagagagggagagaagtgggccgagccggcccaagaaaggaagggggggaaagaagacttcttttagggtttttctttttataaacctttttaactttgttcatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcaaggatgtattttagagtcgatttgggacgcgacaatcaccgacgacgttatcatcgccgcattcaccaaagggattcgccacgaagaattggtcggcaagttcgggcgtaaacctcccacgacagtcaaacttatgtttgaaaaagccaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagattatttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccaaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggatgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaagaagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaatcatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtagtcgactcgaccgccggctatgagcttctcagttttttggattgctactcggggtatcatcagatccgactgaaggaatccgactgcttgaagacttcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtctcataggggtatccaagccaacccggagaaagttactgctatcctcaacatgaaaccgccaagtacccagaaagatgttcagaagctgactggatgcatggcggcgctcagtcgatttgtttcaagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacggattgctaagtgggctttggagttgatgtctttggacatatcattcaagcccggaattcaatcaagtcccaagcgttagctgattttgtcgccgaatggaccgagtgccaggaggatacccccgcggagaagatggagcactggaccatgcatttcgacggatcaaaaagactttcgggcactggagcaggagtggttctaatttccccaactggagaaagattaagctatgtgctttggatacatttttcggcgtcccacaacgtcgccgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgcagccgactggcgagagcccctcatacgattcttgacttctcaagaactcccccaagacaaagatgaagctgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgtggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagttgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcatcgtttctacgcttaagcttatcactgtacttccctatcttgactgtcaacatcaagttttcttcttgaagttgtctgtcgggggctatcatcataataacggagtgtgattttttatcaattcaatttgcttccttggtctatcattgccttgtttgatttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcgaaattgatctacgacgtcacttgcgatcttgtcagccgcattttgagcattgctgataagatcaagagcagcctctacgcttgtcccgtctgcaaagccatcaatggcgtcaatttcaatcctcgggtacaaggatttggtcatcgccaatgccgtgctagctcccatactttcagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcgagctccttggcctcgtgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttatgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgagggtgttcctagctgagcgtggggtgatccttgttctttatctggagacccaatcatcgagtcgttaccagcctctggtccttgagaagttgtcgtctgcgtttcaacttcgggagtttcttgatctggacctacatccgactggtttccagtcgggggctcttgggttgttgtagtttcagttgctgccgactggtttccagtcggaggctggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctggaagatgttctaatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaagatttcggatacgtacctgcggaggcggattgaatgcgttatatggcacaactggcagctgatgtgagtagctgacgacaatagcatttgagaagattttacacattctctccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcagctccaaggcttgggctgcttcatccccaatcggaagagagttccaggtatcttggtacaccggaggaagacaagagtactcgggaagagcaggctcaggattctgaatataaaaccagtttgcatgccaccctttgtttgaggtcttaaagggcatagagaagtacttctggctcagagtccccctcagctgaaatccggcccctccgactacacatggcttactcttgtttagttggggcttgagaaagaagattcggcgaaacagagcgaagtggggcttaattcccaagaaggcttcacaaacatggacgaaattggcgatgtgaactatggaatttgggtttaggtgatgcaagctgattccatagaagcttaatatcccgcggaaaaattttgaggtcagaagagcgaagccgccatagaagaaatgggagaagaccacagcctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttccaaatgcgctgatttgattcgagggatggctagggagaggtgagggattgaggcggtagatcacgggaaggattttgatgaacttttcgaaggtggattcgagtggaatggtgaaccctagtttgccggcgcagctctgtactgtagcagggagtggggaaaatggcgagagttccggcggggaagatgaagtgtcgcttggatctcgggatttcttgttaagggtatcggaggtgcgaatgggcttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcttctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgtgaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaatgagaaggcatgaacctgtataaatcctttgtctccaaacccattcacttctccagcttgatagccaccccttttattattgccgaaatctagtttcgacactaagctttataaaaaaaatattgaccataatatactaccgtcctaattgattcgtcccgacctttggaaaaaaaaacaaaattcattgaaagatccttttgaaactctagtatttagaagaataaatgcatgaaaatccagaaggtaataaagcgcttatcattcaatatatacggtcccaaatgatcaaacggaccgatgagcagcactatcatggggtcggatggcttgggttactagagtacatctgtcctctcaggctctcactaacaaaccctctcctccataatgtggttgtgggtgttggatctattcttgtgccaaatctaagcaccccgatgctcaaaattgtaaaaaaaaaaaagtaaaatgttgaatgtgtgcttttaaaagacgttattgtacttattcatacccgtcacgcaagttcatgtacctaagtatagttattttttctctttctcacgatatttgtgaaacgtgcgctgcgttgtggtaggtgttgaaaggccaataattgtggccttttacagttatagagatatttttccatatgattatccaaaatccccacgcatttttgtagatgtttcttcattttcttctaatttcctgatatctgataattcaaaacatttgactcgataaaatcgacacattgcgcaaacacccttgatatataattttttttcccgatcggtcaccgtttccaatcctattggtctcgccgttcgaattgaaatttcgattagtaaatttttgtttgatttttgtcagtaccctagacgcagttacgttacgtaccgcggtaatcatccatacaaatggggtggcgagtggcaataacctccaagatgagaattgcaaaccctggcacgatcgatacatcgataacctgagccatctacttattcttgatcgaatgattcaaatcgacagaggtcgacggccgcggcggcggcggcggccaaaagggcgtcgcctcatgcatgcgctgtgcctgctgcaggtcgatgagagaacgcatgcgcgcggcgagctcggcctcgcgcgcgcggagcagctcgttctcggcgtccacggcggcgcaccggcccacgggctcgcgcgcggacacctccacggcgccgttctcggaccgcagcgcggccgcctgcgccgccagccgccgctggctgcgcgcgcgcgaccgcgagcgctgctcggagtttgagtactcctcccgcttccgcttcccctcctccatcacccagccacctccgatccgtcagacaaaataccgctccaaaacgataagtattatcaattcggagagaacgtaagtaattaattacttggttacttgattgatttgctccggggacaactcttaattaacaagagtaattaacgacttgaaaactcttgcagggtttggttgatgagtagaagatgtagaaccagtagaggaaggaagacgactgcacgagagcaaagctagctaagcagtgcggcgctgccactgcaagagagcgaccaaaccttagtgagtgaggggcgaaatttatagcagaggttttgcttaggggttaagtataatcctactttagtggggtacttgcaattggtggatagtggatgggaaagaagacgaaataaagaaaagaggagaaaggaaaaaaaggtgaatcaaacgaaaacggacgtgatagatcgtttagcgagaactagctaaaccgcataccaaaacggtgcaatggtatataaatatcagaaaaattgctagttcaaaattcgtttttttttaatctggagttcaaatatatgtttagattattaagctcacgaacgtgtgacaaatctatctatctattactacctcacgaatctggaagcatgaagagcaatctgtagagaaattttgaattgtttcccgtagcgtatcactatgcccaacgtattcggccgctctaagagcaagtttaataagtttaatagtatagcccattattagctccaattcacctatagcaaatctaatagccaattcatacaactagtcgccaacccgttgcacgggctattactacctgatgcaataaatattaaaattgtgatcatggaattggatgttttgtaattattaatttagtttttttaattatgttaatcaagtactaaaggtctgatgtcatattcattaattttgaattctaaaattattaaattctataaaaattagaactaaacaatccttggtacttctagtttgatgttttatttaacacaaattcttctagtttgatgttttatttaacacaaattctttggtacatatctacagtcattatattggtatgagttacatatatacataattaataattaataaagttgttttacaaccttattgtgtcaagagcaacactcttacaattatatatatagtttattaaaaatgttattgtgataggcaataagttttaattatttaactgtacgaactgcagtgatctgaaacataccggatagggggtatgttttgctactcattctattgaaaaaaaatcctaattcattctgttgcaaaaaagcaccagtgcatttaataaaaaaggtatgttttagttttgcttctctagtcttgatgttctgaactttgatatcgtttgaaaagctcagtttttttgtcattgttaactggatgatattctactacggatgaaaattgtgcaatgtagatcagtactgatcttttgtactattaatggcctgaacttattgacctgaattttttttatattatgtatcaatttatcatggtgccgaaccgtgaagtgcatgggttattatatagaaaaggctatatgtactaactttttctattcttactaacactgatgtgtcatgctatgtcatgctatgagtgcatctagattttttgtaacttccatctacttaaatcaaacggttgagatgattgttagtaaaagtttagtaagaaaaatttagtacgtgtagcattgctcttattttatatatatatatatatatatatatatatatatatatattctgggacttcgaggttctcaatttaacaattcaaaatttgaatattgtaactgctagtttgtcctattgttatactcatgatttttaaaaagatgaattaataagtatttgtaccaaattgtattaggtctggagtctgaatttcttttcatgattcagtaattccaaatgttgcacaaagattctagttttaattttaattattaatgatttaatcattttgaaattcataattaataattagcgtggtgcactcactttggagtccggattatatcttttcatgatttaacaattctgaaactattgccgttgtctgcctgcacttgattaatctccacatattacattgttgttagtgtaaaataactcctgagtgttgctctttacttacattacaactaaaagtgaatagccgatgttggtatatttgctgtagtattaattagcgtggaaagaatgaggctgattgaaacatagctttaggagatacaatcaagcagtacatagagtcatcaaaacgtaaagattagaaaaaaaaaacattagatcgtgcttacttcgtacttgaaggtctggccctttggcattagatcgtgctgctcaataatcgtctactgatggttgatggctgtgccgctgcggtatgtgcaaaccaggccaacatgcatgagccatgcaacaccaaaacaggttagattagatgcatagacgaacgtcatgctgtggcatctccgccgaagagcgttatcaatccagatcgatactctgcatgttaaccacttttcagatcaggaacatgtaaagaaccaactaattaaaaattaaaagtaccaattgaagctttgactgactccagaaactggtcggataggtcccgatcgagatcgtgatgtcatgtgcgtcctatctttgcctctctttttgcttgattgcgctttgaagcggttctcgacacggagcgttaccgagcaacaggcgaactccaaggaggtcgacgcctcaacatcgacgacatggccgcggcccggcccaacgctcgtcccgtcgtggcatgaatcgaggaacacatgaaaatcgagagagtatatacgtacatatagatgagaacctatcatatctaaacaaggatcgggatcaggtgcagtccctatagagactgcaactttggcagtagccaatctgaaccgttcaaaaaaaatcagacggctggctcacaccactgcaccagctagcacccaaaaggtcatcttcttccttgagcggtagagctctctttcttctccatgtcaatggaagtgctcggtgcttcttcttacttcatgacaagttgacaactacgggaccttcgtacaaaccattgttgtgacagtgtttaaccggtcaagcagattctatttttcgtgcttcatcatgatgttcttctgtgaactcccataaagtgataatctgcactgtcactgtcaaacgccaaggcagtaattaacctgcgagcagaccaagccaacctcgcatcctcctcgttcgatcctacacctagctaccagtccaaatcaccgccaaaccacgagcatcaggcaagtaacaaagctaagcagcacaattcctggccttgaacccttctcacccgctgatacctccgtcttgttggtgaccacgctctggtgccgcctccaccgctccactcttgaagcccaccggagatggagaggactaaagggttgttgattcgtagacgtcggatgcttcgtggatggtcagatcaggtgctactgctaaagttgcagtaacaatagcaatttcacctgatccgaatccctaaaaaaagagatgagatcgtatcacataattgatattggtattcagattgattgggccttcgaaattggcccattaggtgagatcttttatctacggtcatcataatgagattaatctaatcaacggtcagatttttctggttaacgtgagagctcctaaaaagtgcccaattagtataggtatagatagatagatagatagatagatagttacttacttactatactattaatatatggtcccacctgcgatacacacactgcatcttgtagtccgtgttgtagttggctatagatctgtagaccgctgctcttctctttcatctttcatatcattaaaatatgtttataattggctaatagtctactattgtatctgctctaatcatgctgctctcatcgtccgttcctcagtggcggccaccacaggcaggtgcccaggctccaccgcattaaccaatgtattatcacttaataattgtctaatttatttacttctttttgtggaggctacgacaccagcagccgtcaagggaacttgtagatccgctactggccgtcgtgctgttcgccctttcgacatcgacgtgcgtgttgttcgtccattaattatcaacacaagcgatgcatccacgcaccttttgaatagtggagatagggatatagatgtgtgtgtgtcccattttagatgtttaagctcttcttgattcataggagggcttcaacctctcgttagatgggtggctattaataacctctgtcaatctaaacaatagtatcattaatgtagatgggtgtctttccgtaagttgttccttcacccttgcaaaagaaataaaacgtctgtttagtggagtttaaaattctgagaagcagctggttggtagccagcttctcagaatctggaaagctgggtttcctagcttctggcttctagtttattttctgaattctacaactacagtttctcaggatctgaatcaaaagctagactgtttgggggagcttttgattctgggagaagctgcagcagttagaagctctcctagacaggcccaaaggctcctaactggttaaatgtcccaaacaaaacacccaatcctagagatatttctgaacatatagatttttttctaagatgaagagagtacatatagattttagaacttattttattatttttgttataacttgtaaatgtcaaatttgatacattctctgtcaaaaaaatccaattctaaagatgaatctcgataaatatgtgtccagatttatctctagaatctaaataaatgagtatatctgtagttgaatttgttgtttttttaaacttgtagaagtcaaattttaacatgtaatatgcagagtgatgaaatacatattgatcatttgatctacattattttttaaaaaaacataaccatttattagttagtatgtaataaatgagtggaccactcgttgataattaaaacaggctccccaaacacaagtggaacacaagggtgagtgattttagatatggatcatatgtactagtaatcttcaagcagtgttatggtcaccttcaagcttatgatagatgaaactgtttttttaggggctattgcttatttgaccccgttttggatcctaactaccaatttgaccctacttttcaaagtttgcttatttgaccctccttttcaaaaacgaagctcccgtttgaccctgtttccactagtccgttaagtttttatttaaaataaaaaaagaaatgcaactattattcataatacccataataaccttaggaaaccctatccatccaccctcaaccctatccacatttctctctctacacaca

SEQ ID NO: 30687 - DNA, 18254 bp, Oryza sativa
  unsure (1)..(18254): unsure at all n locations
gcctgctcgccctctcgccgatccgtggagaggagaagagaagagaagagaagagaagaaaagagagaagagaggagaggaggagaggagaagagaagaagagagatctgccgggtgggtcccacatgcaatagggtcaaatgagtaagggcaaaagagatattttgtgcttcagttaacaccgttagatgcccttaacagaacagggtcttacgggggcttcgtttttaaaaaggagggtcaaataagcaaactgtgaaaagtagggtcaaattggtagttagggttcaaaacggggtcaaataagcaattgtcccttttttttataggtttgttataaattaagacgggcgccattcgtaataccaacttaataactcgaataaatcaattaccatccacagaacactaagagataaaaaaaatcacaaatctgcttacagaaatctacaatacgcgcgactccaaccaagaaccaaaaaaggatcttgatcgatcggcgaagatggaccattcgatcctgcgtgctagacgagctaatcattagccgggctagacaagctcagagcaagtataatagtaaactataagccgactaaatgctgtgatggaggagagaagagaggagagggaggagaagcggactgtaaacttacagctggcttggacataagaaccaagagcaagtataatagtaggctataaaccgactaaatgctgaagtggaggagagaagagaggagagggaggagaagcggactgtaaacttacagccggcttagacataagaaccaagaaattctgtgagagacacaagtggatcctatattaattgtaaagagctaactattatatgggtgggctgagagaagacttaaaagaactttatagttaacaagtcgtctgtattattagccttgctctcagagataaaaaacaaacacagaaccaagacctaattaactcaggatggttgttcgccacagtagcacgcaggccgacaggacggcaaagacggaacgcgggaccaccacgttgggcccaaacgagtagaatacaaaggaaaaagtacactggaggtccctgaacttgtcaccgagataaaaaaaaaacgtccttgaaccgtaataccagacacccgaggtcccctaactttacaaaaccggacacctgaggtccctcggcggtttttaactcggttttatccgacgtgacggctgagtcagcgtgggacccatgtgggccccacatgtcagccgggcacgttagcctcatccctctcccccctcttctctcccttcctcctcctctccctctcactcttgtctctgttggcgggggagcaaggtggcagcggcggcggcggcggcctcccccgccctcttcgctctgggctgaggctgccgtgagtcaaatcggcggaaacccaaatcggaggtggcagcgacgcgtcggggaggagctcgtggtggcagtgcccgaggacggcaaggtgggcggtgatgtgcgcctggtcgcggcggagcgggcggcggaacaccgcggcggagtggccgcggagggagcagcggaacgacaaggaagaactcgccgcggtgggaggaggagaagttggcggtggcggcggcgagctcgtggaaggcgcgcgagaaggagaaggcatcagaatcggcggcggcggggaggcacgtgagaaagcgagcgtagatggcggcggcggtggagggattggaagccggtggtcaccaaaagagcaccggcgaggcgggagtaagctggggagaagaacaacggcggccgcggaacagtagaaggcgcgcggcgtccggcaagggaagagcgtatggggagtgtcggtgctcggccggcagggaagatgccgcttcctgctcccgcatcaccgcgccgccttgtcttcttcccacgggccgccgccgcggatggggagtggcagcgctcggcctcgtcgtcgtcggcggctccgggcagggatacgacgctcggcttcatcggcggcggcgcctccaaggggatggggccgccaccgccgccatgctccccatcatggatagggcggcttttcttgcctcgcccgccgagctccgggcagccaccgcctttcaccgccggcgtcctcctcttccttcgccgccgcatcgacagcgtgccccgctgctccctcccggccgcctccgcggcgtcgtccctgcgagtgcgagcaaagagcgagaggaaggaaagagaaatagagaaagagaaagggggaagagagaggctgacgtggccggctgacatgtggggcccacgtgggtcccatgctgactcagccgccacgtcgaacaaaaccgggttgaaaaccgccgagggacctccggtgtccggttttgtaaagttaggggacctaggatgtctggtattacggttcaaggatgttttcgtatctcggtgacaagttcagggacctctagtgtactttttccgaatacaaagggacatttaaacggttgttgcttgggtttagtcccataccggggagccaagccggcacgctgctcctcaattggtggccacggcgccatccaggcgtgccaaagtggaggcacacgaagagcacgagtgagctcgtgtgctagttggcagcacggcgtgcgtggtatatgtgcacgtagcaatccctaaaacaacttacttatgaattgatttgatgaattccctctaagccctgaggagcatccgccatactagcagcccaagcgcgtgacacatgcgctatgcaatcgtttttttcctctctttttaaattactttattgaaaaaaaaaactagaaacatactacacggttcagcatacagtttattgaactgaaacgacctttcatattctttgcataacatcttctattataataggctagatgagagatattttgcatatttttgacaaatatgcactagttctgatgatagttaatctcttctattatgataggctagatgagagatattttgaaaaatatgcactagttctgatgatagttaatatctcacatccttagccaatatgtctgccatcttgttaatttatctgggaatccatttgtcctgcatcaaattgtccggaatatttgtttgaatttgactaaggaaaagcctcagacgtgtcctggctcctggctcatcttcaaattcaaatttgtttgaatttgactaagatattttgtgtttgcaatcgtctcgttgccggtgaggaaaatggtacatgcaaagtccaaaaattttgctacctccatcgccatttgaagagccatcaattctccctgcaaagatgatcgagctaccaaaatagtagcctttagaaaaagtgcattatgagtgcttggtatgtggaagaaaactccaattccagcatggccatccacccaggctgcatcaacataacacctattacccctcggaatatctggtattcttatgtgagtagtaacttcgtcatgttcgtcttgattttcctgctgagatgagaatttggcataagtcttccccattgcttcagctgcaaaacaaacatcagtaggttctctatgtttattctgaaattttaagttattcctagattttcataattgccacaaaaatagatatattagcctcagaaattctccaagttagtttactgaaaggacaagcaaaaagaagatgataatcagactccagctgcccacatcggccaaagttgagcgaaatatctctcattctgcaatttagcctctgggaggaagagcctctctgagtaatctccaagcaaaagtcttcactcttggaggaatcagtttatttttccaaatttgattcatgaggggaagggtttgggtgtttacctgttgaacattttgattatcccttttaattacctgcgacatttcactatcattttttttaagaaatgaaaattacccgtgacatagtagatgctatgatacgaaggaggtaatgcatcttcttactgccaatgtgaccgcctatatcttggcagttccagctcagcatcgttacggcgctcgtggcgccttaagagctaacaccgatggcccatgaataacgcaatcatcttcctccatccctttctccccacctccagcaacagatagagcttgatggacaatttgcaaaacttccctccggtccaaccccattcccaccaaaaccagaagcaccatcctccactcttccgaaggcagtaaatgcagaagcagagctagaatcctgacaccaacacccatcaaccataccgagaacttgagggggtgtttagatcccaccacaaaaattttcaccctgtcacattgaatgtttgagcacctacatgaagtattaaatataggctaacaaaataactaattgcatatattgcgactaatttacgagacgaatcttttaactctaattgctccatgatttgacaatgtggtgctacagtaaacatttgctaatgatggattaattaggcttaataaatttatctcgcggtttactgacggattctgtaattagtttttttattaatgcccaaacaccctatacaacaccctataaaatatccgatgtgacacgctaaaactttacgcccctttatctaaacaccccctaaatgggattttagactcatgtgatgggatgattctcctatgcagtattctcctcttacggggttcaccgacatgtgggctcgttggttgtggggcccacatgctagcccctcaaagtcagagagcaatattgcaaaggatttgtttcccttcactactacagaaatgcatttcagtgccggttgggagaccccctttgatgtcggttatcccaactggcactatgttagcggcactgattagggagccggcaccaatcccattttgaaaactggcacctttgagacctctgcgaacccaaaaaaaaaaaaggctcgatgcatcggctcgaatcgagccgatgttccccgtcacccctagacccgtcaccccgagaccatcaatccaaaacaaaatcacaagaagtttcacattgtcaccatcgatgcatccaagcatatccctcaaagcaaatcacaaaagtttcacgcaaatcacagatgaaagaatcacaaatcaattcatccaacacatatctctcaaagcaaatcacataagtttcacacaaatcacagataaaagaatcacaaatcacatatccctcaacaatttcatagaaacaatcaccattgccgctacgtcgccggatccattgcgggagccgccgctccgcccgccgatgccgacgctggatgcagcttcgcccgccgtcaccaccccggccactgccgaggccagatccatcatggggccaccaccgcttcgcccgccgatgccgaccctggccgccgacaccgccaccattgctttgcccgccgtcgccaccctggccaccgccgaggccggatccgtcgtggggccgccactgctccgcctgccgtcgccaccccggccgcctcacccactgccgcatccgccgagggagaagccaccgacgacgatgccgtatgcagggagaaggaggagggggcaagagagagaaaaactgagaaagagagatcgagaagccactagtgacgcccttatccttatctcgtcctggtggggcccgccggctcggctcgatttgggtatcggttttttaaaaaaaccgacacctataatattttataggtgtcgatttaaaaaaaaggcacaaaatataataggtgtcggtttttatttggaaccgacacctataattgcttaaaggtgtccattttttacgatttcaacccgcggaggtgggaaaaggcctataggtgccagttttagcactaccggcacctatagtggcgacacctatttgatgttttatgttttgtagtagtgcttgtgatgaaatatatcatgtcaacttggtaatgcacactagccatgtgcatgacaaatgggctatgcaatatttttcttctttacgagtataccttttacactgccttcatcgtgtttctcaatttcttctccctaagcaacgcaatttcttctccctaagcaacatctcgtttgggaaatgcaacactaaaaaggcagaaaggtgcatcttatctttcttcttgatccacccccaagaggccaaaacaacaagatgccttgagcccttattgacatgcatgatgcatctagcttagagggaaagaaaacataatatgttcataaccagaacagagtctgcagttctggagcaagagcaatttgttgatcatcaccagcagacatagatgtgtcgtcagccatgtgaaacaagcaactggagcaagagcaatttgttgatcatcaccagcagcacctgaagggtgagaattcaccaggattcaaggataattatttcagcatcatgtttgtggctaacattttataatataggatgcaaacttttctgccccattgatatcagccaaaaatcggacacagatcatgagtgttatagcatcagaatgctgcttgtgaatgccattttttcaatggttgtggttgtcaagttgtcaaccatgactgcttccaagttatcaccaagcaaacataaagaaaatatgcataaactaggtaattgctactcaagatatctacagtttcccggtaaaaagataaagtaaacatattaccatatcgtagaaagggtataaggtcccattctgtgaggtgcaaaaggcctttttgtgtgcgttttgattaagtttagctactagtgctcaaagcctcaacaacaaaataagttgctacaacataaagacatttccaaaagtagcaggacccataactgaatgaggcagccacgttatgcaaatttgcaatgtcgagcattactatagtttagatacccacttcactgttatctcctttcaagagatggtgatgatttctataaaaattctgcaagagggactgcaatttaaagaatggtacatttgaaactacagttagcaatcattaaatttctgaaatgatttactacgtttaaagtttaaactggtggacacgaaacattgtgttgaggccaaaacaataaaacaagaataaggcggagaaaacataagtcgaggttaaaaggaacataaacggatgaaacacatcaaaactgatcaatgtgatatcattcggattctagaatcaatgaagccagacatctgactagggttaacattctatcagcactaagaaatctgaagaacagcaataatgcatgcctatgacaagtgagagatacaacttacaggtgataccttaacttaacagaaaagaaatggaaagtgccatgatatggtcccaagcaagtcagagatcatgcgcgttatgagacaattatggtgctgataggttgaagatgtttgagggtagaacataatagtatcactgattgactgtcccactgatgttcatactgcctttttatattaaattggtgcatacttagagttgtttccatcacttggtacatcaacagaattgcttgctttgtgactgaatgatggcagcagttatatgaatgatgcttgaactccattatgcatgatagtatcagtgacacattaacaacttggaaagaaaagaataaatgcccttcaaggacaataaacaatggtgtaacattaaacagtaaaaggttacctgagtgacaatattttctctaggaagcatgttcgataacaagcattaacaggaagcaagatggagagaattacagatgaggagaagaactagcacaccgataacaaacctaattctcaaccaatcagaacccagatgtgaactcgatggatagtaagaacagaaacagcaacttattcacatgccaattgcacaactatgacagtaaatggctgtgctattagctatttaatttatatgaatttatataacatagttatattcatgtgccaatatcaaccttagcagatggaggagacatgatgtcagtttttactacttttttaatctatgatcacacactctactcttaagttctttctgcttattctctatgaattaaatccttgaaatcaggccaaaacacttgcccagaagtggggacaatacttttctttaatggtaattgatactccctccatccacaaaagttacacctattacttttgtcaccaagactaagaagatattaaatcatcttgcatgttacaaaatcaaggagtgaatgcaagcatgcaaccaatgagtatttagatgactccttggattctaatcaaacatttaatttatctttcatttcagtcttggatgcataaagactacaaatatgaacaacttgtttggaaaaactcaaatgtgaaatatgcctaacttttgtggatggaaggagtatcaattataattgtgaagtgaaatgtggtgcattagaaaaggaagagaatttccagtttctggggaaaatcaccgaatatgtggttttggagctaaaactatcaggtactccagtcaattcacttaattgtattggtatgattatagaacttcatcactgaaagttatctaacatacttcctactgacaaatctcacagaatttgatctacctaagattcttcaggctcaaagaatactttcagagaggaggccagaacactatcacagtatagcagctatgagccatgagagcagcccaaccactggacattgttccaaatgttttgcaagatgcttctgcattgagcttgtaggggagcaacaataagcaaatattttgcaaccaaatttgaaactgcaactagtttatggttaatctatcgcgaagactgatctttggttgttgctatacaaaagtaactacgtataagactccttgttttttttcaacgacattgcttggcttgtaatcaaatcttgccatccacaacaagtctccaagaagttgaccatgctagaactactgcaaactcgagattcccaaaaacattacgttgtttgaaattctgcaaggtttaagagtcctcagaaggactttatccttcaaataaaatgctcatcagataattgtcacattggagcctaaaggcgagatttgcagttgaatttatggagcaggttcgacactccattagaactatagttaactaacccaaattctcaaatgttgtttttattttatcatctgatttctattcaatttctgaaacaactgtaagctggacttattaactattctttttggagtttgtagtctcagtgttcttaacttgtaccttgtaccagttcaatgctttgcatcagagataaatctatcttttagagggtcattttccagctaaagaaatcgaactatttcagacattctgggacactgagagtcatgaaacaaatagaatcaagtactattcaagccaaaacactctcatggttgcgtaacagctaacattaaataattgacaaccataacaatcaacataattgccacaaaattgtgaaaaggcatgagtttcaaccttgaccaaggatccagcaaccttgcaatacacattttattatttgtacaagcatatcaaggtcaaaccagcaacattctgtagaacaaagcatggtagtactaaaacacaaggaatggggacatggaggcaccttggcaaacaacctcatcatcacaacacatgggccatggcagcctcacttggcggttgctgctccaagctccgcatcgatggctctgcgcgcggcgtcgaggtcctcgtcgaggaagatgtcccaatggccgtcccagcggatgaagaactcggtgtcctcgaagtacttgacgcggtgcacgtcgccggccggcgtgaagaggaagtcgccgtcgaccaggtcgtagctctccttcttggtgaggttccagaccttcttcttgccgctgatcaccaccaggtcgtgcccgaacgtgtggtggtgcgccggctccacgctcccggccttgaaccggacgtacgccgacgtggggctctcccgcacgatccgcatctcgccgccgggcatgatccccaccggctcgaactccatccccttcctcaggcagcagatggcgcaggcggagtcagggacggaggcggaggagatgtcggggatggcgcccatctcggcgggcgcggagtcgaagaagcgctggatgtcgtcgggccagggggcgtcgccggagcccgggcacggggcgcggaacggggtggcgagccaggcgtcggcgatggcggcggcggcgtcgggcggggtggccaggccggagagcgcgaggacgttgcaagcgttgatggagcgggtgttggcggcgtcgccggcggtggcgcagtgagtggcgtagacgccggggtacttgttggcgaagatggcgacgccggcgcccgtgccgcagaccacgacgccgcgggcctcgagggcggggtcggaggaggaggtgggggtggcgatgacgctgcgggcgacggcggcggcggcggcgtagtacttgtcgacgccgaggtcgacgacgtcggcgacggaagggtgggcgcggaggtgcgcgacgacggcgtccttgagcggctggccgaaggcgtcggcgggcgcgaagatcttgaagcgccggtctgcggcggcggtggccatgggggatggggcggtggatgtctcggttgcggggggcgccgggggctggatggatctgagggcgaggcgaggggagggagcagagcagtggccacaagtacgacagcagcagtgagtgagttgagtgaagtgagagaggcgaccgcggtgaggaggacgaccacgaccagggcggcggattatacagatattttatctgttcttctttggttgcgtcgagtgacacgttggtaaaggcctaaagagccaaattaagttataaggaaataggaggatcatttgtttggaggttgtaattttgataacttaggttttactacctctgtcctaaaataagtgtagccgtggtaatccgtatctagcatttgaccgtccgttttatttaaaaaatttatgaattttttttaaaaaaaactagtcacacgtaaagtattattaatattttatcatctactaacaataaaagtactaataataataaaaattaaaataaaacttagacatgagcagtacaaaactgcacttattttgggacggatagagtatttagcatagctctgaatcttaatctataatactccctcccgtaaaaaaataaaacaatatgtccaggattaggttgtttttggatggatggagtagatttgatgtttgtatattaaattgattttattggaatgatttttacatgattgtagttctaaatctagggatccgatgttcggatgacgagaagaaatttgggattacacctttagatatggatttaactctaataccacttgcaaatgacatataaaatggcacctcatctccactataatgtcatttcttgcctttgtataaaataagaatgaatttgctttttcttttttatcatgagaatgaaacacctttggttgagttgattcaacaggtcaggtcttctcactcttacaatatccgtcactaaccaatggcatcaaccatcgtgctccacctccacccactcaaaatccattgtcaccatcctcccggggaaacctagcttgatcctacatattctctagactacctccttgatattctttatttgtcgtctaacagctgtcaaatactataacttttgataaggggggtgtgtcgctgatgcttgcgctcggaactcacataacaatacatagtcttagccaaaacaaaacagccaaatacttgggtgctaattataccactcgagccattggtttcggcaacaattttcatttcccacttcctattcttagctatcacaataaacaaatagtgtatatatggcagccgtatagctagggatgtttctattgtaccttgatactcatactactttatattttcatagttgaaatcaattttgattattagctgagacttatttgacttgggctcaatccattgcaagaaattacagtgatctccactttccctttgccgttgtgacttgttagcatagagttggcctaaatatatatcgtattatcatgacaccaaatcatcatccatccaacttatgagaggaaagagtatagggcctattcggctgccagcgcttgtgttgtgcggctgcaactagctgccgtgtagctaaagaaaatacaagccgaatatattgatcatctttttggtgaagactggacttaaaaacttttgacttgtgattattatttattattgtatttaaaattacaaagctctagaacattgtagaactaatacgttctctaatgtaacctgaacggaatcattggcttaagaaaatgacgatgccagttgacgcttgagcccaaagtgagctctcttccacagcacaaaagtgcacacctcagacgagactggtggtggggtcaggtgggttactcgtcgccttcagcccctggcatgtggatccgtacgtgagggtgggccccacacgtcagcgaggcagacaaaagacaagggacgaagtcaacgaatcccatttctcgagtcgttggccggcttcttggcacgccgccctggcccgttcacaggcacagcccatacgatttcccttctgaatccgactgatcgcctcctcccgcaccgacgtgttcgattcgtcttcccgcggcggcggcggcggcggcggcggcgaggaagatgggggtggaggtgccnnncgangagtccaaccggtgcgtgcgcgggtgcttgccgaacgcccgcatcccgctccacctcccgccctcctccttctccctcctctcccccatcgccaaaggtaactaaatcctctctctctctctctacgctctactagttctgacgaggaaaatggaatgtgccgcgcgcagggtcggagagcacggtgtacgaggcgcggctgggcggcgagcgcgtcgcggccaagaagcccgtgctgtccacctccgacgacctcgacaagttccactaccagctgcagctgctctggtgggtactccccatgtttgttccgttgcctgtcgagtttctctcactgttgtcgtttgggttgctgatgctcgagatggaagttagcgctcataaccgatggaatagctagcattttatagcttggcagagacttgtgatcataaatttatcggtgagtcaggatgaccacctgaccagtgcttgtgttccattattgcttgatcgttaggcggtaatcttttggtgcaaacagagtgttaattacgaacccttatgcaatagtatatggtagctttaagctgttgcaaatattgattgatttcatgatgaaaagcagggagtttagtttcttggatacttgctgacacttgtaattatgacatgtaacgcttgtaaaacttgcaaactatcatttcagctttcaactcttggcttgaaaatggttgtttatatcctgaataagtgaaaacatacttcttcaagaattgctcttgacaggttcattaaataaaatgggtctatgtctgtgcagtgaactggatcacccagggttggcgagactggtcgcagcacatgcacgtcctccgaattacttgatgttctttgatttctttgaacctccaaaccttgcggacaagatacatgttgaggagtggaacccttctgtgcagcaagtggtcaccattgccactgatctaggtcccaatttattgcaatcaagtttccttttactctttgagagattgaatcgtgtcatgtgtatgtttcttttctatattagaataagacataaaacatggctgccttcaaaccgggaatgctgtgttttaggacccatcttgatatgtttgattcaatcgtgagttggcagttccccacttgtttcaagcaattaagcaactttttaactcctgtatcacttctgagcttgacgcgatgatttcttgtcatcgtatcatacgtattctggactctattaacatgtgagttctggcctacatgaacattttctatttctcaatataactttaatattatctactgcgtttagtgacttcttttagaaactagtgagggtgtaacttggttatgttcttttgtgctagcaattttaagtaaggtaattaagatcaggatcctacgcagaattgctttcatatgctctagatcactattttatatggctaggatcaggattgcaatggtcatgtagtattttcaatgcagatatattctgaaaacccttgttcttgatcttagagtaaataatggcacgataaatgtttccgacacatttgcagcatttctgttgaaaataccgaatttttccctatcatttttgtcctttcacatgtagcgatttttgaacgatttttcatttcctttttattaatataccactgtatttctctgctaaccttttgtggtacggtgcttattatgtaaccgaatgcacaaatgtaaaattaattcatggatagctaatttcccccctgaatgttaggtgaaataaaaacaaaaatattcctcctgaaatatagataagaggatgatagtaagatcttcttaaagtccatgaaccaagtatgaacaattagttcttactaattcagaatgagaaatatgtcattgtgtttagtttgttattctaattcgaagtttcttgctggctctaacttgaattgaacatctgttgttgataaagcgcaaattaacatttattttcaatgtatattgcagcaaaggctctccaatacctaaacatccttggcatagtacacagagatataaagcctgcaaacattttggtaattttgtcttctatattgaatgatttaagttctacacataatgcatttctacatacattaacaaagtctaataattgtgtacagatagataaggacttccatccacatttagcagattttggcttagccatgtaccagaaggacatcaagcatgtttcagttgaaaactggagatcatctggcaagcctactggtggtttccataaaaagaacatggttgggacattaatatacatggcaccagaaattttgagaaaggacatacatacagagaaatcagatgtatatagctttgcaatatctatcaagtaagccatttctctcttggtattaactgcagtttggcctcatatacttcaaatgtgtactccattgcctgagaaaatacgtttgtgttttcttggtggtatgcatgacatattgcctctgtttctgttaagtaccatataaccagtccacgcacatatgtagatggttgcttggaggtaaattgccttttctgtgttggaggatttggtgtttcccatatagacttgcattacatatacacttctgctaggtgatgtattctatttttttttgtgcggggagatatattccatgttgaacaaatgttggacatggaaacctacacgaatgttctctcatatctgtaactaagggccatgatcacaaaatgtgatattcctatcattttgttctctgttgttgaatactagttcatataaatcacgttttattttggttgtgtggcttgcagtgatattagcactgtattaagataagcaaccaatcaaccaatttttattgtgttatgatcatgtcttgttaagtcctgcaagaaaatatatacaagtttaacttttaaattttaataaatgctttgacatggtgactgattgactatatctagctgcatatctagtcgtgcaacctggttttggtgacaacacagtatactcatctgcatacacatgctgcttctgttgaactgtgaacattacggatttcacttccactgataataacatgactttaaaagggacgagggacacatttggctaaattatactaattgtatactttggccagctgatgtgaaatgctcatttgaaacaaagctgcatggttccaaatgttacttgcacactctgtcccactctttctcaggctttttcttaccctgtgtacataaaataaattcaaaacaaatgaaaatactcaactagcttaggttttcatgtattaacagtttcatttttttttcatcaatttacagtgagctacttacgggtgtggtgccttatacagacctacgagcagaagcacaggtacgtattttttgttctttatctttgtctctttcacattttcactccaacagcacaggttgttgtgtatggtttctaaattatataacatcattttgttaaaaattctaattggacatgcatctagccatccccacacttgaataccatttatttcatgctgccctaatggaaaaggtacattaagtgctttgacattctaccccatttagaaatttgggttgtttgctataatctttagttcctgttgactatttctgttatatccaaatacttgaaattatagcatcatttatcttcatatatgattggttgtacaatcatgcatgtgcgcctctagccctgtattagctttaattacgtatataatgccattgctgaagcaaacatgtgagatacactattttctacaattgggaactcattgatttttctctaggcacacaccgttcttgaaatgacttacaccgaacaacaacttacagcagcaattgtttctcaaggattgcgcccagctcttgcccttcctgagtctggtgctccacctagcctcttgtcacttatccagcgatgctgggactctgatcctcaacagagaccatcatttaaagatataactgaagagttaaaaataattgaaaagcatatagctgtaaattcttgctcactagcatctcctgcaaacaagagtcaaaatggcaacacagaagttcaccactatcaagaagcattgagctggtgaaccaaggggagttgtttgcaaaaggaaacaaattggacagtacagttgaccattggtctgatattttcgatcagtcctctaagtactgtccaacattaagttggggatcttttgcaacatgtggtcgaagagaaacaatggaagatacccattttatgcttccccacatgagcgaagaaaaggatctgcatgcatttggcatttttgatggtcacagaggtctacaactcaacaattgacaatgttctttactaacttttgcattaccatatcttacaccacaatttctacaggttcagcagctgctgagttctcagttcgagcagtccctggttttctcaaacagtttaattccaatacaaggtatggaatgaatgcaaacaatctgatgacatttttcatgcctgaagtctcaatctgacttctgttttctcgtagcccaactgatgcccttacagaagcatttgtaaggactgacatagcatttcgagaggaattaattcttcaccagaagtcaaaaaggataacccagaaaaattggcatcctggttgcacggcagtgacagcactgatagtgagaaacaagctttttgtagcgaatgctggtgattgccgggcaattctgaaccgtgctggtgaaccatttcctatgaccagggtccgcataatatttcttctttattttgcacgcttcttgaaatttaagcattataacataagatatgttttcattctgccttggtaggatcatgttgctagttgtccaaaggaaagagaacggattgtaaaggaaggaactgaagtcaaatggcaaatagatacatggcgtgttggtgcagctgctcttcaggtgctagcttttgctctttatggcatgtgctcgcatgagtatcattcactatggtagccatgattagctgtagatgcatgatataatcattaattttgataacaatagaaaaaaaaaatgctcacataacattatacgccctctatccatgagttttttttcagttggttttagaactgttgaagtgatattatgctgtttctgcaaatggggttgtcagctacgtaaacagcaagcaatattcctttctgtactatgaataatacaatacggaaatgcctattggaactcagccaaggtatatgctagcacacagtgtccaaagaagggcatggatttcaagcttaccttgctgaggtccaaccacagatacatacgctactctgcccaagattctacttgggttaattggtttgggaatattatt

SEQ ID NO: 30688 - DNA, 2311 bp, Oryza sativa
  unsure (1)..(2311): unsure at all n locations
cccccccccccaaaaaaaaaaaatcattctatgcttttgcacactatgaacgatcccttgacacttgcatcggcgtaattatactatttcttgcagaaataaaaggataaccgtaaggtctgtagtttacacaaacgagtggttattttttgacaggtcacacggtccattggcgatgatgatcttaagccagcagtcacagcacaacctgaggttatagaaaccattttatcacctgatgatgagttcctggtatgtccattttgtttctctcatctgtgcggtttctttcattctcatacatcaatttgttatatcttagaataccaaagctaacaccagtgtggcataaaaattattatgtcattattgttcgatcgctgttaatctgttcagttgaatgattggcatcagcttcggaagtttggctgtgaatgcttgtcttatttcagccaagcaatacctttatttctcccttgtagaacactgagcaattactgccaccaaaatatagtagtaaatccaagcctatgtatgaaaattcttaagttctgagaaatagaccaatggcccttttctttattttgctttcatatcttataatgatatcagagatccagtattatttacttctccaaaatttctattatctgcattgaatgggcaaattactttttctaattatttgttagggaagtaactaaactacgtttctttgagaaacccctcaacatgcctggctctgcttggctgcaatgaaactctttcaacgttattgggcattatgcttctaatatgtatatttgtgttgttcctaatttaatgtaaacaccaccattcaaaaaagagaggtcattgcaaagtttcgacttcatacataatactctagagatgaacctcaaaacagggtatctagttttggtgcttctgcgaacacccaagagatgcactgaaacatggcatcaaagataagaaacctcattatagattcacaccacttcatttggttacctgtaggtgatggcaagtgatggattgtgggacgtgatgagcaacgaggatgtcctgtccatcatcaaggacacagtaaaagagcctggatgtgctccaagcggctgnccacgaagcccgcagcgcgtgcagcaaaggacaacatcactgtcatcgttgtgttccttcgccccgtctccactgctgagcgaatatactaaccacaaagccttgttggtaacttcatcatttgtcagaatttttagatactattatcaccactgtaaaggaaagaagccaccgattcgttcttgtacacaaattggatttgctgattaccctgtctagggcagaaagatgattaatctttctgataggagatatagcattctttcattggtcaatgtttatgcaactctgattcatctcatttgtgcaccttccaggccaaaagaacaaaacatatttattcaatacttatctcaataaaattttgtggaattgtcgatggtccaactttaaatgtttcccccatatttattcaatacttatctcaataaaattttgtgaaattgtcgatggtccaagtttaaatgtttccagttcctcgtatcaacacctgctagaaatcgttgaatgattcatacaggtaccgaaattttgttcgtcaaatacggataatccggaggcaacctgtcgttgccaagccgtgaggcacgtgaaaaataattattggtcccaagtgcacttatcttaataaatacagtaactgtcacgagatatctcatgcattcatgcaaggtcaaataacccgacttaaaatattttttttctatcattgtcttcacattaatgttgtgtacaaaccacaatcgtggattaagtctacgcaacaatgatgctgtacacttaaggaacctggtacctatattcaaatataaaaacttgatcacattacagcgaagctgacctgttacctgtacaacaaacgatcactccatctcaaaaaaatagaaaaagatcacttgcctagttgtgccgctgtgtacgaataggagaaatcatgaatcagctatctttcttacagaaacttgaactaaatcggataaccacggcacttgttatatcttcagaaatttctgataacctcaatctggtgccaaacagagatatcaacatcaggtcaactttctcctctgaattcaagcttcctggttgtaatttcgtccaattaaggcaatgtagctgacatttggatgaagaaagcaactgaattgatcaaggaccagttgcaatttaatattatcaactgctctgtact

SEQ ID NO: 30689 - DNA, 3740 bp, Oryza sativa
cgctcatcaagaacatagagagtgacaaatagaagggcatgtactccacgctcttcgtcctgatcaccagattctgttgaagacaaaaaatgcataaaagaaaaggatcaatacactgttgctaagaatatttcaagaacatgaaaagattagtcaaggctaactgtatcaaaatgcacaatgtttacttgaaactacaatttattgtggattataaaaactaagaagtgcaattcattagaactcacaatgatggacaagggggacgcaaacatgaatatgagggacgcaacgctgaggtaaccgacgaacaattgccgtgtttggtgatcaaacaacgccagactaacatacacaattagagcgaacacgccgaacaccataaccagcaggctggacaccttcacctgcagcaacacaccatttcgttagagaacttttatggtacaatatactactagtataatactgtcagtataaatgatataattgtgtagattgatttgatcttatactcaattcaatttcaattgcagtataaaatttgaaagggtaaatttgtctcctttttttttcgttattctatcgtcaaacagtgttgccgctaagtgtgtcatcatcaaatggcgctcaggacagtcctccactaataaacgaggagatctaggaccgggtacttacaattagattaaatccgaaccacaaattactaaaacatctttttcaattttctatcaaattcctaacatatgcacttctttacactgccagtatatactgataatataattgtaatggaaaaaaaagaagaagtcaatggtcagaagagcatatgctgggaatctgatgaaggtggcaggtaaggtaaggtaagttaagttaccctgttcttggcgtcggcgaatgcgatgaaggtggcggtgtaggcgagctggaagagggcgccgatggagttgacggtggcgacgaggacgacgccgtaggagacgaaggggaggccgtaccagagacagatgaggcagttgagtagcgagtaaatgtacggcatcgccgagaactgctccgtcgatccgttccggacgatcctcttgaacgtcggcctgaaatcaaatccaacaacagccattctcagttgtcggcattattgcagcgatccgaccaatccggaccaagaaatcagaagatcacaagtggggggaaatcagagaggggccgggggcttacagcggggagatgaagagcacaagagcgaagatgttccctgcagtaatgggtgacagacagcaaacatgaatcaaataggcacaatcaactgccaagaacatctgaaacctctccccaatccaaccaagattaccaagaagcaagaaaggaaagagcatcgaagcaccccaaaaatgggaagagagagatagagagaatgggaagaagacgaagaagaagcaatggtagtacctgcaatcccagcgccatagcaccagacgtcgtggaagggggagccggtgctggtggccgccaccgataaaccgagagcgttcatcatcaaggaagctagaaacaagaaagccggcggcggcggcggctcggcggtgggaggctttggcccttgggggagggaggaatccgtaatccggggtttctttctctctctagctgtatctttggttgctggtttgggcggctggctatggctgccgtcgtacgtgtcccgtccgcaagatataaccatgcggcggttcggtggatatgtcgccgtgaacagtggcggagccaggattagaaagttgggtattcccgtctaacaaaaaaattcataagaaaaaaaatcaatggttcacagtatgtcaataccgaatatctaagaaataaaattacaaattattacatggtatctctaattttctatttcggttccttcgtggcttggaagagtagctttaattctgcgttccttcatggcttgaaagcggtttataatatcacactccttgactttcaaaaacatctcacgctcaataaatgtgaccaagcaatcattcaagtattgatcccccatcctgtttctcaatttattcttcacataattcatggcagaaaatattctttcaacactagctgttgctactggaagtaccagaaccaatttgagaagcttggaaataatctcatgtctattgtgcaattttgtttcaacaatcataatggaaagattagcaagattttttacttttctaaacctttcatctatacgcatctcagtgaggaagagcttcaatgctgatggaagatggttcatctctgtgcttgagaaatcattaggataaaaccgtgcaagcttaatcaacttatctttgtcccaactagcaaagttatctataggactaaatgcagccatacaaaggagcaaatctgtgtttacctcatcaaaccgttcattaagctcttgtagttgtctatcaatgacacttagaaacatgtcaacatggaagcgatgcatattcttgattttaataaagaacctcctatctcttccaaccggccgatagaaagagtccatatcagggatcttgatcttatgcttcacacaaaaagattgcacttcttgaagaaaatcatcccatccaggatcctcgcgtaattgctgcaattgaaactttgtcaataaaatcagtcctactgcattaacaatgtcttgatccctcttctgcaaagcatgattcaagtcagatgtgaacccaagtactgtttgcatcaagtgtgccataaaaacaaactcaaatgattggaatattgtcaacactgtttgtgcatttgcacattctgcaccaaaagagcgatccttgccaaccattataagaactttttgaattgaaggatacaaagataggacatgcataacagttttatagtgagatccccaacgagtatctgctggcctgcccaaacccatttcttgattcaaaccctttccagtttcaatgtcacccaaatctagttcttctacaattctttgagcttgtgcaactctaagcatttctgtcttcttacaagaattcccaagaagatttaacaaaaatctaagttgctcaaagaaccacacacaatctgggttttctttagcaacagccacaagtgttaattggagttgatgtgcaaagcaatggacataataggcagaagggcactcatccataatcaatttctttagtccattagcatgacccttcatgttactagcaccgtcatagccttgcccacggaccttagacaagctcaaggaatgctccataagcaatgattcaattgcagctttaagtgtcaaggaagtagtattttcaacatgaacaacaccaaggaacctctcaactacccttccttttttatcaacatatctcaaacaaagagccaactgttctttttggtacacatcactagattcatcggcaagtattgcaaaatattcatcaccaaggtcttccatgataagcttagtagtttctttggcacaacaattagctatctgtttttgtatttcgggagcagtcaacttacaattctttggagcattattcaaaaccaccttaccaacttcttcaaagttttctgctagcatactcaacatctcaagaaatttcctttattaagtgacttttcactttcataatgtccacgggcagccaaaccttgcattaaaagaaacttcaagcacttcattgaataggttaaacgagccatatatc

SEQ ID NO: 30690 - DNA, 1233 bp, Oryza sativa
tttggaatcctttttttcatgtgccaattcctaaatcccctatttacaaatgcatctccaccagaattattaattttatgcttggataagtaccaaataaaccagaatgcagcatcttgttccacactatattcaagccatttaaattcgtcataccaactaggaaggaagcgccgaggcttacctccaattttccttataggaaaattgtggctgcgtggttggcatggccctaatgcaatatatccccttatcacagaattccgttcattgacatcataatttttgattgcaattcgccttccaggatcatgacaaagtaaatcaatgtcataaatagcttcatcacttgagtcatactctgtctcttcatcatcaccatctctgatgggagaccaatctctgataggagaccaagtggaaggttgctcctgctgtgtcactgctgttgctatgtctggatcattgctagctacctctgtttcaggttctgtcacatctcttgctgcatcactggctgctacctcaggcacaacctcaactgcagtaatctgaatctgaactggactctcatttgcatctgtaatcggctgaacagaaggaacagcaacttcactgtcaattctaactggctgtgttgttgatccagaaccagaacctaaccctaccttcctagactttgaatgtctatcccacaaagtcttcaaatcaatcgatttcttcttcattttgagagttcttcaatctacagaactacaaaagtacaggaaaaagaaactactcagagactaaggtaaaaaaacatcagacatggacacatagtgagtggatttaggactgattgaatcttgaactcttgatttgtcacctgaaattgcgcctgccgcagtgccgctgggcgctgtcccgctgagctgcagctgttggccggccgtcgccgcgcccctgcccctcggcctcgtggcctcgctcccgccgtcaccggtcgcccgtcggttgccgtctcgcggcctcgccgcgccgccgccgaatgcctcgccacggcgtcgcgccgctgccgaatgcctcgccgcgccaccgctggtctagctccctgctcccgtcgccggtcgccggacgccttgccgttccgttggtcgccgcgccgccgtgccgccgccgaacgccgccacctagggtttggaatcaaatggggaattgggaagcgggagagcagcgcatttgcgcgtgagg

SEQ ID NO: 30691 - DNA, 17222 bp, Oryza sativa
ggtattcctgggaatacataggcatcactgtagctccgcccctggccgtgaaatcgggggagattttctttttggttttttgtcgaggataaatcctcgcgtttttctcttttaatttccctcgtgtcatgtatagtagtactccaccaggacgaacgatacgatagtagtagtacgattacgcgtatccggtcggtctcatccggagagcggatgcgtgggcggcgcccgggatgagagtcccgcgcacatgcgtactgtacatgtaactacgacttgttgtctgtctcctgctgctacgtgggtctcgtctctctctcccccgtcttgatgtggatctgccagctacttcttccgtggtttactgcttcctcttgtgctacttcttctcctccctcgaccttgtgcactggcgattggtgatggaaggcaagaaactatagcgcgtggtaaaccgtaaacactccataaaattcctgttttatggcaccattcaggcaatatttattcctttcatcctaaaacacggctatttaatattggcaaattttgttacaggacatcgcaattgtgtggttttagctcagagacaccgcgaaagtgaagacatcccatgatcgtggatatttgccgatagacaccgcgccgtctgccatgctgacgtgtcgacggaggccgtttttttgacgcggtcgaacgtaaatacccctgtgcaagagataataaggttacgtggagaccacttgacaatgtctccctcctcttctttttcttctctctcgatttcttctcctctcgatctctcctcctcatctctctccctctcgtttcccttaatccccacgtgcgtgcgcgcccgagcgggatgtggcaggcgcatgacggcgcggccagcgaccggccgcagtggctcgggccgaggcgacggtggcagcctgaaggcggcccggcggcgtcgggtggatggggaggcagcgtggcggacggcgacagcgtcgggcaacgccggcggcgaacgagccgccgagcaaggccatgggccacgccgccgtgacgaaggcggacacgggcggcacgtcgcggagtgcgcgccagacggtgctgttgcacttgaagcctgagccgaagctgatctgccagacgcggtggccgcggtagacgcgccccttggcctcggcgtaggcgagcttatatcaaagcgagctgctgctggtgttaattgcacattaggctcaacatcccgacctctctctttgatttcctgcatcaatcaagctaagcttggttaattaattaactcacagattattgtatatcactcattattgtttgttctagatcgatcacttttgtgcgtgcggttacctcgatggtggaagcaagagcaatggcagtaggcggcggcggcgtgagccagatgcagccgtcgtcttcgctccaccactcggctaccgcctgaggcagcagctccacttccgccggcaggcattgggtggatggggagaaaaggccggcgcagcgaggaggtgccggggcagcgccgggcagaggaggccgaggtggaggcgttgggtggtcccggaggcggcgcccgtgcgggccggcgctcgcagtgtggttgtggtctcgagcaagacgaagacggcggtggtcgcggtggcgattcgttcggccgagatggaggccggaggtgctgacagtcgtggtggcgaaatggcagtggcgcgggggtggtgctcgcgcgggagatgtggccgcgcgtggtggcagcggccgagcggacggcttggcgcggcggccgagagggaaaagtggtagctggccccggtggggagtggcctgacgggaggccttttttttctgacgtggcacaagggtatttacgtccgaccacgtcaaaaaaacagactcccgtccgccacgtcagcacgacaagtatcctttagacggcgcggtgttcatcggcaaatatccacgattataggatgtcttccgccaaaactttactttcgcggtgtccttgagctaaaaccacatgattgcgatgtcccgtagcaaaatttgcctttaatattaggctgagttctttttccaactttttttaactcatcttactcatgttccgtgtgcacgcttttcaaactagtaaataatgtgttttttataaaaagtttctatacaaaagttgcttaaaaaattatattaatcaatttttttaaacaaataactaatacttaattaatcactcgctaatagaccattacgtttttcgtgcactacaaatgtgtttccaaccagtggcggatccagaaaatcgattcgttggtgtcataacgtgtctatcggtgtcatagcatgctaattatgtttatatcatagtgttataacatatggataagtaatttcattatagattttgctgaaagtcgtcggtgtcgcctgacagcggccattctactgtagatctgcccctgtttcctaacctgggaaacgaacacaaccttaggcataatgtgtattactactacgaaaaggagtttggacaaaaactcttatgaaaaaaaatgaacatattcgactacttgatacagtcatagagcagtatagtcaggaaattcattgttattaaatacataagtcattctacatattaattagctgcattgaaaaaaagtaggaaaaagtacacgcaaggtccctcaacttgttagtgccacgccccgaactagtcccgaccggaactagcccgtgacgctccaaattaacctgttaatcgataccagtcccaggaaacagtgctggtatcacaggaagacagagtatcacagcaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttctttagcaactgggggggaattatttatatagagcaagggtgagtacaggagtactcagcaagccatggaaaataagtgtttaatgcagacttcaaggaaaggctgttgtttttgcaattgattttatttaaactcttttctgaaacaactaagtgagtgcttctcaaacgacacggatgagacaatgcgtctcgttcggtcggagtatgtgcaatgtatcagtcttttgaatcgatctaggttggcacccggccaacaactttcaaacggccacccgggcctggctgatcccatcagccgcagattttccaaacatcaatcccaaaccacatccgcaaatttcacaaagcagtagtcaaacaaaactgcgctaggaatcacctcacatccgccatgaccgtgggcacggctgttcgaacagtttaataacctctgcagagggggtacactttacccagacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggataaaatttcaaggaaacggtccttaagtgcaagagcgggaaaccgtacacccggtacgttccctggtccgcggttttggagattcatttagttcgcaagcaccaacccaggtgtcgggttttccaagtcttttgtaaaacccaagttttacccaagatgtttctcagattttaagtttgaaggcgaccatcgatacccgtgcagagtgcacgaataccgaggcgcaactaggtgggtacaagggaacatggtataacaattacaaaggaaggatcagatgcaacaagttaggtgggtccgccaatctgccttgcagacgggacaagcagattaagtgcgatcctatcgatgcataatatttttcaagcaacataattaagttcaaatataggctcaagatgttcaaaggtggcttgcctcgctcgagatcttgagcttgatcttcgaaatcctcgcactgcgggtcttcgggctccgaaactacacgcgaaacgggacaactcagcaaacggcgaaaataaagccttattattgacctctaagcatgccattagatagatctcgagatttgaggaattttggaagttgaacggagtcaaacggacttacggttgggaagatattgaatttctaagattattggatttttggtcaaaaggaaaaggatttatttaaatcctttttgaaaaagaaaagaaaagaaaagaaggagggagggaaattagacttccctcgggcggctagggcgcggcccgagagaatggggcggctcggcgagaagtggcagcgagggcggagggcgctcggctcggcgcggctcacgcgcacgcgtgcgcagctcacgggcagagcggggggagagggagagagagagggagagagagagagagagccggggagggagggggagatgggccgagaggagttcggcctatcgaacccaagggaggcaaaatagacttttgcggagggatttgatttgggaaggatttggattcgggattgaactcgatgatagatcggggatttgagatctgagatggcacggacactagacaacaagcaaagaaacggatttcgcaaatagggtttttaagagatagtttttcccgctaggcgccacgacagaacgggcgctacagaccaccccccctaacaagaatctcgaccccgagattcagcacctatgggagtagctccgggaactcggtgcagagaagatcttctcgttcccaggttgcctcatcttcagaatgattgctccattggaccttgtagaacttgatagtcttccttcgggtctgacgttctgcctcttcaagaaccttgatcggcctttccttgtaggtcagattcttttccagctcgatattacccaggggaacttgttcttctggaactcgaagacatttctttaactgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctcctttttcgaactcaaggtcacgcctccgattgtcagcgtaattcttctgacggttctgcgctgtctttaaacgttctcggatcagcttaacttgttcttctgctgccttgagcatgtcaggaccgaataccagcgcttcgcccacctcagtccagcacaagggagtgcggcactttctaccgaacattgcctcattcggcgacacctgaatgctggcctgataactgttgttgtatgagaactcagcatacggcaaacaacgatcccaagtgccttcgaaatccagggcacacgcacgtagcatgtcttctaggatttggtttaccctttctgtctgaccatcggtctgcggatggtaagctgtactaaaatttagatcggttccgagagcttcatgcaactgcttctagaaccttgaggtgaactgagtgcctcggtctgacacaatcttcttgggacagccaaatctacatacgacatgggtcatgtagagttctgctagtttctttccatcaaaggtggttttcactggcacgaaatgagctgatttcgtgagtcgatccacgattacccagatggagtcgtacccgctaggattaaattttttatagcccgttcaataggattaaattcttctagtctttaataggattatcttaatttgtattaaattcttgctttaacacgtcgatcatattttgttgaaaatcatcatatttccatctttttatattatgtgttttctatgtaagtctaattatttaagatatctaatctcaaaaaaaatatttaagatatctaatatttttaaaatactgattatttagtctcatattcaacttaaacaagccatgatccatgtcgaaacaagatttcgacaataataaaagggggtggctatcaagctaggaaagtggatgggtttgtagacaaggaattttatacaggttcaggccttcttattcaagaagtaataccctactcctgtccggggatgattccgccgagtgtgttattgattgtatgattgggagaaaaaagaatcgtgccccaagaggcacacgtaccctccttatataggggaagggatccgtaatacaaggtacagtctatatcctaacggaatatgggattacagataaaatacaatcgtaaccgactaggatcccaggtactttcttgacatacaagtttagaatctaacccgagtcctcataaagatattctatctatatttggtactgtatatccagctggaatataaccgccatgtagatatgggataaccatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatctccacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaatcaaggccgtgaaccctcacgaacctgccttaacccaaggcctacgatgattcagaccgaactggcaacccgaccctgggtcctagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcctgagcttaatccttatagtggccggggtgctacttcccacaactggcatgcacccaaaccccaccaaaaaacaggttttaggggctttgaaagaggaagagagggatatgtccaattccaccataagccaaccattccatagtgtccagatgatatgagaattcccaaagtctaaagttatataaccacctaatgttgcctaattaaccagcgaagcatctgtcgcgtcccaaatcgactctaaaatacatcctcgaaattgtgcaaagaataattaaaattcatgtgaaagcctccaacaattaaaatgtgcaaatgtaaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaaccctaaaagaagtcttctttccccccttttccttcttgggccggctcggcccacttctctccctccctctctctcttctcccctccggcccatcggctcctccccgagcgcgcgccgctgacaggcgggcccgcccgccaccctcgctgacgggtggggcccacctgtcatccccaaccccgcgccgcgcccgccgccgcccgtgccctagcgccgccgccgccgccgaatccgccgcatcccgccttccccgcgcgccataaagaggggcgaattactccccgtgattccctctcccgattccccctcttttccctctctctctccctcggattcgtccgatttgaatcccgaaatcctcgccggcgccatcaatggagcccgagaactccgcgcccgtttcctccctctccggccaccctctcctcctcccggtgctatttaaacgtcccccgtgctcttctcctccgtttccgccactcgccgctcactctccccgtcggaatcgagcccgcaccatcgcaccttctctccgccgtcgccgccgtgctccggttcgccaccgccgtcgctccggacttcctccccactcggcgtcacctccttcggcttcgccgcgttcccgtcgacctcgtccgcgcctccgtttcgctcgccgaccgccggagcaccgtcgtcctcgccgtcccgaaccgcgccgccgccttcttccgcttcgaccgccgttcccgtcgtcgccgtcgaccggggtgagccgaagaccgttcctttcgcttcccccttccctcctctctctcgggtgccgctccgccgcgccggtggtcgccggcggtgaccatcggggcgcgggcgtgtccccctcccgtcggccgtgccggcgaggctgccttcgggcgcgccctcgcggctgccaggtgggacccggccgtcagccgcccgcgccagcgggtgcagctgacgcgtgggacccacggcgccggccgccgccagccgcgtgctcccggtccaccgtggaccgagaggctgacgcgtgggccccactcccgtggacccggtccgcgcgccctctccctcggctgacgcaataaatgagttttttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactatggaattgttggattattgtggaattggcttcacaccgccccctctattcaaaatccccaaaagtggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattgaagatggatgaagtcgggggtcgatggacattctccagggcaaatgaaggctacacgagctgcggcccggtagtcgagatgtcatatggcagagggttggtgccctgctgctaggggctcagtctcgcctgcctgtcccgggggttccggccgtaggcgggattgggtcggtactcttgtctatggctaggatgggttggaaactatgtcacgtcttccgtccgtatatcgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaagatcgtgtttataaaatagccctgagcaactaaatgtctttaaatgctgtttactgcaaccctaacccctctatgttataattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccgcccttgaccctaggacgagccgtagatcccaagccttagcaatattttcaaaaataaaaaaaaaatcctttgttatttgtgaaaactgtctagtctctctctgtcttgctgcttcacttatcatcaaaatctgacctttaaaatgttgtttctctttttgtttttgtttgtagatggccggcagcgtcacccgtcgtggtttggacatgactggcttcgttttggagctgcgaggcatgtgcgtggtcctggggtatccacacggagaggactaccaggccaggccgcttccggatcaggagggagatgacgcggagccccacgctgggtgggaggtcaccgcagtgatcctctctggctcccccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcccgcgactacgccaccttctgggatgctagctcggaggatgacgctaccatcgtgcacctggcacgcatggtggaggcgtacgacgcggctcgtatcgacttccatcagatggtacgccgcgggatggtcgagaacaacatgaagatcctggagctgcgtcaggagaacctgcagctcaagaaggacctcgacgcagtggaggcgcagctgcaccagctcaaggtcgcccagggagagatctgccgccccaagcgtcgccgtgtttgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgttctttctcgtttgtcttttttggagtcgtgtggggcatggttatgccggtgtgtggcacaactatgtcggagcctgtcttattttatttgcctaagcaacttgaacattaatgaaccaatttaatagcagtaataaatttaagaataatggtagtcgtgggtggttagttttaattgttagctctctctctgcttgctggctctgtgtggggttttcagatggtgacgaccaggagaaatgctgttaccggtgatggcaaccaacccgaaggcagcaaccccaaccaccagggcaacccacctccacctcctcctccgcctccaccaccaccaccagacaccaacgccattctcacccaaatcctcgcccagcaagccaacatgatgaatgctttcctccaccacctccaaaatccgccacaacagaatgctccaccaccacccccacaacactctaaactcgccgagttcctccgcatccgcccacctaccttctccagctccaacaaccccgtggatgctttggattggttgcatgccgtggggaaaaagctagacacggtgcagtgcagcgatgaggagaaagtcgtcttcgccgcccatcagctgcagggacctgcatctctatggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatggagtatttgcatgagttcaacaacctggcccgttacgctccggaggatgtgcgggaagatgaggagaagcaagagaagttcttggcaggaatggaccctgagctgtccgtccgtctagtctctggggactatccggattttcaacgactggtggacaagagcatccgcttggaagccaagcacaaggagctggaatcgcacaagcgccgcttggcgaatttccgcaatcaacagggtgctaaccaaagggttcgctacaccaatccctatccagggggatcctcctcgcagcagcagcaacagcagcagcaacctcgcccagcgccccgacctcaattcgtggtgcgcgtcccacagccgcagcagcagcagaatcagcaagggactcgtgcgccccgtcctcctacgccaactgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagttttatagccctgccgtccctatagaaattcaggggattccttttccctcggatctgattctgctagacaccaagaacttggatgtgattcttgggatgaattggttggcacaattccaaggagtagtggattgcgcgagacgcactgttactctgtaccgagggccggaacaaccggttgttttctttgcacccccaacctctgttagaagttcagaacttcatcagatagaactgtcagaaattcccatcgtcagagagttcggagacgtgtttccggaagaactacctggtatgccgcccaagcgagagattgagttccgaatagatcttgctccaggaactactcctctgcacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatttgttcgatcagcttaaaggtgccactgtattctccaagattgatctccgttccggatatcaccaattacgtattcgtgaagaagatattccgaagaccgcattcaccacgcgatacgggctgtatgaattcacggtgatgtcgttcggtttgaccaatgcacctgccttcttcatgaacttaatgaataaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagttacccaagtccgcagtttcttaggtttggcaggatactatcggagattcatcgagaacttctccaaaatcgctcgacccatgacacagttgttgaagaaagaagagaaatttgtgtccagcccgcaatgcgagaaggcgttccaaactctcaaggaaaagctggtttcctcgccggtgttaatcttgccggatactcgcaaggacttcatggtgtattgtgatgcttcgcgccaaggattggggtgcgtgctcatgcaggacggtcatgtggtagcctatgcctcacgccagctacgtcctcatgaaggcaactaccctacacatgatttggagttagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggactatgatgtgggaattcactatcatcctggtaaggccaacgtggttgccgacgctctaagtcgaaagggccattgcaacactcttaacgtccgtggcattccacccgaacttagtcaacagatggaagccctgaacctaaacatagttggtcgtggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagataaccgagaacttaaacagctgatacttcaggaagctcacgaaagtccttattccatccaccctggcagtacaaagatgtacttagatttgaaggagaaatactggtgggttagcatgaagcgggaaattgcagagtttgtggccctgtgtgatgtgtgccagcgtgtcaaggcagagcaccaacgaccggccggacttctccaaccactccaagtacctgaatggaaatgggatgaaattgggatggatttcatcaccggacttccaaaaacccaaggcggatatgattctatatgggtagttgtggatcgattaaccaaggtggctcgatttattcttgtgaagaccacctatggagggaacaaactagcggagctctacttcgctaggatcgtgagtctccacggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcaaattctagaagatatgctccgcgcatgtgtactagatttcgggaagacctgggataagagtctcccctatgccgagttctcctacaataacagctatcaatccagcatacaaatggcaccatatgaagcgttgtacgggcgcaaatgccggacaccgctcctgtgggaccaagttggggaaagccaagtgttcgggactgatatcctgagagaagctgaagctaaagtcagaatcattcgggataatctaaaggtggcacagtcacggcagaaaagttatgcagataaccgtcgccgtgacctggaattcgcagtggatgattttgtgtatcttcgagtcacgccattgcgaggtgtccacaggtttcagacgaaagggaagcttgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccagcagaccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaatacatcctcgaaattgtgcaaagaataattaaaattcatgtgaaagcctccaacaattaaaatgtgcaaatgtaaaagtcaaatgaggcttggaggatttttgcatatttcctaaaaggctaaaatgcgtaaataaattttagtggaattttcagagcacaaataataattgaaaagaaataaacaaagtggaaaaggtttataaaaagaaaaaccctaaaagaagtcttctttcccccccttttccttcttgggcc

SEQ ID NO: 30692 - DNA, 499 bp, Oryza sativa
cggcgcggaggaaagagaagggcgacggcgggaacgcgcctccggcggtcaccgcgcgaaacggagggcaggccggggtgaagaaggtggcggcgacgttgaagaggcgacggcgcggccggccggcgcacggtcgaggcggcacaggcggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggccggacttggcgcgtccgttcccggggattgaaggcacgaatcaagggggaatttgggggcaattgaagaggattcaatggggattaaaaccccccaattaattttggaattggccaattgaatcaagcggatttggaggagggagcgagctag

SEQ ID NO: 30693 - DNA, 395 bp, Oryza sativa
  unsure (1)..(395): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcntacaattgatgttcccgcaactttcccaacaccagacgaagatggtgctgatggtcttcctctgattgtgagtatatcagaatgtcatcaatgaaaaccacaacaaacttatccaagtattccatgaacactttgttcatcaagttcatgaagaaggcaggtgcattggtcaaaccgaacgacatcaccgagaattcatacagcccgtatcgcgtggtgaatgcggtcttcggaatatcttcttcacgaatacgtaattggtgat

SEQ ID NO: 30694 - DNA, 505 bp, Oryza sativa
cacaaaacattaacaaatctctgtggaagttcaaggcagccctcaaagttaagattttttacttttgtaattacaccagggtgtagcgtaaacgaaggacaacttagcggaacgtaatttgcaaggatgcaggaaaaagctggttttatcatataaatcagacaactaagaatatctttcactggtggagaagtgctttttagtcccggttcgtaacccccctgtagtcccggttttcaaaccgggactaccaatccgggactaaagatcgttatctttagtccaggttcaaatacccgggactaaagatggtgttaccaaccgggactaaagaaaagggatctttagttccggttggtaacaccaaccgagaccaaagagaggtagcggcggtgagatggtccttttctttttttttcttttttattttctctcgaatcaagtgggatacatatcccaaatcaaaccccaaatacccaaatcaaatcccaaaccaaagtaacat

SEQ ID NO: 30695 - DNA, 5869 bp, Oryza sativa
  unsure (1)..(5869): unsure at all n locations
atggggagagttaataatgattttaatcctttagtcctcttggggacggttgctactaccagttggtctttatggctaagcaggaacaatgtgatttttttaaagaagaaagtctcgtctcctttgcaggttatttatttagttgtgattagctggctccatttacggtctattctccaaaagctgagttaataggatttggttgttgtggctaattattaacatttggaccaagtgatcagggagttttgattataaaaagtaatctagtctaaaaagtgatagtcattagcgtatatgttttgtttataaaatattacgcaggctgtgtgcaaccttgctacgccaggactgatttcaggatggttgtattatcttgaaataagacgatttcattaaaagcttcctttaacaaaaaaaaaggctaaccatgatacaaataggagtggtcaacttggattttgtgtttggaaacaagaataactaacccattattatctagaccaataaattaataatttccatgccttcgattgatttttacttgatctgaaaaaggcacaaaattatatggcatgcagatcattttatagtagactgggaaacctacaagagatctgatcaatgataaaatttgccacttgtaatgtcaactcatctttataattgcactctaaagattggtacaattggcaaggtggtggtggacttcgatagtctgattcctagaactcgaggcccttagagttcacatactcaagatggaggaagagtcaaggattgaggtgttgaaccatctattggagaccatggcgctacgacggtggtgtaactggaggtggggctatgaaaatcatcgggcggtggggaatcagtgaccatgcactgcaggaggattggagtaatggaggaagaagaatgatggttattttattcttaattttttttactagaaaaatatacatgcatgcatgctacgtcagtgcaaaaccacctcaaaccattcttgggctgtttaatttctatctgggttggatacttgataagtgtttctaacccatttttggagttgaataatgaaatctatactttagcaacactagagggtgaaaagtagaccttttcctgtataaaatctacatatatgtgaagtttttagtactaggggttaatctttcttaaacgcggggacaatgttttatatattgtagctccatcatattaaattgctatttttgctacccactaccaccctcacctagggtgtcactttactacctctatccacactcgacttgagaataaagcaatctagaccttacatttgcatctaatggctgaaattatttgaatgacattggaacaattatgcgtcaattgacataatgaaaatgaagttgtatccaatttccgtcatctaagtgaggcctcacactacatcaatctgctgagactatatatgtaccaaatggttacaattgttaactgatctcatattatgaaactgataccctctcatcaagccacttaatgatgtccaaaaatacaatgtcaatgttgcttgcgggctcaccagatgtcagggcgtgacacatccctgggtacagtttcagtgttttgtccttgctctgagctgatgtatacagttcttcacttactgatggatctgtgacggcatcatcaccaccatggacaatgatgaatggtagtgtaacctgcatacattgttgtatattgtagatattttattgaaaagtacttttgacacttgaaagtacggacttatatgttaggcatactcatgtcaaataaacacactcaaaacaatatttttacggacctgacaaagctattttcacaaactcatgtcctactaaaagaattttgctcatggtgattggtgactttcaagcagtatcaacaatctactatacgcaaaccagaccaaattgtaactcatccaggacgtgtacatgtaggaatataattgaatttagttaatgggatggttcctaggtattctgataaatcaacatgaaccaatatattgtagaaccacaccgtaccttgtcaagagtgctttcaatatccaagcttgccataaaaagttcataaccagtctttaacctaggccttcctttatagcaatatggattgtttcttacctgaaagacataacaaaattactgaaaacacaaaaaataaatatgcatacagttcaggtgattccttatcatagagaaaaggtgtctccattatgttccatctttcattagttgaatacacctttcatgtatttttcctatacctcttgacgccactcctcgcttttaattgccttatcaatgacatcttcagtaggaataattttccatgtaggtatcacgttgctaagcttgcttaggattgttatcacaatgggacgaggcttcatatcttctacaatctgaatcgaagttaacatcaacaattatattacataatgatcaacttaatatcgtgtactaatacatatttccaacagtcaattcttgggaacatatcaagctgtgaaatatatcttcaaaatatgaataattaaaagaaatctttagcatttaaccttgcacatgggggcaaccaaaatagccccatcccaatttgtaggttccttcctatgtagcatcagcacaatagcgcctcccattgactcaccaagaaggaacttcttttttcctttgcactctcctctttctagaataaggtgtacacatagaaatatttacaatagaaatctttgtaaacatccaccaatcacatatactaatatagacaacaatttctataaaggtcatatgcaagtgtttacgcttcacaaatgcacaattaagggaccatcttcattattgcaatatgccaatggcctcaagaagtaaaaatatggaaacatggagtacattttacaagtactaaaagtaggaacaaagaaatgttagggttttttttctgctaaagggcaattgtaattgttagataattctaaagatatatcataaaaaacaatcttacatgggagcatcgttctggaaaaggaggcaaaaaatcatagaggataataatggaattgcttatagttttcagtgactcatatatatttgaaccaaatatattatgtgtacgtggttaaagcatgtggttacaaaaaagaaacaaaatatggtgataccaagtaaaattttattcaatatatatactatttggcagtgacaactgacaagtaatttgagataacattttgttgctaatttatatatatatgtttacattttttttgaaacaacatatgtctaaatttaattaaatccacttttataaatacattaattaaaatatacatgagcattgtagcatggttgattttctttctcaaaatacatattttgagtgaccaagcatttgagaaatcaaatactctctccattttttattataagtcgttttgacttttttcttaatcaaactttgttaagtttgaccaagtttataaagaaatatatcaaccattccaacataaacatattcaaaatatattaaatgttagttctgatgaaactaatttggtattgtagatattactacaatttcccacaaatttggacaaagttaaataaatttgactaagaaaaaaaatcaaaacaacacaatatgatatggatggagtacttagtgttctcttgtaattctacaatttacatgaacaaagaaccatatcatttttttgcgcacacaaattgtaatagatcttttttatgccttacaggatgaccgcagagtgatagagactaaacaatgatgcactcaaggactaattaatttttttacaacgatacactcaaggactaattaattttttttacaatgacacaatgtgcaattgtgaagtcatttcaaaattttaaaattcaaaaacaatttcaaccttggacaccatcaccatataagtgagagaaccaccggaaatgattccgcatctaagccgaggttgacaaaaagtgcaaggttttgatagcttatggttaaatagtgcattgtttttaagtttagtatgtctagttttacaactttatgaaacttcatcaggatagcaaaattatttgtttcctaaatcaaataatgagctagctagctagttgattaaattatgctgaacataccacaaacacttgcaaagtagttcgagcaatcaacaacaacatcatcaaaactattgatatagccttgagtccttcggacttcccatggccctgatagtccaatccgtgcactgtaaatccagcctttggcaaccgaacacctgttcctgagagtagcaaatcatcaacatattgtcattaaaatggtgttttcaagtagctaaaagaaactgaatgctaaacaagtacgacatggtattattatttttcaacatgacatataggcatactcttgtggattgtttatttaaagttgtttaacaacattgtgtgatttacctctcattgaaatgctgcattccatggcatatcctaaacattgaaagatatgaaattgtaattaaattagatggtgtaaggaaacaaattgcttatatgttggaataattgtatttgaagttcaaatgtataagagtatcaatagataatgttaccatggcataggaagattagagctttcggttcatggtctaaaggactccattggcatgcaaagagcttcatccctcgtttatttgtaacatattcctacaaccaacataaaatttgaatctcacatcccttgataaaaacaaaataaaatggtgatggtgtttttcaaaattctcttattcagcataatacaagatcgatatcaattgtaacacacaagatgtatcacaagaaaaaaatggcaactggaaacgaactaacctcatgatatttgaaaccatcatctgccattttctctcaatggaagaccatgggaacatatgtagttttatgcaactcagattaggaaatggccaaggaccaatatttttttaatagaacaatcgaagatcattagttactgaataaaaaggatagtttttcaatataatgagaagtcatctttgcgtggtgttccttttgtgcatgtgcaagatcttgaatgtgtggttgaggatgaaattaacctaagtttagtttacattaccttccatagtaaggtcatactaaatttggagcattggccatatacatttttttacaagaaagcattggccatattgaaggcatgtcatacaatcactagcattttcgcaagaatttatagttggaattctaagtaacaacagaggaagttgatggttgcatcccaaatggaacatcaaagaaacaatgcaagttgtatgcataattaccgttaactaattttgtatcaaattctaaattaatagaaaatatagtggcagatccagtattctataattgtcctaataaagtgtttcggattgacctagttacaataagttcttatagtcatcattcttcaagcatgatccaatacaccttttcacaggatagctaattacacctgtggcatcgatgggcccaagacttcccattgagtaacaatgttacaatgtggatgtaaaagtaggttggggcacaccttgaaccaaatacttccgagcaataacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30696 - DNA, 483 bp, Oryza sativa
cttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcctctctacccgcgggaagggtgaatgtctcgagcattgtggtccacagcatctctttcttcgaatctgggacaaagctctcatgatctctgcgtgcccttgttctttgccagtacaccgtactgacaggcacgttatcccgcacaacccaaccactgtgacatacatagttcttggcggcttctgccggggcactaggtcgtccatcttcttccacttccgttatgatgtgccgaccctcaagcttcttcgtggtacctcgttacccgcgtgccctcttctgtccaacggagggttgacttccactagccttct

SEQ ID NO: 30697 - DNA, 689 bp, Oryza sativa
acatatctttgttatcgttgcccggacattgtctggaaggataccccttattacaactggtagcagttgtgtcatcaacacgtgacagtcatgagactttaggtttgtgaacttcttttccttcgtgcttattattcgcttgatattcgtggggtatccagacggtacctttatgctctccaagcattcaaacatactttccttctctgccatactaagagtgtagctggctggactcaagtaatggcttcctttctcctttggttccggctgaaggtcgccgcgttcttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaattgggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggttagccttatgttcgaagtgcttgcctttcttccgtaccggatggtttgctacaaggaatcgacgatgacccatgtaaacaaccttcctacagtgct

SEQ ID NO: 30698 - DNA, 1528 bp, Oryza sativa
ttcttagcctcgtacgttgtctggggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtataacgaagttctgtggtcctctaacatcttgtccaatttatgggcccccttttcactttcgcagtcctccttggcatcctgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaataccttgctctccgtgggatgtccaacaattatagcttggcataaaccccgactcaaacaagtggaaatgaatagtcctggatgcagaatactccttctgattcttacacttattgcatggacaacaaataaaacccctttgcctattagcttcggccactctcaaaaaatagtgcacgccgtcaataaactctttggaccgccggtcagcgtacatccattgccgatccatctacatgagtcgaaaaaaatcgtacacaaataattattcttacaataatgacagtcatacaataattataagataattacaaactgtttcaacagtcatacaataatgacacatctttattcatacaaaaatcataaaatattacaccaaataattcttatttactatttctaaagttttaaactaattttaatgtgttttacttcttttaattttcattttagtttgttttctagtattcaagattaactttcactatagttttccttctcaactattttataaaaccttctttatcaaatcaactaaatttgtatatattctttctaacccacacaaattttctctctcatcaacttacaactaaattttagagacaaaaaagtgtgcaaaacataactgcaaatgtaatatgacaaaaaaaacattggaggatgaagttgcaacttttttaggcacctccgatttgtatgtaattaccaaaataaattcactagaaattttggcatgacctaccctcttttttgaagaaattttgaagcttgctcggcaagctgaagaagaaagaagacatatatatataggggtgggactttaattccggttggtgttaccaaccggggctaaagatccccgagatctaccaaccgggactaaagttacgatcactaaagatcccggggggcctgacaggccctgacagcatttgaaccgggactaaagatggtgaccaacccgggactaaagatcaaatatgcccattacccttttgaaccgggactaaaaatcatctttagcctcggtttttattgcatccgggactattgtggaatttgtccgaccgacgaaagatggtttctccaccagtggatcaaagactccaagtagcctagtataatatttag

SEQ ID NO: 30699 - DNA, 3961 bp, Oryza sativa
  unsure (1)..(3961): unsure at all n locations
gtaggcctcctctctcttttctggtcgaagccaaattcagggagatgggcctcacagcccacgttcacgtttattttcttctcaaattgtttttttttatctatatgtactaactttattttcttctcaaatccggcctctacaccaacaaggctgtacacaaacacaggaggtccttcagtacaagtttgaactttacccaagatcacaactgaaagggaacactaaggctctaacccgaaacaaaacaacaacgaagtgcatcgaccaaaggacatacacggctgcaaacaagaaaagccagcaaactatacccctcaattattttcctcatgttccaacccttagcaaagaagtgcacaacggtagtctccaacagtttgcaaccttctttcatcaagatgctttctccctcttttaataaaacagactactgtctcattcaatatattttcctgaaaatgacatttaattaacgaagttgatttttatgccattgagacaatgccatttctagagatccacatcgcccaacatatagctgcaatccaaataaagagatttagtattttagcctagattaatccaaacctttgaactaaactccaaacaagttagcaaccttatgaggcggtttgaaccagaaaggtaatgaaaatgacacatttgaaacacatctaaccacatatatggcaatcaatgaaaagatgttgtatcgtttcatcttgattacaaaagagcacccaacatcgtcgccattccatctccgttttgctaggttatcctttgttaaataccactagaggattttaatttttaacggaattctcagcttccaaaagtggattgatgataaaaatgggatcttcagttgactgcttcttgtttctcttgttgcatctggcgctccatcacatttggcttcttttatagtaacagagaagggaaggaccagaacagaaaaatgaaaaaaaaaagcattgcaatgttatactttgccataccttttatctaaaaactctggctacaaaacatcgcgtggttcgctgatgggccggtctgtgttgcttcagcgatcagcaccgcaagtaaataaagagagccgccggaatggctcaacgactgatacaacacgagctgcatgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaggtgatgatgaccacaccgcagtccgtggttgcaaccccacaggtgacttatctttgaggctgtgacgggtgcattatattcggcctgtcataggtatatcatctttgacggggtatagtatcaaagctgtcacagatgaggtcacctgtgatggattttgttatgacccatcagtgatgaggtgaaattcgaaaaaaaaaacaaattcagaatattagctagcctcaggatttactagccacgccctctgaaaaacagaaacatcacaaatatatgccaggcaccccaaatatcacatattccccattttagcacatatgcatcttaaaatttacatcattcacatatgcagttcaaatgccacatatttgcacaacacattcataccacattaaagccacaaacttgcacaatttcttgccttgcacatgaaaccgcaaacttaccaaagtttcttgtatcctattccttttgaacctccacaatgacctgtcattaaaaaaaaggagaaaacaattgaacggtacaaagtaattcgtagtagatcaatggaacactggagaaatcgtcggagcttcttgaagaagattgcgtggcttgagcggtgaaaatggaagtaacggtgtgaaattttttagggtggtggttgttatttgtaaacatgtgcttaatagtcgaaaggataacactagcaagttgcggactgaaagagataattccactgtgttatataacacatcggaattgggggagcatgtgttaacagtgaaatttggcaagatagactcggatttggagttggatatcgaaacggaatcaaaggagattgatttttgccaaaacagactacgcatcgacttgaaacagagtcggaatctggttgagccgatctggtgggaagccgatacagcctaacttgggctcggtttgggcctcaattgagataactatcattgccgtttagagatagatctcatctaaggcaattgtatctattaattaggatatttatcttggtttgggcctcaattgagataactcttttcttttactttccaacgagttcttgcttcaagtcggggtatcggctgcgatctctcgacaagtggtaacttgtcttgaaggcttgcgctatcggggctattatatcattttaatgtatcaatcattttattgtggtcatttttatcacatatcttagttaatatagtcttagtatctcaatttagtcatatcagttgattctcgttttagggtttttgtcggtattggcttaaatcgtcttactagattagattagctaaggttctaccatcccgaaaagttgttaactccttgattgttttgactttatgtttctctgcgtattttgtgatgcatcatccctagccgtgcttagaatcatagaaactaatccggagttaatcataattaaggatagtatcggagtttcagccgatcttacctaatatacatgacaatgcatgtttcatgatctgtttatgaatatttgccacttatatagatagattgatttatataaatgcatcaagttagattgatctctcttaaactttatatctggtgatcgattgttatttggtacgtttatatagattgatttctttatataagtctgtattagagtattagtcaatacattatttgtttttgctctaagtactggtctattggactattttttataatactggcttaaaatggatggcaaaaaccacaagagatggtattacaaccgttagggcatatttagggtttgcactttatctattcatctaaaagccacaaccgatttggtttaactgcatcggctgggtcctgacgatacgtcatcggctctatcggccgatcggctatcgntcatctaattatgttttctgttttatcttgctgcttgccgatctcctgcaaaagggcgtgatcgatagtcactcggttcatcctttttgcgcccaggagcttgaaacgacgaaccatatcctcctacactgtgtgttcatacgtcaagtctggcgcctcgtcctgtcttctggctggcgttggctcgccccttcccatggctgctctctttaggtctggtggccgtcttctagggcctgtctaccaaagtgtcttcgcaagggctttgacactctggtcctcctggtatcctggcagctgtggaaggagcggaaagccagtgtttttgattcgtccctttcgccggtctcggtggttctggagtccatcctttagaagaatcgtctttggtctcttgctagtgccgcttcatttggggacctgttgggaacatagggcagcagttactccaccacctctctccctctttataggagcagcattttcagcttgtttttcctcccttcgcggtcctttaccttgcatgcggcaagggtctatctgatttattgcgttgtgaaactaaaactctattttcttctaatatactgacgcatagtatttttgtgcattcatgaaaagaaatctgtttt

SEQ ID NO: 30700 - DNA, 244 bp, Oryza sativa
caatcgtttgacgcttgcgatgccttggctttgcttctaccctagctctcattagctgatcgccaggcatgtggcccaccctagatggtggtgtggggcccccaaaagttgggggccctgtgcggtcgtcgttttcgcactcccccgtcgacggccctgcccaccatgagtatcgtccacctctccgacctcgactaccatgtcctccaatgctcaactcatccggtccacgagtatcactcgt

SEQ ID NO: 30701 - DNA, 410 bp, Oryza sativa
gggctcaccattgcaggaggaatggtcggctggggatcatgggaccgatgtgcggccatgcgttcatcaaccttccttgccacctcctcttgcatgctgcgctcgtagctcgataccctgaactctagatctgcaatcttcaccttggtatctctcttgctcctcatccgactcctgtacgtgtggatgtcctccttgaacctaatcttccaaggaatcacccctttcgctcgtgttcgtcctggatgctctggagtctgcagggcgagtgacagctcgtccctctctctgtccggtcggaacgtgccctaagaagaggcttccactgcgtctgctagtcaacgcgcagcctcttgtatctgatcgccgaagaccagtgggccatcagctgggttgagcgttccaccgtg

SEQ ID NO: 30702 - DNA, 1509 bp, Oryza sativa
  unsure (1)..(1509): unsure at all n locations
atcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgtttacaactgctctttttgcatcatgggcatcttcccgtccccggtcgtgtgggcagcatttcagcaacacgagtttgtcctggaactggtactcgcccaacatagtcgccggtgatgttcgagtactacactataccgcctgctgacgctggtcgtcgtggtgttattcttggtgatggcacacgcgctctctctctctctctctctctctctctctctctctctctctctctctctctctctctctntcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgct

SEQ ID NO: 30703 - DNA, 590 bp, Oryza sativa
ataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcatagcttgagt

SEQ ID NO: 30704 - DNA, 560 bp, Oryza sativa
  unsure (1)..(560): unsure at all n locations
atgcatttctttagtcccgagtgaaataacgggaactaaagatggatctttagtcccgcttagtgttaccactaatcgggagtagatattttttttttcctttttttcattaattttaactgcttgcatattgatttcactccatccccaaatcacgaaaaccccaaatcacctccgaatcatagatcaaatgcatcacaaattctaaaagaaacatcacacatacatcacatattcacatcaaaaattcccaaaaacaaattcaacaaaaatatacaaaaacaaattgtaaatccgcccatccgccatcgctccaccacccgccgccggctncccagcccagcacgtgccccccaaccccgcccccgccccgcgcgcgtgccgctttcgctcgctcctcgctgctgcttcaagaaaaggagaggataagagagagagagagacaggaggaaagggaggaggaggaagttaaagatgaagaggagtttgcgatcgaggaggagaggattagtgtgagggattatatacgacgcgttaatttttagtcccagttgataata

SEQ ID NO: 30705 - DNA, 642 bp, Oryza sativa
  unsure (1)..(642): unsure at all n locations
cgcccaccaccaccaccacgcgatcgccaccatggacggatcaagcttaataggagatcatcaccatcacagcagcagcatcctctttggcggcgcatcagtgccacctctcctagaccaccaaaccattctcgacgacgacgacgaccaccctaacaaaaccggcagcaacacgaccgcggccacactgagcagcaacatcacagacaacagcaacagcaacaagaacaacagtgataataacaacaacatcagcagcagctgctgcattagcctaatgaacagcagcagcaacatgatctattgggagggtcaccaccaacaacagcagcagcagcatcagatgctgcagcagcagcagcagcacatgagcaggaatgtcatgggagagtgggacttggaggagctgatgaaagatgtgtcatccttgcctttccttgatttccaagttgaatgattgagagggaggggccccatctatagctgccaaaggagtacattgcatatatatacaantatacatatatatacatacatacacattgaaggtagtatttttttccattgacacatatattctctcttccaaatgtacaagatttctcacaccaactccacttttgatcttgcatatatataaat

SEQ ID NO: 30706 - DNA, 528 bp, Oryza sativa
aattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagatcgtagattccctttgaaattgatccagagaatgtcatcctttaattaattaggtctttgttcttggcggcgtcaactttcgcctttttcggtggccttgtgtgggcaagccgtggaactttgggggcccttgactttaaagtgcccgaagaagagcttgcggaagagtccgtgcacgaaccta

SEQ ID NO: 30707 - DNA, 160 bp, Oryza sativa
cgctccggcgcgccaccgcgtagccgagcagcagctcggcgtagagcggaacgagcgccataacagcctcccctaccaccatattttttgcaatgaaaaatggttccccccaactaggtaatgctagtagtattttttccaaggaaaatcctgttcgttt

SEQ ID NO: 30708 - DNA, 2015 bp, Oryza sativa
ctctgacatgcctcctcaagcacaacggattagtggaaattatggctacacaaaccgttgaagatagttctagaccttgaccaagacgaactcgcgtaggtaatttattgaaactcttgaattcagaatatgggaatgtagctctgggttgggggagtactcattttaggggggggtcgcaatggctttatacgtggtattcctatctattatttttgaaatttatagttcttccatttcagaaatgctcattttggtggaaagacggctttgttctacaaggacctatggtatacctccactctaggcatagaatttccaaccttttctcatatgcacaaaaagaggacatctcattcgaatccttcatgcaacatcaagagataacctcaaactttcacttccctatctccacacaagctctacgagaactgcaagaactcaatgaactaatggccacaatacaagtgagtactctagaagatacatggacttatatttggggcacaaatctgtatcaatccaagaaggtgaattctcttttctttgcaccgatacatccatctccttctctaacagtgatttggaagagcaaatgtacaataaagatcaaagtctctttttggctgcttttagtggaccatttaaacattagaggcatgatgcaaaggaagccttaaacctgcaaactggagttaaatttcctgtatgtgattcccatgttttggaagatgtaacatgttttaggagttctctcccgctcaattcatgatgggtgtgctattaggatcattcttttatttccatattcactaaattgttcaccttaacttatgttctactactcatttttcctcttctttcgttgaggaaaatgcaacaggataactgctcacgttgatttcattatcaactgtactaggtggtttggaaagataatgctcttctagtgaatactatcctgaacaaaactgcatcttccgtgcgatcaaaagaatgtcaatgaactcatttatctggcgtactcattcattagagtaacatctagatactaaggagagattgaaatacttgatcaatctcatcaagtcaataaacagagcgtatttgacttaacggtagctcagagctttcttgttccagcataattttgacttttgttgcatatgtcagagatattctagattcggcaaacttctagttcacggtgccagtcatcttccgttattaaaagtatgcgcaaattatattaaggtaaaatgcacaaatgctacaatataatggtacacataattcccacaaataattctaatgtattctatgcaattctatattttatcacttaaaatattaattaaaggtaataaatgcattacaaataattaaggcaaaatttgctataagacaccttaaaaacatgatctttgccagagtatactgtaggaatatgaatttacagtaacatgctcttagttttccagaaatacaaaggcctttatgcaaaatcagaagattttcctttctttttttcttacctttcttcctcttcccttttctttccccaccccacgatggcaccgcctgccatgtgcggcagttcggttgggcagcggcagcgaggtgtgaccgggcagtggcagtgcgacatgctgggctgcaaggccaggatcacgcgttggcaccaaggcgagcacgctacgctagcccgacagccaccgcatcgcagcgtgttgccttggtgcgtccacagtgcttgggaagtggcaatagtgagggcacactgccattcgatggcccaagggcggaggccctgtgcatgtgtggcggccgttcgtgggcgctgtggcctgacgtgcatgtggcaacagcggcggcgtaggcatggctcggcaagacggcaacctcagcacgggtgcgggatgcgcgattcggccccggcctcggtgcggaccccgggcacgatcgggcgtcgcggcgcaacagtggaggcacggacgcacggtggccagcgaggg

SEQ ID NO: 30709 - DNA, 20015 bp, Oryza sativa
tagcaatagggggtaagtacaaaattaccatcacatcgagatgcagaggggctatatgcaaaatgctacatacgtggagcggtcaactctggccaaatagtggtgtggaccagctatggttgattaaaacatgatcatgaagttcaatgtgcactttcaagtttatagacataagtgacaccttcgctcaagttgaaggaccaaccataaattttactcttgatagagaattaaatgatcttccacaaaatctgtatggaattcggaagcttaaaaaggtatagatcatggatatgtatttggaaattgaatggttttagatgcattgctctaaacttaacacagataagattgataggtattggcaaccttgaatgaaccaagtatcgttgattcaaattttaccacatttattgaaaggtataattattcttgtgcttcaaggtactggttgccaaataaacaggaggggctcgtgttgctagaagtggaagcctctagcatatatctgtttgatttgcaatgttgccttccatgtttcagttttggaggcatgggaatgttaacaaaccaacataagccgtgtgacactattttttcctatcttgagtagaacattattttatcttggacaatagggccgaatggttaatacagtttccacctgaatttcgatattcaagttcgagttttgccgccaagctttctagttggacccttgaccaatatgaaatcatgtgtgtttccagtagaacacagccagcaccgtaacctagtatgaaattttgatgattgcaacgtgcagggtaatataatctcagtagaattttcaaaaaaaaaatgattatgagatgaaattgttagttacagtatactagcataatacccgtgtgttgcaacggattctaaataacattcatcgacataaattaatattctgaaccacatatcaatattggacagaaagaagtatgattaaattaaaatcctaaccatatatcacaattggactgaaggaaatataatcatggaaataacaacatgaaactacaaataactttccagaatcataattcaatatcaggaaaattatgtaactaaatatgccattttttacatttagctgtaaataattcaatattataagttacaacaatttttaatagatcaaatagtgctaaaattaataatgtaaatggaaaaacaactaaaattagcagaaactaaaaatttattttagcacatagatgaaaatttgatccattaattctgaacaggtacccttttaattgacataaattagatttttttctatacataatcctatggtctcaatattaagtaaatggtctagtagcatggttaggctaaaccagaaaagaatagtgcattagttcatagatgttggaggttgataacaaagaaaatcagaacatcatgaacgcggttggcaacgatgtggtaccgatagagagagaaacagtaacggtaagatctggcagtgaacgcgactggatgagtgcgtcaaaacacgttccaggataagaaggttccgttttccttgaacatgcaggagaacgaaagatggagaaaaaatgactaacaatattcatcgtcttccctaaccaaaacaagaaatagaagaggagggaagatgggccccggtccactggcgaccaaatggtgctaagatggccagacgtgtcccaatgtgactatgtcaatagatggtggcggttggcaatgaagaaaaccaaaatagtgggaacaacaatgacgtggtcccaacagagagagaaatggacaattgcgagctcgggtgagtgcgtcaaaacgcattttcggccgacggggttccgttttcattgaatgcgcaggagggaggaaatgcagaggagaaaagggacgctgggaggacaaggcgacggggaggagggggcgacaccacgacgggaaggagaggggcccgcgggggaagggggagtgcgtgcagtggggctggagagatggatgtcgccgggaggaaaggagggagggggatcaggaggaaggaggaatcacgccgccttagccgacatgaggggggacggacgaaaatacacccggaagccttacatcttttttaattagatatagaattgatcagctaccacatacaaggatctgatgttgaactggattttttttgttaatgcagagacttgagaaaactagactagtgccattccaaagtgatgatgggattcaaataaatgtagatagatgttcaatttgatagtttagactttagaatattgttggatggtcagtccagaccatgtgtgcttgatgttgtaaagctgctaacactggcgtttaattgatctgtacccaattttgttttacattaaagcagcgcacaaaataaataggagtctgtttggcttgtggttgcttctcttcatcattcatgctccctctctctgagagctctattaaagtttggtttgggaggcatatggaattttaccaccccttcatttttcttatcgtccaaatgttttattctatttaaatttacaaggattatcaaaggctacaaaaacatttgcaactcatatattttctattgtgagtaatggacgtgaaccactagaagggcctgaaagcttggatttttcttcattagggatgacaggatacattccggtttcatgaccaaacacttgatttggacccttgccatgcataagttatcgaaattagagacctgccgtagagagatgagatgcaggtagacattgttaaagacttaaagtgaaccgttatatatgtatcaagctgcataatcttgtaaggtgactgatgttttgaggaagaatattctttaaataaataagataagcatgttcccaaaagcttgatctacccacggaaaacaacaatgcaatggaacagacttattattatattacagtggagttgtccttctgtcaaaaaaaaatcccgggaaagaatctggacaaacagattcattgtctggtttagacttggatttttatggtacattgtactgtaagaatatactatcagtatatttgatcatcggggcatttgcaaatttgccaccggttatttcaatattgcaaggatgccactcgaatgacagttctagtggtatttttgtaattttctagtggcagttttgcaataacgatttaaagtagtggtaaatttgcaattgccccttgatctaggggctaatggtgcagattcatttgatcttcctcccaattatcatgcagtataaattgaatagggtatatttgtcttttcatctttttgcgtggggataattttgtaaattcgagtttcttcacttagtcagatccgttcaagcgaaatccagtaggagccaatattttctcgaagctgcgcgcatgggcgaccgccgtcgctgaccacctctgcgagcatctcccaccttcctagcttgaaggactcgggatggcggcgctagggccggaggcaagtattccgtgagtcaaggacgccgggggatacgcgatttatccagaagaagcactatcatgaacggatgacgtgatccagacaaactaccacctatggaaataaatctcaatttcaaatgactaaacagctattttcagatttttaatgaataccaaatctacccttgcatatactgcaagtatatacttcaagtagaatgtaccgtaaaagttctcgacttagtatttttacggacaggatagaacgagtatgttgctggtaataatcttaccacaaactccacctttgcatatatttttgtgtttcagcgaacaatgattcgcctcatctaaactctgcatcagataattacgttgctattattgtggactaaatactgaaaaaaattacctctaaattattaatgtaataaatcttgcattcatatgggtttatgtattcatcaaataatacaaattttactacatgacacctaaattttatgtaatttgacatcgaaaaaatatgtcactgctaaaagacacataaaaaactggtaaatttgctagaaggcactttcagctcaattggagagataaactcttaagaaagacgagaatgtccctatgaccacatgcttcaaacatagcattaaagtgaaaatttagcaattatgcaactataaatttaccatcacctcaaatacatcactaggatacattgaattccatcttcactctagtattagctcaaaagcttttgaccctagggacattctcgtctttttaaataatttctctcacgagccgaaaaaatccacaacaaattaccaatttttttaggatgtcttttatttatgacacgtttttgcgatgtctactagcaaattacataaattttaagtgtcatggagcaaattttaccatcaaataaagatgcttttgatatcccatttatggcaataagaaatgagaattcttgcactatgccgtgaaaggactaattttttttctctgcaattataatgccttaaggatagcatgattgctgaagaatgaggctattgatttttacaatattacaactccccctagttaatatttattcttgattagctgagatgtttttggctgtcacttttgtaagtcgtaacgcgtgactgaagcaacaaaaagaatatttttatactcctataattttttaagtgttacggaagtacattattaaaacaaagaagcaattccaaatatttttttaataatggtttaagaatctggcttctacaccaacgcaattccaaatctattatcatggaaatgttggtaagtgaatagtagttgtgatgcattactgtgaacagacagtacatatattggtaggtatttgcaaccttgaatgaaataagtattgttgattcaaatcttgccatactaattaaaagattacaattattcatgtcatggaagatactgggtaccaaataaataggaggccggggctgatgttgctagaagctagaagcctgaacatataccttcgtttttgttttgcaatgttaatgcccttggttccgatatcttcatgtcccagtttaggttcgggagacattggcaatgaaaaagtacaatttagttgtgtgtatctacctttttcctttttgtggtagactaatgttctaaaccttgaattcatatgggtttatgtacacaatcaaagaaagatgctttatgatgacccatttgtagaatcaatgagttgatttatattttgtgatgaaaatattggtggtttgctaatgtttatttggagattttataagacggttgattttgtgaagtggatgttttcggttgaccctagcggtcagaccagctgaatgacgccggtcagaccgtaggtgttgcggcgatctgaccggccggcccgatagtctgaccggcaggatcctgatcgatgtcggtttcgggttgttttgttgtatttggatatttccttcggggatttggcttctagatggtttctatgtgtatggatactgttgttatactaatgtgagtaaagttgggatgaacttgggctcggaatatggtttcttagttgttgcatgtgcaggtgttgcttgaggcctcgggagagtgttgccggtgatagatcggagtcaacttgggagaagttgatgtccagggatcaagagatcatgcgggatactaaaggctagaggacaatgcacgtggtgatgaagaaatccatatggtatacaagagggattgtgtatgtatggaaagaggagtcgaatttggaagggagtccgaattcgggaagtttgattaagataaggaaagagatgagttgtatacttgcaagagagggtttcctatgtgagttaggagtcctaagttgtgttattgcatagcctacctcatgtataagtagagagggagggtgaggcctcccggtatcggttttagagagactagagttgagagaaagtgtttttgtaggatcgaatcacaacaactaagccaaccagaggggggtgaatggttggtatacccaaaaaccaaaacttttacggaaataaaacttaccctcaaattcgacggatcgcggtctgaccgaagtagatgcgctggtctgaccgcctggaacacgtcggtctgaccgatgtagatcaatcggtcgaaccgcccaaatcgcctgcctgtggctgtagccgccgccagtccgaccacaggtcacccgtcagtctgaccgcccccttgccaccggttggaccatcggtttgccactggttagaccgtcgaaacccggtgaaacacaaatcgaagaactcttaaagtggatgacggctttattgattctctctgtgtttacaaagtgcaccaacagcactccttacaaaaatctcgactaaactcgaaaccctaactaaactatcaactcaattgctctcaaaagcaatatcgggaagcctcacactccctctctatttatatccaaggtaggcagcctaaagttacgaaccaaactcatactagaagtcctaatctccataggaaaccctctagtacaagaaacaaactttacataactaatcataccaaatttggactcctcccaaattcgactccgcatcccatacgcatacaatatctctatcatatgtcatatggaatcttcaccaaccacgtgcattgactctagccttagtatcccgcatgatctctaaccaccacagacatcgtcttatccccaagccgactcccggtccttcaccgcaaattctctcccggcatctcgagtcacctacacatagaacaaacaaagaaaccatattccgagaccaagctatccccaacttgactcattagtagcaaacgacagtattacatacgcatagtgtccatctagaagtcataatcatgaaacaatcacgcatatccaaacaaacaacccgaaaccgaaaccgacacagagtcggccggtcagaccacgggctgtgccggtctgaccgcgcaatacacgccggtctgaccggcagcacctgcccagtctgaccgaaccacatccagcagtactgtagattcacatgtgaactccaatcatctccaaaaccacttcgcaaataaattccaaatatcaaaaacaataatctccaatgccaattgttcatcacagaataataatcaaaaacacctttgattttacagtttcgagtttagttcgagattttggtgaggagtgttgttggtgcactttgtaaacactagttgatgcaataaagtcgaaaagtttcaatctacatcttcgaatttgtcatctaccggtgtttctgggtctcgacagtctaaccacaggtgtgcgcgcggtctgaccagtgggatagcggcggtctgaccgcaggtgttcgggcggtctgaccacaactgcggtcagaccggcgaagctacggtggtctgaccggcgacaggagggcagtttgactggcggcgactggatttaatcatcgacttcgttcgagggtaatctttaattccgcaaaagatttttgggtttttggttttccctaccattcacccccctggtaggtttgtttgatcttttgcgatcctacaccatttgtagcattaaaggaaacgagaaattcttccattatgcaccaaaaggactatttttctctctgcaactataatgctttcaggagagcaggatatctgaagcatgagtcaattgattcttacaatctaatggtctactagaacagaaatattacaacatactctcgcatacaaaattacaatgtctgtcttttcaaatgaaagcactggaccggtaaactcatcaacttcaggacaatataagcaaattgatactcatacattaaaatatgatagctataacatttttatacatgggaataatggtacctcaatctcggctgatagcgaaatcatgccaaataaaaaaaagtgtgtcatggaaataacattggtatgattcctgctaaaagtaatagcatacaaattatgaattctctgataacctgcttggagaattatccatattcaaaccgatacacatgtttcgcatgtcttaccatgtcatgtcaggaatacgctgttcaaaaatgcgtatccagcaactaccccaccttcgttcagtgaggcagccttggttctcatcaaataaccacactggtcatttataatgaccctgtctttgttcctgaaattcagaggccaaaatttgaggtatatccaatacataatatggcttcttacttcagttttacgatttattaccgcaggtaggctccaaaaattccaaattcagaaaccgcattttcccgaatgcatgtgccatctcggactagatagcagagtgatgctggtggaaagatcctctgcattaggatgtaggctgcaagttcattgcttccatccttcttcagacttatcagtgtttcacgcagattgtccccataaatgttgtttcctgaatgaaacacaagagtttctcattagataccaatgcagataatttgaaggcaaagtatataagatagcagggtacctccaccctctctttgtggcttcagaacaaacaattctggtgattcaatagcagacatgactatactgtcattctccaagctccatagccctgcaaagcatttccgaactttttctatgtcggctttgttgtcaagaaacctatagtaggaattgtagtaagttcacacaaaatcagattaactgacatgttaaaaatatgagcctttgttaggcataaaaaactatagattttaaagaatatcatgttccccaatgtaaattacctttcgagcacattttcttttgccaattcttgttgaatctttttggttccaacaagatggtgtgctattgatgggcacttaatagcagaggaacactcaatcaagagtcttgctctccattccttagaaaaaatacagagagaagtgagagataggaaggttaatttctggataagtaaaatgaacggatgaagatgattaataacataccgcttctgaagggtaatcatttggtgtataacctgctctgaagtacacaacagcaactggcaatccatctctacatgagaaaataaatcatgttcgatagtctgaaatcgtgtaacgtgacattatatccaaatttctgcaggagaatccttacattgttagtgtaccgtcaggacggagctctccttctgcatctattgcagccattgttttgcgaattgtcgtcaccccatacgtgaaacgaagttaagggaaactattttttgtttaattgctgggtggatattttggttaaatacatggttaaaccagtaaacactgaagcatttttcagctatcaaatcagctttgcccactcaaggatgtcacaaaattggacagttacaaaatttcagaaatcagcaatagttaacagtttctttgattcttgaaagcacccaaggatatatttctctcaaggcgacagttatccaatattggtcatacatgtacctttcttctggttgaacaaccaccagaactactgaactggatgaccaaaactttagttagtaaagagtagtcatgcataagaaaggtcatgcataacagcttacaacctttgattgttgaactcagcccatgctccagctaatgcttcagcatgctgagcaattgctgtgttcccaacaacactctctggatccaaaccgagctccctctcatgctgcctaatcaggtttctgcacattacatccaggttgttctttgttatataaattttggtgtcagtaatttattatacaataatacaataaaagtgggcaaaaggataaatagcatgccaagaatacaacttaagttgccaaacttattaaactacttcgatatattaaattaaatttctttctgcatgcaaaatcgagcaaactggctggtctatatatacatatttgaagtcatgacgcctaaaaatcatagaataatctgggaaaatatgtattggaaacttaaaaactaccataagattacaaaaatggacttctgagatttatccatcacaaatctcaaatgttcatttttgaatgctacaggagtttctaggttttccctaaatatatggtttatactatatattttccatataacccatgggtgcataagaaatgaggaagctactttttcatgactctgaacttccaatcttaacgatgtgtccagattctgttcagggcagcaaacttatatttcaatgttttagcttgtctgaaaaatgtgtgaatgcatggttaataagaagaatcaaatacatttggtgtccatctgtgttttagcttgtctaacctgtgaagttcacatacaccgcaagcaagaccgttggatgatgttgaaatggtgttgagttcaacttgaagaagctggtcagtggccccatcaatcatgtaatctgacctagtaagacccaacctaacatcctgaaagatataatacagttcaattttttttttcaaaaaaattaataaaatcaatgctataataattatcagagtgttgaattcctcattgattagtatatttcaaaataagctgcgtggtcacctctttcttgtttagtttcatcatctttgcatggatatcaagaagccttccagtgaatgaatccacctctttcgttctggaaaatgataaactaaaactgttacaagaataacacgatgaaaacacaaagtactcaagaattgaaaccgatggttcagaacttcaagactagggtaatctgtagtttctaaataatgtagttataacttttttggtgaacttaggtaatataatttttttgttagtatggtttttcccgagagtttgaaaacatataattttatttatgtcaattatttaagaaatcaccttgccaaagtctcctgcaaaaaatccccatccaaactaacacgatcaacaagctcattgaaaaggggagccaattcaaccgcctgatcccagtaaactttcgaaaatgacattggcagtagagcaaatggggcatggagcaaaccaacaccgggagcttttcctgatctctgcagatcacgagatgtacctatgagtgaatttcttcttgacacgatgaaaaaaactatgtgcatttcaattccagagttgcaattcataaaaatgatataaaaatcaaactacaggtaaataaaacaacagctaattaagaactagaaaaatactcagagacgatagcattgaaaatgactttcattgccagtggtaaatccaagaaatgaaatcaggggctgtaaagaagcaacttaaatgatgttacaaattctgatggattatcatcaaattacataaattaaactgatttcttgtattagagggatattcaaatggacatgttacataccactccagctagcgcaaaaaaggtagaaggttggaacttatggtgtgtttaagaggaggggaaaggagaaaattgagaagacacgtaaagtactaaacctactatatatatttattttgatagtatatttattttctatttgtaatactgctacatgtttttctataaatttagtggaacttttaaaaatttgttaatgaaaattagtcaacacactttacattatgaaatggaggagtagaagatgaatatattttttgcttttgatgtcaatctagcctagaactgctgggaaagtttgcccaatgaggctctaccgcgatgacaagaacgaagcccacgcttaaaagctttgtattaagcttggcaaaaactaggtaaaccaaataacgagcattgccttggtgggctacagcccaaattaaatgaggctgggggctggctagatatagataaggaggtggttaaggatcaaatcagacttctttttttttttcatgttgaagacttctttttaagacggctagttaattagtcactttcgtcctttctatttctgtcaacagtgaaagcagctgcttgtatgaaccacgcatgtgctcttgcttttgtgatatgggtgggccatactccaactgttttgagtcctgagtatatatctattttatttttatgatgtggctaatactgatccctacgtcctaatataaatgcacctaaggttgaatgtggtatttcatattacaataaatatggacagtccaatcctagatgcacttattttaggattgagggagtaaccaataagctgatttataagtaaaaaaaaccaatcataaacaaacaaacaacattttatttagatttttaaatccataaaccactcttatcctgttaagccaagcgctaggaatgttgtttaattatgtgaagacgaggtaggactcctctacaaaggcttaaaagccaatgacttttataaatcatataagccaaaaatcgaattaaaacaaagagggcttaagtgtgctactaataatacaaaggcctttgggattggtttttgctggacatcttttacagtttgttactgtatttattttaagtggttttttaccaatagactcctaacaaaagttttactaaatattgggcataattaagcagaaagtcgtgacacttaattagcgactttatagcaaagttgtcacatggtaaatttcgaacttcagttcctgtttgttctttctcaccgaaagagatcaagttgttccctctataaagaaagggccagtaggcgccactcgtgcagaacgtgttgatttgtttttgcatatttgcatatactatattgtttgaaaggcatgtttatatatattttgtctagtttcgtgcatattggcgaccttcagtcccactatctggtcaccccaaccaaatctggccccacttacataatcagtatggttgagctggctgtttccggttgggtcaattaagatgggacagcatctatatataggatgattggatttgtagtttaattaaatctccaaatagcaaaagtggatgctccacaattattggggaagatataatggtcaaataattgtgataaaatattatatcaataaaataaattgaaaaccctgtataatgtgtcacaggaaattaattagctttggttagaggtaattaattttaatgtcgataactagcactgttgcttgctagttcagtctcgagccccattgcatggttgccctagtaagctaaagcaaagctaaattttaaatttttaaacttaattttgaagttgatttaaagatattttctacgtggttattttttagcatgggtttttatgttgctaagaacacatatatgagcaaccgatgagtgcctcgatttctcgggatcaaaccttcaataatcataatttcttcggacttgccataaacttcgtaggcaaattttggccaatatcaccttaattacttgtgacgagatttcttcattaacttttatgtagttcacacattcaatcgattaaaaaagtgacacaaatttcttttacataatttctacttaagtaaaaatctacagaatgttgcaatttgatgggatacgtatgcatgattttcccagcagctagctagctggttctaccaaatgatatggaataattttaatttttaagcctaggaaaaacccggtaaatttaataggagtatccggtagttgcaattgatgggatacatatgtctttgacgaacactaaagtaaatcttaaaaaaaatcactgaaatatgttcatgttaaaaggacaggaagaatctgcacgaataattcatgtgaaaaatatagtacgtaggtcacacattgagctagtcacttcaccgggtggttcttgtcgccaacgacgaggccgtgctgcgacgaccacaccagcgccttctcgaccagctcatccaccagccgcgccggcgccaccgccagctgcccctgctccgacgaccgccgtccgccgccctccaccttgggcgccgccgtcccgacgggggcggcgcacctcgccggagcgagcagcggtgacggcctcggggcacgggccggccgacgcaccaccacgactggaagaaccctgcaccgcccgagcgaggaggcgaacgatggcgaatgcgccccggaacgggcgccggcgccgcccatggtcaattggcctgttcgatcggagttggtggaggtcgcaaggtttcttgataatatgagaaggtgatgaaaggagcaagctaagctagttataaagggaacgagacttcgacatagactagctcggattagtaaggtcaacgtgttttcccctcaaacttccaacttttccatcacatcaaatatttgacacatgcattgagtattaaatgtagacaaaaaaaaccaactgcacagtttgcttgtaaattgcgagacaaatctttcgagcctaattacgccatgatttgacaatgtggtgctacagtaaacatttgctaatgatggattaattaggcttaatagattcgtctcgcaatttacatgcagaatctgtaatttgttttgttactagtctatatttaataattcaaatgtgtgatcgtatacataaaaaaaaatttatcaaaacaactaaacacggcctaagtatgggtatttgggcacaaagagaaaaactattagcattataataaattaagtttaattattttgaattttttaaaataatttatatgatattttaaagtgtagaaagtttttatatagaatgcaccgattaataattttataaacatgctaataaaatctgtgccttaatcagaccctagtccttgcaaattagaaatcgatcccaaccgttggatgataccgtcggttgaatggtcgacgacattcacgcaccggcagcgtataccactaaagatatgttctgtgtgtctgtggatcaccggtgcctgttgatcgtgacgtgaggttgaggttgtcgaggaaatatccctgtgaaaaacctaaaatgcccgtaaatgaagatactccctcaatcctaaaatataaatatttttataattgaatatggttattagttattaagaaagtaggtaaaattaaatgatgagagattatgattggataagaggagggaaaattgaatggtgaagggttgttattggttaggaagaaaatgttaatgcataagttgttatattttagaataaattttaaaggttagaagtttttctattttaagacggatggagtatatttattaatcactaaggatatatgtgcaattgaaccgtagtcgccagtaccgatttaacaaaaccggcattgatgatgttcctgctccacaaaacactcttgcgctatctagagaagatattagtgccaagtcatattaagaaccggtactttggcggataatcagtgccggttataagaatacccggaactaatgattaaccaatcaatgccggtttaggtggattggagcggggtgccagttttagccgattggagtgggaaggttgacctattgatcggttgattggaaaattcatctgtgaccctgaccatattagggcatgttcaatggtagagacgagtatggtctcttaagcaatacaagattatttagagaccgaatctttacaatagtagagacgacaaagtctctaatcattaactcaaaaaatattccttttgttaatattctttccattttttttaccctcatgcaaccatatttctatattatattgattaagagtcgttgttaagctgttgttatgcatgacaacgatgttttatctctcctctttctatttcttccatgtcaacaagtattccaaattaacatcactaagagaccactattgacaaccattgtatatgcccttagcgctaattacggatatatgaacatactcccttcgtcccaaatatagtaactagaaccggatgggacttattctagtaatatgaatttgggcatgccccttgtcagatttatagtactaggatgtgtcccatccagtcctaggttgctatattctgagatgggtgagtaatttttttatatgtactcagattgtgataaagtttatatgaaaatcgtagctcttaatgagatatataattttatagttgataactttttcatttaaattcttttaggtacttgaatccatgattcaaatatcggttaggaacgctcgtaaggaaaaagatgtgcatgtgagggagggatctctagtttgaattcacaagaattatattcgatttttctaggccacatctgtgttgggtccatttctatcaattatactagttacgaatcagcacaatgtctccacaaaatttttcaagttcaaaacgtctaaggatcgtctttctcaacaacatgtgtagcacaatattatatattagtccagatatactagcaccaaaccttttgtgttcaaaacatccaaggaacatgccatgtgttgccttgctctggcggaacttgaagccatcatcactcccacgacatacccatcaccccttctgttcggagcggataattctgagatagttcggacacggatacatatttttttctcatatatgaatatgaatatggtatcgaagttttcgacagatatgaataataatacgtgtatccgatggatactatttggatatccgctaaaggtatgaaacatatacctcatttctttttaactttagaccttacaaccctaatccacactggattatttaattgaaatcgatccgcactgagtcaactcactcccgttctaaatatgtatccttgagatataatagggttgtttgtttttgttgtgacttataacttaattttgaatttaaagagggggggtgtgggtttgggttgtttccattattttttatttgcctttgggccgaagagtaggagtataaaaaattgtactctcagaacttgtttttcgtatatgtctatggtttataagtcactgttcaaaaaattgctttccgtgaaagcctgttatacaatgtcatgaaaccactaagaaaagtatggcatttctataatccaaatgggaatttcatactctccattgtaccttttctcaacaatcaacagccatttttcaatacattcgtcacaaccatacgcggccattcgctgaaccacacaagagggtttaataaaaatgccaaatcccattgcatatccgatactgtgaaatttgttcacaatgattcttcttaatataaagttccttaaataaaatggtcatgttactgttttgacctttatgataagatggataagaacagtaaatcaatgacatgaaaaataccctttactgtagcgtcaatattcctaggatctgcgaaagaggactccatgctgtagtacttactataccgattttatctaaaataatatgtaagacggtatagtatgtaatgcgacacatcttaatacaacgaatttgaacagtctattcagattcattgtactgtaggatgtatcacatcttgtactaagttttttttttatggacggagggagtagatagttctcctttccgtatatacagtactgcaaagttcattcgtgataaataagaattatatcaatcaatcagtctttccaataactcaatttgcaaaagtaataataatctatgcggcatatgccactagccgtaggccagccactacattcatttgcaagtgaagtcctgtgaatcatcattcacgattcattttctatgattctggagatgatatggaaaagatctttgagtgttagtttatgatacctcatggtacgttaaattataaagtaaaggttgcagtagaaaatgtgatgcctcctggcatacttttaggagtgtaaaaatatagagaattcacatatcatagtcatcttgttttccagcattatgtaaaggaaccagtagacctttaggaccgtaaaaattatgaaaagaaaatggagtgattttgacagcattagtcataaaacggacacagcaagataagaaccacaaaatatttgatgcatagaaaattggatcggtcctacattggaaaggatgacattgtcgttagtatgcattgactaagtttagtagaaaatacaacacatcattttcagcaattgagtaactaaggaaaatatccaattatgtggtgaaatggaactggaaaactgatgaaatatgtgtagctgaccatggattgctgtacccaagtgttcagagattggaatacacaacagcaacatacaaacaactatgtatatgtagagcagcatgaatgaacctgagaaaagggttgcatgggctaagcaagcacatcacacaattctcagagattgagagacacaaaaatgaaatgaatcttgttgaagtaaacaacgtcccgcatcaggatggagaatcttcatcttcaacacccttcatgacaacggagcaaagaacctgctttgagatgtgggactcaagctctcttgacacctctgcaagtctcagatcgaagttgctccggtgtctctgtggtttcggagatggtgaaccggagaatcgtcttcttgggcttgacagccttgctgtcggggatcctgacaaccagctcttggtgaaaacaggaacaatctccttccctgtcatgatgtgctttctctcttggttcagaggacctctctttgtctccaccggtaatggtttcatcggtgaggttgttgttgatggcagcttgttcctgattcgctcacgggcacgctcagcggctgccatagccttctccttgctcatcttgatcaacgtccatgggttgatctggatgtcatctttccttcttgttccatcactgggctcattttcaatcctgatggatagctttcgggtactctgtcatgtatgaaatggtattgtcatcaccaagttagattaactgaaactagtactactggcctagtgctgcaatttgtatgtacttacttcacttaattcatcttttctgcagaagatccttgacagaaaggatggcctttctggtgaatcgaagtcgatactctcatcagacgacgaatcagagtcatcgaaagggtcaaatgcttgtgctgcttctctcatagcaaggatgtaatcatatgtcctcattccctgaagtaacaacagttcacaaaaaaaattagctgacatgatttatatcatctttatcctgcacaaaagtatttgttcagcaaagtgcacacctttctaataagcacaacatggaagaagaagagctgacccagtgctacagtactgtataaggtgaagatcacaaaaaccatctgcccagaatatcataatgaacaatgtagccttatgagtattgtacagcagtaatgatgcgtgcctaattgcttattgagagagatgatatgttcttcttggttacatactgataacgctgcatgtgctccttttgggagcctgatgtgaagcctgtgttccatttccattttcaaccctttgctgtcggtaaagcagcgaacgaagatcgcgattgctgttcctccctcaataacaagctgatacagaagatttgcatgctatttagttgtagtaaaagaaatgatttcttggacatagaaagaaaaatgatgcaagccgagagacaaaaaatattggcatttagcacccaccatgagcaggacaaagaacatgagcagaataaatgatgcatagttccttcttccaatgcaattgttcagccactgtgtgaaaaagatagaaaaactcagtcacttgatcattgaaagatcaaccattgatttgggagtgaaaagaatgcacatagcttgggtgcttaccctgcagtggtgatcaaatccatcaacacagcgatcacaggtcttgcagtgcttgctgcgcaatttcacctgcaattcgtacataatcgtttcagattgtttcatcttgacctctgactgactccacattaatgaatttcacaaaccaaaaacgttgaaattcagttgaatttatcctcttctattct

SEQ ID NO: 30710 - DNA, 5689 bp, Oryza sativa
cagagcagtggacctcgcaatcacagacggggcagtaggagatgtcgtggccggcggcggcgtgcggcgagacgatgtcgtcgaggctggtgaaggcgaaggggagcatggggtcgagctggacgctggagttccactgctcgaggtagctccgccgcacccaccggttcatcacgcggacctccacccgccggagcagccgcacgacgtaccgccacaggatgtacccgtacctcagcctcggcaacctcccccctcctccgccgccgcggcggcctgcgcgggccctcgccagctgccgccgcctcttcatcttcttcgcgtgcgtccggtccgacgggtccaccgccgtgcaccgcacgtagagcgccgccgcgcccgccgcctggtgtttgatcccgtcaccgtcagcaaccaacaacgcgacgcgaggagaagccagccaagaaggttaccgtaccgaggaggagaagagggcgaggagggtgttccccgcgacggtgctgccgaggtacggcccgaggacgacgtagaacgcggcgacgaggacggcgaacaccgccatgcccaccagctgcatcgcatatccaaccacacaccgtcacctcaaagaatccaatccggggggaagaaaggtgggagagaagcggcggggggacctggagagggtggagggggagctgccagccgtggcggcggcgccagcgcggccacgccatcgtcgccgccgccgccgccgtggattcgccgctgcccatcggtggcggtagaaagatctgcggctcgatgcggacgcgtcgttcaactctgctgctgtgtgactcgaacgcgagagtgaagcgaagcggcggtggggttgtctgacaggtggggtaggggaggcagccaacggtcggctcgagccaacggcttttccatccaccgctttgtcgttccccggctgtttgaatttcgaatcggcggttgggcgctcgaggccgagtcctcgagcgcatctgctccgtcggatggcataccgtcggccagatcggaaacaagagtggggcatccactccctagcccccaaggcctattgacctaatgccatcttcggtgtattttcttagtcccataaaaaaacaaatcaaatcaacggcgtcgagttaaattgctactccctccatctatgtttgatagtcatatttcatcttggcacacagaccaatgataagtaattctacttatcatctatttaaacatgctactagtcatttctcgtaaacaagcgattcattaatatttacatttttcaatgcccatgtagccaatcatgtgtggaagaatgaagagtcatgcattaaatccgagaaagtcattaagatgataggttgttggattgaaatatgcctatcaaaaataattttttcagatttggaaatatgactatcaaaagcagatggagggactactgtttaatgaaaaattatagtactaccatattttcgagtggaatcatctgaattggaaattattttattgtctttttctttcttgaaattattctattaatgatgtctgtctattagactctgctccatctgaataagaaatgaaatttttactccctccatcacaaaatataaagaatttaggttggataggacatattatagtactacgaatctagactaagagtttatccagattcgtagtactaggagtaggagtatgtcttagtagtatattttaggatgaagatagtagttcttttttccttgtcattgtgtcccatgatcaatttatacattgtttgtctcgacttgtggtgaatacttcgattgcacattagagttggactatggctaagggtatccatacttcaggccccgttcacaacacacgtaaaaaaaacatttcaaaattaataaactgttgcagtaatactcgagtgaatatttcatgccattttctcggtgtgcacgattcacaggtattatctttgtatcccttatagcaatgtagcaattgcgtgtcgtagaaatatcagaaaattcaataatgttcgcaatcaagtgtgaacatgaacatgataattagctctcatttgaactttccacgtacccgatcaacttgataattgtaattagtaaaacagagtatatttaagctggcttgtgtgctgtacaaataccataaattcaaacaagcatggtgttattgaattctcacatatagagagaattcgactaagcaaagcaagctgccaaaccataaaccaacataaatatttataaaatttaggtatactccgttacagatagcgtttcaggaattcatcaatgcgggtgtactgaacctctgggtacagtatagttgcttcggctccattgtcaccaatgtcaaagtttgttaagcaaccctcgtagaaaatgtggtagaaatgtgttattcccacttgaaaagcaaattgcatatctgcttgcattaaaaaaattgcatatcaatgatagttaggtcaataattgtttgaaattgaaccccatgagtaatggtatttaaaaaaaagaaaatagctaaaagtgcacattatcaatttggtaatcaatggaaaacaacatcattggtggggtgctgaagctgtaattgtacggctccaaccatcaagagcacttaaatcaagtacgtcttggtgttcatgattagatgtgtgtgtatatatatatatatatatatatatatatatatatatatcggtaagcagtttatttttacctttcattggagccaaaaattcttcagcaggtatgtggaatttcgtaagactttttccagagagtttttcccacattgcgatcagctcgttatgagtgaggcaattatcttgtggtcttatgtatattgtcttgttcaaggtgcgaggatcatcgattgatttgattgtatatgttcccacatcatcttcatccacaaaaaacgctgcatataacattgcagcttaattggttagtatagttgaaaatcaaaactgattgtaatattactgaagaatggttttcaatgccctaaattatttcctatagtttcatcaaataatgagtagtgaaaaggaaggtgtacaaattgatgtattattatttttcacagaaaatcatgcaaaaatatcttaataagacatgatattttcactagctagctacacataaaaaacataactatttacaatagagtaaattgcgctagtggtaaacgaacttggcatgtgtatacaatttattacaagaacttaaaaaatgatcgtctgggtgcaacaacttatctacttcgtacgttttctagaaaaaaaatactaccaaagattttgtttgttgatatacacgaatgattcatccaagcgaggatagggtgtttggtaaacatactagtatggctgtatccacatgccattacccaagttgctatactaccagcatgtcggtttttgaatgattcattttttaggtgtttggttttggtatagatgaaattggatgaactctgaaagaaaatattcccctaaaattcagattagcttggtatctcaaaaattggtggaccaattaaacctattttcctctttctctgaacccttaaaaaatagaaccatgtcttttctcatgccgaatggacggttgtgaccatctcatcctaaatttggatgagtccaacccatctcatcccgtcatcaaaccaaacaaatgttaactactctcttcatttcattcatttcatattataagtcgttttgacttttctaatgttaaactccttgaaagtttgactaagttatagaaaaaatatagcaacatatatttatctatacaaatcgattttattgaatctaaattaaattattttgataatgttggaggcatgtcatgagaaccttcggctagactgtcgaaacaactatcaaatcgcgtagccgacaccgaaggacgtaggtcgcaggaaacgccgaaggcgagcgaggggagtacctacgcgaggacggcggcaagcaccttcgccaagcatgtagcaagagggcttcgaaaagacgaagaaggttgagcccctctgtggggccttcgcccagcaagctccgacaaatagcccagtaagggcctctttagagcccatgagccagtaagatgggccataagacaattattaccccctattttaatgctaactaagtcgatttcgagtaaacaatacccctagggttgtaatgggatctaatttttgagaaattaatactccctccattccaaaatataaggcacaaccactcttaatccaaagaccaagaaaataattattatcatcttgtagtttggatcatcctaataaatataatgcatgcatccaataggattagatagtggaggatttaaaaacgtaataatttaatggagaagatgtcatagttaattgcatgcttgcatgtatgccttatattatggaacatataagaaaagtggttgtgccttatattatggaatgaagggagtacgattttactactttactttcaacctgccgagtgaagcatgcctttcggcagaaacatttgtcaatcgataacatatactttctttctttcttttttgaaaatattgctatattttttttataaatttagtccaatctaaccaagtttaaattaaaaaaaatgtcaaagcgacttataaaataaaaaacagaggtagtacattacacctgtacaccaagttcttggaacatgagcgtaatttactctttatagcaagaaaagttaccaaggggaaaaaagatgaatggattaaatggtggagaaacaaaagacgctcatcaggaatcttgtcatgctctaataaattggtacattaaaatatggataaattatatttttaaaatgaaaagtcgatagatgaacagacacgtgcaactgaacatgcctgaggaaaaaaaaggaaatgccaatcatgaaaaattgaaggtaggggatttgcagttttgtaccacagaatctgtatcgaatgggaccactgaccatgattaaaaaaaagctggacgcatgcttggatccaaagataaatctcaattttataaatagagagaaaaataactacaaatctatcttttcaggagaaaaagacaagccatctcctaaaaattaaagcaatgaagcaacaacttagctaactactccctccgtccaaaagaaccaacctcatactcgaagataacacatcatagttcaataaatctagacatactagtataataaatatacttcctctgtcccaaaatataaacatttttagtatagtgacaagtcaaacatttttaactttgaccattaataaaataaataaataaataaataactatcataatatgcaactctttttatttaaaacatcttacttttatatcttacttttatatatattgttgatcaaagtaatatcttggagaccgtaacatagtccaaacatgcttatattttgggatggaaggaatagtatgtctagattcgttgaattaggatatgtcacatcttagtagtaatttttggaacaaggagtaattaacttttttacctttgacgttaccatccccatacacattaactctctctttgggagggaggaaggaggtcagctggctgagattaggacagaagtaagcagcaaagcagttggaa

SEQ ID NO: 30711 - DNA, 15927 bp, Oryza sativa
aaaaaaatcgaacggattagtgttgtttagtaggacgtatgtatctattgaaatcttattgtgctgctcattggaaatggaattgaataacttgtttttatgtctgtcgttttattactatacagaagataaaaccttttactcctgtcgttcacatttattgatttatatcataaagatcagtaaaaattgccataattttactcaagttattatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagtttgaactgaatttgaacttgtttttgttagattttgattctaggtatatagcatccatacatatatttagctaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatatatatatatatatatatatatgtatgtatatatatacataagttataatatatatatatatatataccaaattttttatttttcaagataatggacagaaataagatatacacagccaaatcaagttcttttaattatgtactaatttgtggagctgattgaaaaataaattaccttgacatttccagcttctttgatggcctcgacaagcttgagctggagcatgaggttgtggctgcggaggtggacgccggacatggcggagacgacgacgtccacctgccggaccgcggcgacgaggccatcgtggtcgtcgagcgacgcctcgaggagccgcgcgccttgcgccttgaaggccagcagtatctggagcttgtcgatgtcgaggccgatctccggccggagcaggacgaaggtggggtggccctccgccaagctcgccgccacgatccgccggccgatgtagccggtgccgccgacgatgaggacccggctcttctccatggccatgtatggctctgctcgatctgatgagtcacacaacggacgacgctatcgtgcacttcacaaagcttactgcgatttgtggcctatatgaacgagcgcgtcgtcctgttctactgttgtcgtaccaagggtctcaatcgtactccaataaataatcactgttgactgggtaagggctacttctcggtaaaaagaaacaaaatataagtagtactgaacatgacattgatatatctcagtagaacaaatctgcacagacgatatgtcacatccaggacgatatgtcacatccagtttctagcatcgttgtttgagatggagggagtaggtaaagaacaatgtttgatacatcatcttttcgcttatgtttatacttatcagccaaaatttgaattttgaacctaaaatttggagttgattttggtgttttttaatatttttcagtctttgcttttagatcgctaagaacacgtatataaaagttttattcacaaattattttttatttgtgaatatgctggggccgttggatttgcatggccgatgaggctcttttaacttatataagataaaagtgtgtctatgtgagagtatcactaagtacatcctaaaattttatccccaaacttttagttttacgaatcctaaacaaaatttgaagtgttaaaattttcattcctccaaaagattagctaaaataggcttcctaaatattaaaaggtgggcccctaggaaacttccaaccccaccctcccgcgagatcatgttcgcccgctcgaccctgccctcaccgctcggtcatctctagatctgtaatcacttgctttctcactgattggcagagccaatggctggcctgaaaactctgtttcttttgccacaacaatttgttacataactttctttattatctactgaattttcccctaattgccctaaatactaacatcagagaacaaactaaattgttgctttgcagtaatagaatttgaattacctcatcttttaatagttcctcctaaacacaatcgctaagaaactcgaagagacaagcttttcattctcaatttaatataacagaaagaggaccaagaaccgtaatagctatatctagctagatgcacccaacaaaatttgccacacaaacaaatctgaaaactacaatcatcattagtcactggatggtgaagatgtcctttgctttttctttacacatttacagagcttggatgaatcatgttctgtaaaagatgttgatcaaaggcctttggtcgcccatatcaatgggatcacacgcattgctaaaactatcttcaacacaaagagcttctatcgaataagtgttgtaactacaaaagtaaatgcaaaatttgctacaggacactcaaagattgtggcatttgctgtgagacacccaaaaattgtgtatttgcttgtggacactgtaaaaatatggtaattagctgctggacactcgaggcattattttattattttcggtgaaaacagagagagaaagagtgttgaaagtaccaaaatgcccctgacactgttcttctttcttctctctttcctgcccctgacacgggtcgcgttcttcgctgcaggtggcggcgccatgcgggaggtgctgctcacgcggtgggaggggcgggacgaccaggtgctgctgtacggtctcctcccggcaggggtggaccacggcgagctcatgggcagagcgcggttctgcctgtgcccgaccggtgacaaccagggcgcggccgcggcgagccgccgcgtcgtggaggccatcacggtgggttgctgcgctgtggacagcgccgtctccttcctgcgccgccgtcaccggtgagctccaaggccaaagccttcttcccctcgcgccactgcctctctctctcttccccaattccggccaatgccgtccgttgccgcagcgccacctccacgccatcacagagccccgtgccgtgccaccgggttcgcctccatctcctcttgccgacgccgacgctcgtcgcagcagccatgcgctgtcaccgacgaacgccgccgcgccgccgccatggcagagcacggccagggagccatggctgctctgccttggagccatggccggacctggtcggcttatacaaatggcccacgggcaaaattgtcttttatgaaagtttctctcaccgtttcagccggaaataataaaataatgggaggagtgtccaccagcaaattaccacattttttcggtgtccaagagcaaatacacgatcttcgggtgtctcacagcaaagaccacaatctttaagtgtcctgtagcaaattttgctaaaagtaaattacctcagctttgtctaagcttccaagcctcttcccagttgttagattagttatgactacagacacccgtgcggcgggaggggcggtggctgacggcccatgcggcgggagggcagtggccggtgacacccacgcggcggggcgacgcccgcgcagcgggagtgcggtggccggcgccactgcacggcgtgacgaaggctggacgacggcgcgtggccggagggcggcaggatggcgcgttcggtcggaggacggtgggacgatggctcgcgcggcaggagggcggcgggatgccggcgcgggactgcaggccggtggcgcgcagaggctgctcgcgtggagaggatgcgggagaaggaaaggggattgaaactttagttaggattggcatgggcattttggtattttctaaaaatactaacaatacaacacacggtttgagtaacatatctaacggaaacctatcgggaggggcatggaagggatcaaagcgaaatttcaggggtacacaggggattgggtaaaattcgagggtatagaaggcattaggtgagtttttatggtacacaagggattttctctacattatttgtctgacattgtacttaaatagtttgattatacattagagatggacaacggctaagggtaaccatacttcaggccccgttcacaacacacgaaaaaaaacatttcaacattacacaaactgtacagatatactcgagtgaatatttcatgccattttcacggtctgcacgattcacatatagtatctttgtaccccctatagcattgtcgaagttgcgtatcacagaaatatgagaaaattcaataatgttcgcaaaaaagtctgaacatgaacatgataattaactcatttgaactttccacgtacctgatcaacttgatagtaattagtaaaacagagtatattcgagctgggttgtgaacagtacaaataccatatattcaaacaagcatggtgttattgaattctcatatctagagagaatttgacttagtgaagcaagctgccaaaccgtaaaccaacatgaatatttataaaattttcatatactccgttacagatagcgttttataacttcattaatgcgggtgtactgaacatctgggtagagcagagttgcttcggctccattgtcaccaatgtcgaagtttgttaagcaaccttcgtagaaaatgtggtagaaatgtgttactcccacttgatgagcaaaatctgtatctgcttgcataaaaaattgcatatcaatgataagttaggttaatcattgtttgaaatttaaccccttgagtaatgatattaaaaaaggagcatagccaaaagtgtacattatcaatttggtaatcaaccgaaaacaatatgattggtgtggtgctgaagttgcaggtgtactactccaaccatcaagagtacttaaattaagtcttggtgttcatgattaaataaatatatatatcgataaacagtttatttttacctttcattgaagccaaaaattcatcaccctgtatatggaatttggtaagactttttccagagagtttttcccacatcgcgatcagctcgttctgagtgaggcaattatcttgtggtcttatgtatattgtcttgttcaaggtgcggggatcatcgattgatttgattgtatatgttcccacatcatcttcatccacaaaaaacactggatataacattgcagcttaattggttagtatagttgaaattctaaactgagtgtaatattactaaagaatggttttcaatagccctaacttagttcttatggtttcatcaaataatgagtagtgaaaaggatggtgagtaatgcattattatttttcacagaaaatcatgccaaaaaaatcttaaaaggacatgatattttcactagctagctacagatgaaaaacataattatttacaatagagtacattgcgcttgtgataaacgaacttggcatgtgaatgcaatttatcacgggaacttaaaaaatgatcatgttagtgcaacaacttatctactttgtacgttttgtaaaaaaaaaatactaccattgattttgtttgttgatatgcacacatgattaatctaagcaagggatagggtgttttgttaaaacatattagttttattgtatccacatgccactacccaagttgctatactaccagcacgtggtttttgaatgacttttttttaaggtgtttggttttgggataggtgaaattagattaagaaagaaaatgttcccctaaaatttggattggcttggtctctcaaaaactggtggaacaatgggacctatttttctctttgtcgacatatataccatcacttaaaaaaatagaaccatctcattttatctcgccgaacagatggttgcgaccatctcatcccaaatttggataagtccaacccatctccaaaccaaacaagtgttaactactccattcgttttcatattgtaagtcgttttgaattttttaatgctaaacttcttgaaattagtttcattgaatataaattaattatattttataatttccttttttaaattgaaaatattgccatagttttttataaatctggtcggagcttaaaaaaggttcacttagaaaaaagttaaagcgacttataatataaaatagaggtagtatatcacacccatacagcaagaaaaagttaataagtgaaaaaatgataaatggattaaataatggagaaacaaaagacgttcattaggaatcttgtcctgctctaataaatttgtacattaaaatatcaataaattaatatttttaaatgaaaagtcggtagatgaaatgaactttacgaagtggaaacaaaacgtgcaactaaaaatggctgaaaatgaaaaggaaataccaataatgaagaattgaaaacaggttatttgcagcacagaatctggatcgaatgggaccactgacaatgagaaaaaaaaaagatggacgtacgcttcgatccaaagataaatcaactttgtaaaaagagaagaaaaggtacaaatctaactttccatgagaaaaagacccaaccatctcctgaaaattaaagaaatgaagcaacagtttatagctaagtaattaacttttttacctttgacgttaccatccccgtacacaccaactctctttgggagggaggtgagttttcatctgacagaggttaggactgaatttagctgcaaagcaatttgcagaaacatatgtgtgagggatgtttgcattctcaattgctctccttgtctccatcttctcatcaaactagatgatggggcgcgccaatggcgcgcctcctgtatataacttgttgattattagtgccatgtcatattagtgattagataatacaaaaaagggcatgacagaactgaaggtaaactatgcatcctgatgccacaaactccattagaccattaccaaaaaccttagtaagccatatattggcagcactacaaagctggttccagagcagtagcttcaggcattgacaaggctgatgctgcctcggaatgtgtcacatctccaccatggactctcttctgcaggctctccaagctggtggcgcctcacatcgacggcgaccttgaggccattgccgcactgggcacaggaattgcttcatctgggaggctgcagtttgcctagtcgtcttcgatgagagcaacagaagctgcgtcagatacacccgaggaaaagggcgtgctgcttgcaggcatttctgtgaacaattgaagtcctattccagttactgtcctcacgccttaatctgctatattcacctgaacacaaaagtgctccatgacaacgtaaacaatatgaaatcatgagatttaacaacaaccacaacttacaataatataaatacttcttgaaaagaacaataatataaatcagtgtctgaattgtacctccaatagagatatatttcaataaacattattcagaaggcaagttatgttttggagacagaataagcttatatacaaagggatagaacaataggttcaggttgttcctttcaatatctccctgtgtactgttgttggaaacaggattgaaaattctagactaccaataggcctactttgcagcaacagtcatcattgtactgaatgctttgaaaaaaagaacaccttaccatgcagatcaaatagagttgtccatatactcacatacggtttgtatgaatgtgcggttgtgccctgtttggactcctcatctgaaggtttttgttcttctcaagagataaaagttcttccataggcagcaaaccatagacgccgagaacagtgttattcttaacaacaaaactaaaacaagaaaatacaaaaatacacgactaatctcttctgttccacatatagaagaaccagaaaaacaaaactatttaagcattttaattattgaaagaatactatttaagtggatagcttcaggactataatcaacaaattcatagcccttcaatgggaataaataagtgctggatgtagtcaaatgctcataacaacaataacaaaaaatacctttcttctcatagtgttcacgtcatctcaaagattgccattttctatcgtagactgcttatatttctgagtcatctcagccaggcacttttgcagagatgcattctcagatcttaactggaagacctggatgatagtgcagtaattagaattgccttcccagttacaccataagtaaacaaaatttaaatgatatttattgagtaatccatttcctcagttcccacagtaaatttccttgtgtcaaacatgtagaatcaagcaagcagcaagtgaaaaatgccgaaggcctgagcttattggacatggactcaaatcattcataaaactaattgaatcaagttacatgaagataaggtggaggggtatgacgattgctatcaaaatctgaaccagagaatccagcattaggttactttcaacctaggctgatgcacaactggttcatcagtcattgcaccagcgtcctatatcctccacccgaagagttgcaagcaacaaactaatatatagaggagcagtcagtagaaagttacatctaaagaacatgaaaagatacatgctcatgcaagtcataagttacgtctaaagaacatgaaaagatacatgctcatgcaagtcatactgcctcgacgttagctcattcaacatcatacttcacaacataccggtatctactatttgtcttcacgctatatgatcttatctcctaattttctcatatgaatcaagcatcccaaatccatcaggtattgaattagtactaacaactaacagtacatacatagtatatactctaatgttacttttgaccgctgaaaagtgcaatcaccatgagatcctctaaattaagctgtcctaaccaataaaaaagcagagatcattgaaacagataagggattataaacaacaaaatgaatatataaaaatattatttgtttaaaacaagtacataatgatgagtcaaagttgagcattcacatttctgtcaacctcccattagaataggaaattccatcctagttgcttttagtttctccacataaagtttctctccacataaagaattatttctgacagttagtttttttctccaaaatgtcttgcagttgaaaatgcagcaataaaataatttaaaaaacatgcatctaatacaagagacacgcaaacaacagatagaatagggaaaaaatgatatttgttaaatcccacaatcattgaagagctgcttacagtgggttgggatcaattaaaacatgtcaaaggcaaaatcctatttaacccatcgcagaagcatggtgttcaaatagaaataatgaatttgcaatatcagaaaagacgagatgagttacaaactactcacaaagttggtaaggaagtgcacacgatgcaacatcagcaattgcaaaataccactcacgatcatcaccaaggaggcctagattttgataagcaacttgatatttaaatggtccatttgcggagaactcaatatggtttgttccagtaagttgatctctattcataaatctgtaagttgtcaaaataaacagaaccattaattgtgatgtaccttactaagtccatttgatatccagtttttatgtcatcagacaactcacaaggtggttagggatgttactattggaaacccatcacccggtgctggtgagctcatgaagttattcttgcttaggtccctgtaaaaggggagaaattttaccacaactcaaagaatcattaaccttaaattttcctatattacaaactttggttcatcaaaattgtaaaccctggacatgattgctagagtaaatgagtaatgaaatatcacaacaaatgtgcagttgctacaactaacctgtcataacggtggacaggcatctctggtatagatggggtagttccaaacgacgactatagaggacaaatcacgagtcgaaattgactctaacaaagtggttatcccttgctttcactaaatcatgcaccattgggaaggcgcctacaccaccggtgcactaattagttggttaagaaagcatgcttggaacatctaacaattttgcatacattatgctccctttactcccaaaatatagcaacttctggctatgtatcttgacaaaacattatagagtcaactccctctcctttgtcccaaaagttgtaatgttttcagatggagatatatagtattatacagcaacaaattacacatattgtaaatgaggactaaaagtgaataaaaagaattgagtcatagcatatgagcaatgaggaaaatattttgcagcccagcattgatcatgattagttgtcatcgacagaagatatatatgaaagaacgaaatctatcagttgtcaagtgtaaggaaaatcatgaacagtgcatgatctgttctttgacacttggttcttaatttctgaaatgttaaataatgcagttaaacaattaagtactggattatatcaaagtactttactaactacctcatcaaacatgtcacaaagcttgttcttcttaatctggagctcgtaccactctgacgtggacatctcggtagctgataaaagaaaaaaaaaggcagaaaaataactatcctctatcatttttctcaaacaaataaaagagagcagagaattgtcatacttatcaataatcactctggtactactgaagcctgaactcacattgcctattgagacaaaatttggtttgatgtcatacatatcacaccgaaacatggttcccattcttccaaatgctataatgacctataaatgaataatgatataataaattttacaccaagtaaatattgcaccattcagaatctctctaccagaaagaaatattcgagtacctcatatgatattaacaatatgtcatcttaaggacaaaccaatggcgcgcctcctgtatataattcgattgatgacataacttaaaggtacatcgatctcttaaaaacatcatttttaagatattcagaatagccagtgcacccttagcaagcaaatttttcaccaatttcctcatttgtcgcgtaacacaatactcagtgtaccctaagctaaatttggatttgtcaataatcataagtatattccttaaattgcaaaataaatgtcaaaaaaagaagataaccgaatatttaactgaagatataaaaagaactgcttcaatccaaggagctaaaacattttccctttcagaactctagaaaattgcttccatccatggatataaatctttcatgtgtcatgtccagctaagatatggcagcatacaaaaaaacgcaatttatcatttcttagatagcataaaaggaataaaggcttcttaatgtatataacataacatactaatgcttgttttaactgcagttgactccattaattcaataaacaatgtgtgatagggtcgaatgattccatgtctattagtttggctaggaaactcccatctgacgcaagcaccattgtactgctaagatttgggacatatttttggaaaattttaacacaaacagtcagaagcaaccggttaaattacagcattgaaaaaaaaggaaaatgcttctaaaatgaaggcatgcatgccctcacatcagatagggcaatcaatgataattcaatgggtttgtgagatccaaaatacagttacaacatatttaaacttagtaagataagcatggctgaaacatgataacaattcagttcaataaaagtgagcgcacttcacaaaattgatcataaaaactaaaaaaaatatataaatctttcaacattgaagcttttctttcattgacaaattgcatatttaggacccgggaattccaaacaaacaaaataaagcatgaaagtgtgcaatgaacatgtagccaatgttttatgaatataattacctaatttttgtaacactttatttatccaaaagtgcaagtggttagttgaagctaaaactataaatacaaatctttgttaggtacaatagcaaaacacttgacatcttcctgtaaatgtttttatcctagactatatatgatttgtgaagacacaaagcaaaatttgtagtgtctacactattattagtcatagatgttgtgatgtgagtttgcataaatatgtcacatgtcatgcaccgctgataacaacataaagagaaagatgtaaatttgaaaaatgtttaaattctcaatggcaccatacatcatgagaggtaattggtagaactaatatgaacctgacatcagcccatgggttaaatggctaaacatcatccaagtttttacaactaaagttgtatacatgtccaagtagaaatatccttattcttgatctgtgtaaattcaacaactatagaaaaggacttttgtccacattttggtcagtaaatacttatggctaatggctagtcctaatcacgggtttggcatcagaaaatgaacatgcttactatatttcctaggtggaaatatggatctttttccccaccaagaagataggtttgaaatacaaagtatactatatggacaaaacattattggagaaacaattgtaagagcaaagaattcaattaccttggccccaagaaccgccatgatactatcagcagcacatggcatgttgttgatccaaaccaacacaaatggaccatcaagagatcttcactctgatccttaaaactcaacagaaagaccttgataagaacacaaatactttccattttgtttttgacattttacagtgcaattcttgagttggttgatggcatatccatacaccttgttgcctagggcagcaatgaagagaagactcccataatattttctcagtttattatgcgaaccaaagcctgaaacagtgcaagagtattctaaggattgaagaaaccattttccaacaaatattcagatattcttgaacttcctgctgagcaatcacattatttgttgtaactaacacgtctagaatatgagtaatgttgagaaaattgagaacaaccccagggaaataatagtaagcaatttttaggtgaaggctaaaggagtaagttcatagctaaaaattttgcctaagcttgcatatacaccatattgttaaatacatttttatccctgaggcctacacactacatatttgcatgtatggcaaaaaggtgcatgaagacaggtaatccaccaatgacaggtgattgagtcaatttcgaagagaatcaagctcccaaaggaatatataaaccacagctttacaaataacgcaaagattcatgagccacagcaaaatagcactcggcttgattaaaagaattaagaattacacgccttataaatataggattatctattccatgatagtcttgtgtgtctttcttcagaataatggtactacactgaaatagaaaggaaaggaaagcatcttgattctactctaattccgatgctatgtttaaaagagggcatgattatctaccattccagcaacttctgcctatgacatgctaaaacacttaataataccttcacagagtagaaattataaatatatttacttcttgtatgtcctacctacaaataatgcctactcttatccggacacacaatatccccatattgtccaagccaagaataaataatcaataggttagttaaaaggagtgtcagcctactgcgttaaaccaccaaaaatgaaaaatctatagtgcaatcaaaaggatcttacaccactgatgggacaatgcgtagcaagtccaagttcgattatatccgctccattaatttttcaccaatcaaagccaaatattcacctgcaaagggtcaatggtgaaatacacaagttgaataaaagactcaggtatcacaaagaaaaggtgggaagggatatcaattatttttggaatccaactaaagggaaaactggatagcaaccaacatgcccggtcagatggaacaaataaaatgaggaaacaacaccagggcgcattaggaaacaatagtagggagaaatgatacatatccgatccccacaaatcttgcacatgagcagactacttggtcatagccaatggtgccttggccaatatggaatgcataagaaaaacaccataactacaaataatttgcagcttttcagaacagaggtttctgtgcaaggaactctatagaaggtgatagcgataatctaatgagttaaaaaggagtgagatgaattagattatattttgcgaggattgacccttattgagcaaaaagcccaaaagtacacaaataatttaagaaaaagagcagcttgcaatgaatggaccagactaccaatatatcatagcactatagatcatgttgtcttaacacacaggtacctcatctccaatagctattttctgaaatccgagaccaagaatgtcatcgaattttgcaaccatgaaagtatatggcttggctcctttataacttcaatgaattcctaaagcggtgaagcaattcctaaagcggtgaagcaacagtgctaaaatattttggagtatatgatcagagatagtcagtgactgagatatatagtgcatacctgatctttcacaaccagatcacctactgtaacactatcctcgttgaaaaacccatcaactgaaccagtgccatattgaatggcagctggttttcctggagggatcaaacaacagaaaacaggtctgtaatccaaatttgtgatataaaatgattttccctttcatcttaaataactaaacaattcataaggactaacagtataactgccaagcaaatgtgtaattttcaatgcatatctgcaaatcaaatatatatctttttggtagattattttatagaaaaactttaacttgaacaaaaccacttagcttcaacctcctaatttgattcacactgtaatccaaataacataccatctagcatcatttcgaccaaatgcaattttgctttaaaaggttacatttcaacatgacatataagatatcccaccagttgtagagtaaataacaaaaaaaaaatacaggaggaagttttcagtgcattcaagtagtagtatatacagataggcagacagttgcaaactcacaacacaaatgcacggtttgggaaagttttaagacacggaccattcttgcgataagtgcttggctgctcggacttgtagcgagtggaaaaagcacgcgatctgcatcaatcgtcaccaggaaaaatccatcattagcacaactgcacaagtcacaacacagagcatgcatttcaacaaacacttgtagggcaatgagtgattagcatcacctcactcagcagagggtggagtcagtctagcgcagaaggatgacgttgcacagtgctgacggcgagtccgtggtactggcaacctcacatagaaggaacagcatgtcagcgaaccaaagggcaaaggctgcagcactccatcgtcgatggcccggcttagctcgaaggctgttaccacatctgcatccatccagtacgtctgtaggaacctcagtgacacaccaccaagcagtttgcactatacaaaaatctaaatagaaaaaaaagaacttcaacaagctcagtaatatgacatgaaagcaactaatcagcttatctcaggaaaaaaggggaaaacactcacgcccttcttgaagctcgacttggtgtcttgatggcagcggcaagaaagcaacataggtggtcagattccttagcatcgacctgggacgaacagaccttggggcccttgtagaagagcagatatggcgctcatcgaactgcctcaccgtcggtcatcatctccgccccgagctccacccg

SEQ ID NO: 30712 - DNA, 5878 bp, Oryza sativa
ctttaatgtctgacattttttagtttaaacattaagaaaaacaaacagagtagttatttaggtaaaaaataatcttattgtactgctcattgaaaatgtaattgagcccactatggtgctctatactataaaagtagaaatcaatatgatctattatctattttgatcgatgggttatctattcgtactattatcctaattaacggtaatagaaacatggaggaacattattataaaaaatcgtaatttagtagtgactaaacattttttttctcttttatatatatatatatgggggaaaaggtaaattaacttgtgctacatggagtatgggatccaagattcaaattgagtatatacccaatttgaatgagtatgaattttttttaaatgtttagatatgaacattaacttctttactaacaaggagtttgaacttttttttttgttagattttgattctaggtatataacatccaaacatataatttgttaggtatgtaataatgaattgtgaaacaaagttgagtttgagttgttttgttgttaggtatttgtatgaatcaaattcatatacctgatatctacttacaatttgtaaatttttaaaaatttgagagaatttgtgtgttttataccttggagcctgggcaccatgtctcccaggtgtacgtactcccggttgcatccatcgtccatctgtagcaggcgacgatcgaggcatcgagccaattatcggatccatccaccgaacccgttttgattttttttcacgaaaaaatattcagtaatcgttaatttttccaagactaatcggtgaaattcagcaagaaaccgatatatatccctgattcccagcaagaaatggcaacaactcgttctccccacccaatttacggatctagcgcgatttactggcggctcagaggtagggatgaaactggtttggatagtttccgtccgtccggatcatttttcggattcggatagtttcagtcggaattatccggaaattctcggattcggaaacgaattcagatattttttcttggaaacgaaaatgaatacagtaagggtactatccgtcggaatccgaaaacggtcggaaactatccggaattttttcggatatccgcagacattgagtaaattatataaaaaacacgtatatatatatataacttttttatacggaatcagacgaagacaaactttatattaacattgtagagctcgatgatatttacaactttattattgactattttattattttaggtcatttatgggtctaaatattcattataatataccatattaatttttacaaaatctcagatctacaattcaacgacatctaatggagatgtgttccataccaaagttgtagagctcaacgggatctaccactttttagtttataacatttgtatttaaaagcatttaaagtataatacaaagaatacaagttttaaagtaaaataaataaaatctccaatttatacaatagtaagttatatatcaagtaaaaggtcttgggaatagaaaacgataatcatatttgcatatggatctcttagaggaacagccatgaaaatcgattttcacatacggttgtgagaccgtctataaaattgacgatataaatgttggagatgttgaactaaaataataagcgatatctcttccttgatcaagaaactcaatttgaggggttttttatataccggtaaatattcgctaccgtattcgttccgtctcgtattcgctccgtatctgtattcgataatattcgattttatttccgtatccgagttttcgattccgattccgatcaaaaagaatatgaaaacgaatatgataaagctagtttccgatccgttttcatcctactcggaggcggcagcataataaattggtgattcgacgatggcggcggccggccggatgcctggagccattaatgatttggtggtatagggcgatccatcggcagggacaacaaatttatctcggttgtgggtgccatcgcccatcccacccttctcgggtctggatcacctggagttgcaggcaaatccaccgggtggatttcacctaatctgagccattcttttacttctatggctgagatcatcttttctaattaacaacccttataatcagtttaaatcgcagtgatgaccgacaccagtggcatcgctaccgtgataatcatgttcgtgcactgtcatgcatacacgtacgcgtcacggcggtgttgctccagtgaactgcatgtccaaaaatgcagtaactttgccggtcgtccattccagccggcggctgaaccacttgtcaaccaaatagacacatcggcaccacaccgccgagcgcttgctcatgttctgctagtgatctcagccaccaccattatttgccgctcctgtgctccactaccactgcaaggtgatctcagctcaaccgtgtcttctccgttttgtaattggccctgaattcttgatcgatgtcctgatgtgtgctcgagctcgacgcgcggttcttgttaacaattcgggatagtgtaacaaacgagtaaggtactacagaataagaaccaccctggcttaatcatgaccctagaaaaagacaaacggtccagattaggtgaaatccactcggtggagttgagtccaactccaggggatccaccgttcccacatcccacggcgtcttcagatttggtttctccgccggctattcaggaacccatgcatgtaacagtgttttttaccgttcttaattcttgattcattgtgtaatcacctttcttaatcacaccgtcccatcttaattaattgcctttgatgcagatcgatgattctcttgtatatttcttatgatccctatgagtggtctgctgcatttttttttcataattctgtatattctttagtctgtggaatgatgaagctccctaactccttgtagaagcgacacgtatataatggttgagctctgtttttctatgtatagatgttgcctgtggtctgacggctggccggtggctgttcatgccgacccaaagaaagcaatccggcggcatcagtaaatggtgaatattagggaagggtctttgtttagaaactgtaattaggattgtacgttctttttaatcagcgtataatgtttcaatgttagcctaaattactacacatctttcatggaaattctgtttttactaatgtcaatgacgactagttcttctgttggaaatgtacatgttgccttctcgtatctttgagaacatactgatacttgaatcatcatacttgcatgtagcagctgttatatgttactccctctgtttcataatgtaagtcattctaacatttcccatattcatgttgatgttaatgaatctagacaatatgaatgtgaaaaatgctaaaataacttacattgtgaaacagagaaagtatgtatattatgtaaaagtaagtatatactgctactaattgaaaaagacagtagatacttgtacgaactaattaaaatgagtacatatactatctactaacttaaaaaataagtatgtactactaacgaaaaatcagtatatactactaactaaaaaagataagataagtatgtagtactagctaaaattcagtatgtactactatctaaaaaaatatatactgctattgactgaatataagtatataccactcctaattgaaaaataagtatatactgctattgactgaaaaataagtatatactactcctaactaaaaataagtatatactgctattaaataaaaaaaaggatatactactgctatactactaagcaaaaaggtatattctagtactaactgaaaatatatactactatactggatccttaaaataattacatgtctcatggattgcatgctacaatgtgcacatgcaccttgaattttagggatgtatcgttcagtacctacctggtaatcttaagtggtatatactgaactagtagtatatgctttcgtttatatctagattagaaccgcggctcattcaaatatttttctattctagatattctcatctcaatatatgataccttctgcatcttataggatgtactgatacttttggatcatcatatcaagtccccaacaaaaacacaattataaaaaaaaaagtatatactgctactggatattaaaaaaaaacgcatatagttcaacaaccaaaaaatctaatacgtagcacatactaagtcatacaaaaaaacacagtatgtgccgtatactgaaaaaggaaaggcatatgctctttcaacgttggttctggtacataccgaatattatgaagaacaaaaatcgttctgcatatctaactactttgcatgcaacaggcggactaatttacgagttgcatgcatgcatgaattgttacatcatctatttattaatcattttgttttttcaatccggttaatattggatgatccactatcaggtatatatataaaatacacaaatccactcaaaaattttaaaaattttcaaattgtgagtatatatctagacataaaaatttgattcatacctatacttagcgacaaaacatctcaaattcaactttattttatattcaattattacatacctaactaattatatatttggatgctactccctctgtcccataatataaaggattttgatattttggttgcattgtttgaccactcgttttattcaaaaaaatttgtgcaaatataaaaaacgaaaagttatgcttaaagcactttggataataaagtaagtcccaaaaaataataattccaaaattttttgaataagacaaatggtcaaacagtgcaagcaaaacgtcaaaatcccttatattaggggacggagggagtatatagctagaatcaaaatctaacaaaaagatgttcaaattcagttcaaatttgtttgaactagttagtaaataagttaatgtttatacctatatattttttaaaaaattcatactcaattgaattaagtatatactcaatttaaaacttggtgcccggtcaccataaagctccagttaatgaaaaaatgtttcaattcttgaaaaacagtgaaacacagtcaaatcagtagatgaaacaaatgattttaaggactgaaacactaaaaattcacaacgcacacatccactattctgatgctcctcccttgtgcgctcccgacagtgaagcgacgatgtcgtccttgagcatgctagtcttcttgatcgtgagaaaagaagatcaaggatggccgctacctagttctcgagctcaagacaaaaaaaatcacataacaccagatcaacatcatgttctccaacactggctcaacatcagcgccagacctcccccttccacaactacctccttcactcgtgcgccacagagataaatctagccatccccaggtcacaggctccactgtgacctcgacctcatcccaccgctgcaacgtcacctccgacgcctgcttgtgctcatcgtctagtcatggaagaggggaagaggagagagtgggagaagagagggagacggagaggggccttgcctcccaagctgccatcgctcaccatccgcggccatggaaaagggaagagagggagagggagattgagataaaaaaaatgagtggctgagaattgaggagctcatgttatttctgtttttgttgggtatattggcacagacaaatcatgttcttttaattaattatgtattaatttgttgagcagatagaaaataaattaccttgacatttccagcttctttgatggccttgacgagcttgagctgcagcaagatgttgtggctgcggtggtggacgccggacat

SEQ ID NO: 30713 - DNA, 10168 bp, Oryza sativa
catgttcttttaattaattatgtattaatttgttgagcagatagaaaatttaccttgacatttccagcttctttgatggccttgacgagcttgagctgcagcaagatgttgtggctgcggtggtggacgccggacatggcggagacgacgacgtccacctgccggacggcggcgacgaggccatcgtggtcgtcgagcgacgcctcgaggagccgcgcgccctgcgccttgaaggccagcagtatctggagcttgtcgatgttgaggccgatctccggccgcagcaggacgaaggtggggtggccctccgccaagctcgccgcaacgatccgccggccgatgtagccgctgccgccgacgatgaggacccggctcttctccatggccatggctcccagctctgatgagtgccacaactgaccacgctaccgtgcagtcgactcgacaaagctttactgccgattgcggcctatatgtattagcgtgtggtcctgttgtcgtaccaactgtgtcagcgattataatttatcaatctgactgtggtagagaggtttgggggtacgtaaataacaaagcttgaatctgttggtttggatcggcttgtttcagctccgcgttcatataaaagtactgccccctaatactgttaggatgcgataagcaagcaaacgtaaaaaacaatagatcaatcacagaagacacgagatttaacgtggaaaaccctcccaaagcagaagagaaaaaaccacggacgccagccagcaaaatatctttactatatctggggtgaggttacaatgccgcacggcggtttacaagaggtatatatatggtggaaccctaaaagggatgacgatccgtacgctccggcccaagcctccctgcgacgggcgtccgctccactacggcagaagctagcctttattaagtgcaaatgaatttggatcacaactcaacaaatacaccattatagtatttctactatacacgcttaagaatcaccctattctaatgtcaagttacaatcacaattcacaagtaggagctaaaacatgatgggtattttcctcccacacgcccgtccatattaattcgggataaaaaaaatagatacttaggggtatatatattcagatatatatgcgagtcgaatctgggtattttttcaatgcataagtgatcgggttagaaaagatgatacccaatggataaagaggatgtgataaaacatacggataatacctgctaagctattcgggtattagccggatagcgggcccaatagcaaccatagcacatctgcacatatatagcttcaagtctaccctaattaaacaaaatactaaaaggcctaaaaggcacactcctcaaggctctagcagtccaggcagcaaaaattttcacaatttgaccctttgcaaaaactatttttacaaataaatcgccaccaaaacttatttaaaaaatgacccttttttcagcgtcaaatcacctagtgctgaatttagacacctcagcgccacgtcaactggcgctgaatgccgtgccaccgcaaatgggagactaagtcagcttgccaactcatattcagcaccacgctatttagcgctgaggtgtctaatttcagcgccacataatttggcgctgaacataagggtcatttttgaaataagttttggcggcggttcatttgtaataatagtttttgcaaagtgtcaaattgtgaaaatttttggtccaggcagtggcaaaactctgcctagtgatgctgttgttttggtatctatactatctatatagttgataaccactaactactaaaactaatcatgcaagtgtgtcacatgatcatccactagcaattattattaagagtattttaaatcgtatataagtgtgccacatcatcacccactagtaattattatctagagtattttaaatatcatgcaaacataacatatcattcataattttattgtatttttagagctcaatatgtaaataatgtcaaatcattatcttacattatttaaacatatacatctaccatttctataatatataacatgcattcattcacatatcccgtagcaaagagcagagtatcaactagttattagacattagtatgccctaagctcttaacaagttagcatagctttggtccatgtggcataggtcgttgctttaactcagtatccgaataagtattccagtcgaatagtatttgcatctgtcttagtacgtattcgctgccgatgatatttgtgtttgtatttatacccgatactatccgtatccgtcctaattttaattacggttagaatatgggaagggtaaaatccaacccaacccaatttctcccgtcatcacgagggctgaatcctcaccctcgcgacacgactatggcgattactacggaaacagtttcgacaaaaggctatgtggcccacctctatccaggtgtgtgcgcgtggaaaatgaccatttttgtgtatggggcacttagccgagtggggaaatagattattcccgacagaccgcttaagatatctgattgcgataataaagtttgcaggcttctacgttaagcggtccacctaggatgatgtttttcccatgcggccatgccaaattagggcctcctgagaagatgcttcttagatatatatatttctcagctatttttaatcaaaatatttttttaactgaaatttcccagttttatattggcacaattctgtagtattactatagactctagtacttgtcaatatataaatattgaatatgtacaagacatataaatattgttttgtgaacttgattacaaattatcattctcagaccgcgtaatagtaaagtttcattacatgtgttttctttcccactatataaacagaagataaactttttactcatacgtgcacaaatttatatcagtttgtcctaagtttattcaatttatgatatatatcgagttcttttaattaatgtttttaataataaatagaaatacggtctctatatacaaccaaattaaaatcaagttttcttaaattatttactaaatggtcgtgtttctagaaaacaaattacatttccagattctttgatggcctccacgagcttcagctggaacatgaggttgtgtctgcagaagtggacgcgggacatgacatctccggccggagcaggacgtagatgtggtggatccagttcctctctacagcacagcagagaagactgtagctacagcctccacctccgtcgccaccgtcgccgcctgtttgtaccataatttggcttaaaattagtttatctgagcaggccaaattatttagaggagttggtacatttatctagaggtttgctcgagagttctgaaatatatatgtgtgcaggaatttgtgatgccctgcttggatgatttgtgtataatgctgggtgcagcagcaatttatttggtttggacttgtcacatggatgcagcctaggagagatttggcgacggggatcaatgcttgattgatgattaatttgccgagatgtgctgctgttgccgcacgggactggaggactggcattagtagattgcatgagaactatatattccgtttgttaatatttagatggagtcggattctgttagctaatttgttggagtttccatgtacgctcaagcggtgcggctgggggttctggtgctcctataaatattagtgtattaggttagttttgaagggccccgaacaaaattaccaatctattattttcctgttctttactttcatgttattttctattttgtttttatggctaagttctggcatccctagaatttagttaatctttgccgttttgcgctgaaaaacggtcgtgcttctccacgaaagcgagaagattatcctttgctagtttgctcggaaactagtcgttcgtcgtcacgtaagtacgatatttatcctctttgctaatttgcttgtaaattagtcatgtgattccgcgaaagtgaattaatctcgaaatcggtttcactagccgattttgatctatcgattttggcgactctattgtttacaccgcaagtcgttaggtgatcttgtgttggccatgaaaaagcgtcaacaccgccatcgcgtcgccgtgtccaacacctccgcctccctctcccgccgccagtccaccgttcgccgcctccgtttccgaccaccgccgtcgccgtctccatctccgctccgtgtccgcctcgcgccactgccgcctccgctgttaccggccacctcccgtgcggcacgccgttaccgtcgctgagcgcacaacctccgctgctgtcgaccgccttatcgggctgccggcgttcggatccggcgagggggcggtcagatccgtgtcccccgaccacatggaaggggcggcctcgggtggagcagatcgacgctggccacgaaggtgcgagcacggatggagcagttcgagcagccaccgtcgtccctcgaagccacaggtaataaacgagacaagccgcgcttccaggtttgtcgcccgcaccacctctcaacctacttatctccatcaatggagaacccccggaggcggagatcgggcacagggtggaggacctgtgggaggtggcagagccgcagctgtcaccgtccgagaagctcaactcctgcttcgaggacatcgtcgtcgcctccttcccctgcccccttggctcgcaaggtatgtaactaacgcctctccatgctgctctgtgaacgaacatgtttctgcgtattctctgatttgatcagatcactgctacaatagctatttttccgtgcggttgttttgatttttgcgtgcggttgttttgcccgtctggaacattgcgtcttgaaaaatcgtgattttcttgtgcgggtggtgaaaccgcacgcgaaaatccgactttcgcgtgcggctacttacgccgcccacacgggaaaataaaaatccgaaaaaaaaataaattttcaaaaaacacaaaccctaaccctagatccggatccggcaccccaccaccgtgccggccaccaccaccgccggatctgggcgggaggcagccgccgccaccggatctgggcgtggggagggcggcgccgctcccggccgcttcctcgtcgtcgtcgttgtcagccgcgcgcacgttgccggccgtcggctcctcccgctcccggcacacgtcgttggtccgctcctgaccgctgccttgccgtcgtcgttgccgtcgtgagcacgccacttccggccgctgccttgtcatcgtcgtcggccgcgcgcacgctgctcccggccaccgcctcaccgccgtcgtcgtcattgtcggccgggcgcacgctgctcccggccgccgcctcgccgtctttgtcgtcgtcggccacgcgcacacttctcttggctgcctccccacgtccgcccgccgccgcgagccctccgtgcccgccaaccgccgtcgacccctccgccgagagccgcccggaggagaggaggagaaggtgagacagagagaggaaaatgagaggagaggaaagtgagaagatatgggggagagagaggagagaagggggcgggggagagagaagaaaagtccaattttttttgaataggatgcgagggaagtgctattttccctgtgctgttagattaggaggcccgcacgcgaaaatagagttatttttgcttgcgggcctgttaagtgacccgcacacgaaaattgatttttgtgtgcgggtgacgacccggcttcgctccccccatttttccatgcggtccaacttacggatcgcatggaaataaaatggggtggcgtccaggaaaatcaatcacgtagtagtggatgattttagttcttcatgtgaaaactgacgtgaagcatttctgtcttgagttggagtcacctgcttattggctgtttgggaaacaaggacttattccaagtccctatcacatcggatgtttggatactaatttagaatattaaacatagactaattacaaaacccattccataaccttggactaattcgcgagacaaatcttctgagcctaattacgccatgatttgacaatgtgatactacagtaaacttttaataattatggattaattaggcttaaaaaattcatctcgcggattagccctcattataaaattagtttttttattagtctaaatttaatactcccgattagcgtcaaagattcgatgtgacagggactaaaactccccatctaaacggccctagttggatgatgaaatttgctgatggagatggtgaaacaaattaaaacattcggtgttccttgttgaaattgatacagccagttagttaattcattgattgaagaatgcgtttgctgtttctcctgattggattaaactggtggcattagtaccttgtcattattgtgggtctcctgtcctatatatatatgtattttctttcagcttcttgatgtaatggaggtggccactactttatactagtcttttcatttcctttgtgtgattgctggggccatatttgcattcttttctaaagcaaatgcgcatttccacttcgtgcatgtcagtgctgatggcctacatcctacctccagtctgcccaatttttgttctggttgaaaagggtggcactgttttatgcaaccagtgacaatgcaataggggattgtaggacttcagccttatctgaatgatgaagttttgttttagacaaattaagacctgtatgattgagtcaggggggagcatggtgattgctcttgttgaagggtccttttcatttcttagacacgctaaagaagaacctttctcccgtaaaaaaaaaaaacctttctggacttcctttttctttatgccaatatgtcgtatgttattaatatagatatgttctagaaccgtgagggtccatattaccgtctgaaagatcgtattgattaagtctgataattttcaagtccccaccatcctctgttagtaattctcacaaaaacaataactaagtacaggtttatctaaatcatatatgtacaaggaagtgaatatttcaatttaggtggcttggattgattaaactaaaagcagtaaagcaagcaactaattcaaacttaatattattattagggacccttattattattccacttacagtaatgtatctaagagagcaatatatttagctttattcaaccatatgttatgaacatcaccaacagaaagtgattcaacggaataataggtaaacatattactcactgaggcatgcgttaataacttgtgtagaagctcggtcattttcagctactcaatgctaagccgttgttgctgattcatcggctatttgtactctctcagccgctcaaggtagtagaaaaaggaatgattcatggagcggtatttatctgaattacttcggatgaaaactctgcctcccttagccattcatcgctcattatggattataactcccggacagtttctcgtagaaacccgagttccataggatcgggaggtgacaaaggaatgagtggtgtcttcttgctaaaatagttcagggtattaccgtagtcttcgtcaatgccgtccctgaacaggattgtggcacgatccggagtctgaatttcttcgttctcgacggacggctgctcaggaaccttctcatcattcgagctagcagaagtggttggttcagcaagtggctcaatcgttagaggttcctctatcttggacacggatgcctctggctggagttcattggactgcgtcatgaaggaagtattttctagaatgcgatccaaaattgttcttccttctgacggcgttttgtgcatgaacgatcctccagtggttatgtccagatagaatgcagactccttatccaaactcgtatggaaatgttggagaaacacatactcaggtaaggacaggattggtccggattgcactaaattagtaaatctggaccaggctgcaccgattgattcattttcgatctgcttaaaactgagaatttctacttgaagggcagtaatacgagtaactggaaagaaggcaagacagaatctgtctcgcaacttttcccaactactgtttacacatccaacggtagaggtgtaccattgctttgctatttcttgaagagagaatgggaacaatttccaccgcacagtttcttgtcttatgccacgaatcttaaggcatgagcagacttgtccaacgtctcgcagatgatggtagggattttctagatcaaagccaataaaaggtttttccctaaccatactgattagttcggggcggatttcatagccagttgtataaatgggctccgatgaaggaggtggctcatagaattcgccttgaggggaagacagctaaaaaagaggttgctcgatggtcgagaagagtttgacaggaatacttctctaggatagcaggcgtagaggtagaataaaaaagcaaaaaggatatgaggatgaacaaggtccggaaataatcagcaaccgttccctggcaacggcgccagaaatgcttgttggtatttcttacgatcacagacaaaatccgtaagcgcacggatataccgatgtagcacttcccctacagagtattccaagggtatcgaatccaagggaacgtgtgtgataagaccttcctccagttcatccaaggacaccaagcaaatgataggccaggatagagaggatttactagtgagaaacagtgtttagggaaagctgaactttaatcctaatgcaatacttcaggcactggcaacacgctattcccagatgtcgctctactacgtacccggatagggaggacttaagtgatcttgagggttgtcaccacctctacacccacctcaaacgtattgtgggatacgcagcaattactggataacaattacctaaacaccacgtctaagcaattactatctactttagtgtttataactcaccaaagcaatcactatattttagttgattatagtgaacaataatcccgtatgctacttaggaactaaccaagagataattctcacaagataaatctaaattactcaagaagaatattatattgaattcagagtaataaacagaataaaagaaataggagaagattaccgacaactccggaattcttccgactccttctactctactctcttcctattctagtatacaatatagtacaatagagcctcttataattcagctcaagctcgaaagtgtgtgtgtgaagtgagggagtgatgtctttatataggggtaggtatgacggttggcgaagaggaaatgtccgaaatgccccgcaaccgccattaggagatgatcaggatcgtccacgccaaaccccagcctggatggctgagattgtggttcggccgaactagggggttcggccgaacctgggctgggcccatctggcctggcctttagcccatgttctcccctggtcctcctctattcattcttcggtattttgggctgattcactgatgttttgatgaagttcacaacccatccttgtatggagacagaattctcctcacttaagtctagatttcctcccaacatcgaggtttatcaccagcatataaatatataccaacatttgtggaatatgtgagatttaagcacctatcactatattggatgttttattatccaaactttatgcagatgttggcggtatagaatcggcatttaacagctgccaacaccaaccctgttaacgaccaaatttggtaatctgagtatcaaggatagagatcagatcgaagcggatcaaatcaactggcacgctcacacacccaaaggcatgttttggacctgcactggagttaagcagatctctcagtcctcgtgttttacatcaacaaaccctagccgccttcgtgtgcctctcctccttcccctcgtcccgtgccctcctctccttctcacgtcgccgtcgcctcctcctcgcgccgccaccatcgcgtccccatactcatcgcctccgtctccacctccgtcgctgccgtcgtgtcgccgtgtccgacacctacgccttcctctcccgccgccgtcaccaccagtccaccattcaccgcctccgtttccgactgccaccgtcgctgtctccatctccgctc

SEQ ID NO: 30714 - DNA, 19367 bp, Oryza sativa
agagagagagagaggaaaatgagagaggaggaaagtgagaagataagggggagagagagaggagagaagggggcggggggagagagaagaaaagtccaaattttttttaatattatgggagggaagtgctattttcctgcgcttttagattaggaggctcgcacgtgaaaatagagttatttttgcgtgcgggcctgttaagtgacccacacacgaaaatcgcgggtgatgacccggcttcgctcctcctatttttccgtgcagtccaacttacggaccacatggaaacaaaatggggtgacgtccaggaaaatcaatcatgtagtagtgaatgattttagttcttcatgtgaaagctgacatgaagcatttctgtcttgagttggagtcaccggtttagttcagttgggtgatgaaatttgctgatggagatggtgaaacaaattaaaacattcggtgttccatgttggaattgatacagccagttagttaattcattgattgaagaatgcgtttgctgtttctcctgattggattaaactggtgacattagtaccttgtcattgttatgggtttcctgtcctatgtttatacattttttttcagcttcttgatgtaatggaggtggccactactttatattagtcttttcatttcctttgtgtgattgctggggccatattagcattcttttctaaagcaaatgcgcatttccacttcgtgcatgttagtgctgatggcctacatcctacctccagtctgcccaatttttgttcttgacaggttgaaaaaggtggcactgttttatgcaaccagtgacaatgcaataggggatagtaggacttcagccttatctgtatgatgaagttttgttttagacaaagcctgtatgattgagtcagggggagcatggtgattgctcttgttgaagagtccttttcatttctgagacacgctaaagaagaatctttctcccgtcaaaaaaaaaaacctttctggacttcctttttctttatgccaatatgtcgtatgttattaatatagatatctgcttagtgacaagtgccttcgctctcatgattccaagatatgttctagaaccgtgagggtccatattaccgtctgatttcttaattgtgataattgctataggactgagcagcaagttatttgggaaaatagaacctgtttagacttgtccttggattaatttggtacgtcattatatgccccttggacatgaaagatcgtattgatcaagtctgataattttcaagtccccaccatcctctgttagtaattctcacaaaaacaataactaagtgtgtacaggtttatctaaatcatataggtacaaggaagtgaatatttcaatttaggtggcttggattgattaaattaaaagcagtaaagcaagcaactaattcaaacttaacattattattagggacccttattattattccactcacagtaatgtatctaagagagcaatatatttagctttattcaaccatatgttatgaacatcagcaacagaaagtgattcaacggaatgatagataaacatattactcactgaggcatgcgttaattacttgtgtagaagctcggtcatcttcagctactcaatgctaagctgttgttgctgattcatcagctatgtgtactctctctcagccgctcaaggcagtagcaaaaggagcaagcgcggaagaccagcgattgccagattggtctcactatggaccagatctggtttcttctaagagaaacttcctctgctactgtagacaggtgtttttggcctttatatacatgccacaaaatgatctttactttaatcatgaactcagtgccatgtatgattagttatattgttcaaattatgctttctagaagttaggcaaggtgctttgggaatattttcctccatcgaggaaattaaacttgggtggtgtacatattaaatgattaaactgttaatctataagtttccgttcctatagtttgttagttgctaccatttttcttggtttcttcggttcatcaaattgtctatttcctataaatttcaattctcaccagtcaccgtgtgactgcataacatttctatagttacatagccaactatttaatttcaaatcagcatctagcaaccattcttgatacctagaatttatttgcgatcattctatctgttcactatatggtgcgttacttcactatcatttcttccatttccttttcttttacaattcttttttttttgacaccttcttttacaattcttttgagaacaataaacttgattagtgccctttttttattaaagatgggcatatatctatacatcgttttgtgttttatcataagaaaactaatatgacgacatctcactatcaatcagattttttccttcatacatattctaggatgaaaatttcacaggaagatctcgactgttttgctattatacctagaaaaaattgcatattatagtagtagcttgactatttgattgcttttttggtcaatcagagtgttacaaatatgtaactacactcataatctctatttgccacatatccattgcacaccttccttttttttttttagaattctgaagaaaaaacatgaaatttttcagtgggacatcgccgcattgccaatcatctatcctgattgttaggctaatggtggggcatcaggtataggttcatgttgttaggtgctctcagaccatatacgttctttcatccatttttggttccagccattgttttatacttttgatgctaataatggtcacatatacccatcttcaactcaagcgatgaaaggtgtttacttttgcattgctactgtattttatttagcgctttccactaacagaatatcatcttcacattgacagtcaatttgatttacacacattttctttgctttagtgtaggaaaaaggaaaacataattattacttaattatcctgtaaatttcttacccttcatgcttaatttcgtatcaatctaaattctagggttcttttactctcgctgcattcccatgtaataaacacaaatctgtaatatcgtgttgtatcacttgatataactatcctcattgtgaaatggtgtacatgctggtttttgaatctcaataatttgggttgctttttcacatgattttgttgaccttgctggaagtgaacgagctgcacaaacacatgcagttggcgcaagactgaaagaaggctgccatataaatcgcagcttactgactcttactactgtcatcagggaactaaggtctgattttcttaaaaaagagaaaaaaaaactctgggtctgttatctcttatctgcactaatattataaagtagtcgctgggttacctcattgcactcatgggttagtctcagttctaatgtcatcagactgttatagatcattggatcatatggattagatccttctttacaatttttatgctcttagctggtagatcattggatggttagtatggtcaattatgggttgtatgttaatacggtgccatcaaagcgacactccaagagaagcagtcgagaagtagctagcgatacaagaaagacaccaccaataacaccagccataaagatcgcaaggttaagagcatctccagcaatggaccttattttaaagcccctaaaagttaaatgagggctgcccccatttcttaaggactaaaaaatgtctccaactccagcagtagcccctatttcttagtccctactcatgtttatcttgtattttaaaatacaatccatatacagtacgtttaacaccacaaaaattcgaacacaattatttctaactcacataatataaccatacttaaattcactatttcaaacactacaattcgaattcaaaattaaaatttttaaacatgtaaatatggtatgggtacagtgccatatacaacaacaagatgcaaccaagattcgtaattcaccaatgaaaatgaaaattcaccaagtttccttccatctctcttctttcaatttcgcttctttctctttagcgtcaagcaaatctttcatcgcctctttgtatggtccatcttctcctccgttcttcaacttctcctttgcttgcttcctacctattggtctctttttagcactcggctgagataaatcaggagctgtactcttgctagcatcatctccttcatcttcttcaccagctctgtcaattggggtcgaagacttcctagaccgtggcctcttgtgggattctagtgtttgaaactttggagaattcctcaacttgtgctaacaatgattaaactgaaatgccctattctttggtgcattggacgagtataatgcctcagcttcaagaacttgcaacataatttaagttttagttcacatacatacaagattgttattaataataataaataaacaatttaacttacaagctcttgatgtggtatgccactgggatgtcgacgctcaatttgattgtagcaaccctgaaacttgcttacttccttctgaatgttaccccaacggtgctcaagagagtttgcattcctatcagactcaaaatcacggttagcatggtagtgctctgcgatcctctgccaatatgccttccctagttgctcattaccaataataggatctgagctaatgctctgccatgaaatgcacaattgaatgtcctccttatgagcatagttgcttgatcttttggcacttccttttgcaccatttgttgaagtatgaaggtcttcatttggcattagcacttcgacatcagtatccttggacatcatgcgcacaaaggaatcacctccacttgtcattgcaatctagtcactgcaataaatatataaattgacaacatttccaatctatctcagaaacatcaacaaatgattgtaatgtacatcaggttatactgtttgcaatatgtatttttttagataataatatgtatttatttagcatatatattggttccgcagtactaaggactcagtgcaaacacaaatttatttcttcaatattatatatgctccacaagattagctctctgacatagaacaagacactgcatataaaatatgaatgatgacaatgtacattttgctatgcgaatgattttgatgggcctagacgcctagtaagcccataaagatcacaatcaaacaaggagactcagacatacgaaactgaactttactattgtgatttgttttaatcaccatcatctctgaatttttttactgcagcatgtgtgcagccggtgatagatagctgtcgatggtcggcgctaggccttgtggacagcgggtgagcagctagttcggggacaacgtcgagactcacctaggcgtgatcaatctgtgacgacgcgcgttggccggagatgcaaggaggtcggcgacagtgagtgacggagtaaaaccgatgattgtgatggcttgaggcggcacactgtgggatctcgccaaagtttcttgcagagggatgtcgggtggtcgccggctggagcaaaacgacctggcggcttgctcgctgggaggttgtgggaggatggcgatgatgcgggagggaggatgacgatggcgcgcgatcagaaatttcccccgccaaaaaaaaagaggatggggctgtggggttgagccccccggactgggggctaggagtgatctaggggcctccctagattgggggctctagtagggactctgctggacctatattttttgcatcaactctcaaaacttatttagccacactacgtaccaccacaggatataccagtacctcagcctcggcagactcctacctccgctgccaccacaggtggccggcgcgtgccctcgctcgctagctgccgtcgcctcttcatctttttgtcgtgcgtcctgtccgacgcatccaccttccaccgccgtgtaccgcacgtagagctccggtgctgctgccgcttggtgctcgatggcaaacggcatcgatcccatcggcaaccaataacacgacgcgaggagaagccaagaaggtttaaaggcgacgcgtctgtatgtaccgaggaggaggagagggcgaggagggtgttgccggcaatggtgctgccgaggtatatggcccgacaacaacgtagaaggcggtccattaaaaaaaaacaacgtagaaggcggcgatgaggacagcgaacaccccatgcccaccacctttggaaccatgaaatgagaaccgtgagggcataatccagggatagaaaattcgacgggggaggacggtggcaacttggagggaatggagggggagctgccagctgcctagccgtggcggcggcgccaccgtggccgagccatcgccaccgtggtggattggccgtcgcccattggtgatgccacggtgagatcagcgactcgatgcagatggacacacaccgtcgttgtcaactctgttctactccctccgtcccaaaaaaaaaggcaaaccctgggtttccgtgctaatgtttgactgtctgtcttatatgaaatatttttataattagtatttttattgttgttagatgataaaacatgattaatactttatgcacgacttatctttttaacttttttcataattttttcaaataagacggacgatgaaacattggacacggaaaccagtgtttgtctttttttctgacggagggagtatgtgcaaagcgtttttttttttgggggggggggggggcatgtgaatgtgggggttgtgaggtgtgtctgagaggtggggtaggggacgcagccaacggtcggctccagccattagtattccggctgtttgaatttcgaattggaggtttggggctcgggggcatctggaccgttggatggtatactgtcggccagatcggaaacaaagtggggctttgactccctaggccccagtcctgttctattcacctattccatctatttcattaaaaccaacataaaataaatagaatatgaagttttaatgaatctggacaggcttctcaagtaacggctatatgtggcatatgaaaatatatcgaacatgtgacgcttaaaatcgaaccaacaacaccgtaggcaggagccaaatcggtgtaaggcaaaattaaactatattttcgagttgaatcatctgaataaaattttttttaacattgtccaatggactcaactccatctgaatagaaaatggagaagcttttagttctttttttttctgtcagtgcggcccatcatcaatttatacaattgacaaggactaagatcctgatcttccattagatactagataagtcgattatggagactcaacattgatgatcgaacctctcgcaaccattgcaccacgattatggagactcgacattgatgatcgaacctctcgcaaccattgcaccattcctccgttggttatcgcccgaaccgaaacacagatgacctcgctgataaagctatttcctgcaagcgaatcgagaacacaagcaatagagtagaatatgcaatatgaatatattgcgaatttaagatgaatctcacaagttggggttccacaaaccgatgaagggaaaaactgcaatatcagaataatctaagcaaaaccccccctaatccgatgatgtctactaattaagtaggttctagggtcgacctaggacgtggatgcatccctaatggactccaacacaatacacaacccaacgggcctaaagatggtgacacaacaccctgacaaattctggacgctctcttgtttcgaccatttccgttgactcagaagaaattttgacgtgagacctggcctattggaaagatggtcttattggctttccatataaatgcacggacgtcaataaagaatccgaataaggtctgaccgatgatcttagtgcaaccttctcctggataacgaggtggactcaatatgaattgggcctccacctcctagtctcgtgcgtatctaaagtagtgatgtcctcgtcaacaatacaataacactcaatgaatcaaactatacactacattgcgctgaatggctcgattgtacattagagttggacactgggtatccatacttgaggccccgtctgcaacacagagaaacaaaacacttaaaaaaattgacgtttgtgaatactcgagtgaatattaatttcaagcaattttcacggtttgcacgattcacaaatattatcgttgtaatttgtaaacacattttatagcaatgtaggagttgtgtatagcagaaatatgatataatacaatgttcggaaacaggtctgaacgtgaacatgataattaagtttcatttgaactttccacgtaccccgatcaacttgatggtaaaacagagtatatttgaactggcttgcgtacagtacaaataccatcaagcatggtgttattgaattctcatatctagagagaatttgatttatcgaagcaagctgccaaactgtaaacccaacataattacttataagatttaggtttactccgttagagatagcgtttcaggaattcgtccatgcaggtgtactgaacctctgggtagagcagagttgcttcggcaccatggtccccaatgtcgaagtttgtcaagcaaccgtcatagaaaatgtggtagtaatgtgttactgccacttgaatagcaaaattcaaatctgcttgcatcaaaaattgcttatcaacgacaagttaggttaatactatgatatatgtagtttgaaatttaacccctagagtaatggtattaaagaaacatagttaaaaattggcaatatcaatttgaaaattgatagaaaacagcatcgtttgtggggtggtgttggagttgtagatctacgattccaaccaccaaaaatacttaagtcttggttccatgatatatacatatcaataagcagtttatggttacctttcattgcagccaaaaattcatcgctgggtatgtggactttctcaagacttttccctgtaagttcttcctacttcgctatcagctcgttttgggtgaggcaattatcttgtggtcttatgtagattgtcttgttcaaggtgcgaggatcatcgattgatttgattgtgtatgttccaatatcatcttcatccaaaaaaacgctgcatataatattgcagcttttggttagtatagttgaaattcatcaaaactaatattctgcactctacagtatatgcaatatatgtatactcggacacaattactgttagtaatattactgaagaataatgagtagtgaaaaggtagctatacaaattatttattattatttttttcaaaaaagcatgcaaataccttcataggacatgctatttttcactagctatacactaaaaaaaatcattatttacaacagattaaattgtgctcatggtataggaatctggcatgtggatgcaacaaattggctagttttttgtgtgtgtgtgttttaagaaaagtactccctctacttatacttacgtgctagtttaatgataatacataattcttataggaaaatagatctatttgcaaaacaaacaaaggggatataattatttgacaacaaatttttttaaaaaaactattttttttaaatttgaacccaataaataaataattttggttcataatttctagctaaaactcttacatggattttgtcaaaaaaataaatttgttcaataatttaaattttatttttcaaattttacaatcaataattatgccccatttgatttttatcatgaattataatttttcacattgtgaattatgaagtagatagcatgtaagtatgagaaatgggcgatatggtcattttagaaaaatctaacagtcaaactcatggtcaactaacggaatagggatagaagagatcgaaataaaaactaaagggcatgtagagggtgaggcaaaattcaggggtatagaagaaattgcgaaacttttcagaagtacgtatggaattttctctaaaataaactagtagtcctagtactatataacaccgcccatgtcataaagtaaattatcttgcttatagctgttgtgcaactactgattgccctgaaactatgatttttttcggagaaaactacccatctgtaaacgccaaaatttggtatgcccctaggagaattatctcatcgtaaatagtcggattcgtgctatattcggttaaggaaattaatctatcgaagaaagcttatccacaagtgacagagttcaaggaggatgcggcatggcaagttatctattaattaggaataatttgttagtttccttttatctttagacaagtgtgtttagtgtcctataaagactttatgttttccttttatctttaggaaagtttctttcttatactacaaggactagtatctacccatgggtataaatatatacacccggggtgattgtaaaatatcacacaggtcaataatactcctggcacatcgccaccctcttttctgaggttttacttattcaaccgacagaatttggcacctgacgcggggctgcattggttcagttcgatctccggcgaaggggtaagtcctacgttctgccggcccaggcaattgtatcatctacgtcggctttgttcaaggctgcatcagtacattcaatctcttggattgctctagtttgattgatatatttgcttggctatttatcatatgtcttagttaatctagtcttagtatctcaatttagctctatcggttgtctctcgctttagggtttctgccagtatcagctaaattgttttactagattagattagctaagacatcaaccaccctaaaaatcagccaacggcttgattgtgtatatattatgtttctttacatacttagtgctgcatcaattaagtttgatctactaagttatgtttagaaccataatctctaacctgccttttgactgctaataagggtttcattggggtttcagccgatgagttatctggatgttgctttggcttacaaggattatatacaagttggatttagccgatgggaacaaagatttcattgtttaatctaatcttatggattgtatgatatcggacctccaaccaatgtatgctttaaccttcggatcagtgcttattctatcttgtcattgttagccaattggtctctactaggattatattattgttatatcttattatcactagcagattgtctttatatcattatctacattggacatataggtgattgctcaaaaccctatcgacatcggctggaatcggcatcggctgggactactccattggcttgttagccgatcggctatttgatctattgtttgcatatcttatcagttgcaggatcaaactgattagcacgcccacatatcataaacctttggacctgcactggagctaagcagatctcccaggccaatgtgtgtttttcgcgtcaacacttctttggcacgcctggtgggacgcgaattttgcacccaacatgtttgaggaggaagtcaatgccatggaggggcaatctcctgagccgatggttgaaacatctcaagataaatttaatgaaacagttcatcgtgccttgtttgatcagtctggggttttgatgcatacactacaagatgtgatcaagaagatagttcctgaaatagttgctcaaagaaatcaacttggggggcaaatcggtgaacaacttcagcatcatcagcagcaacaatatcggctcggggggcaagcatatcaatagcagtatgatgagtcatatgaatatcggtcagaggaacttcatcagtatgggcatggtgaagaatatcaatataatgatgatttggccgatagaattgcaaagatgatagaggagcagtttggaatcaaacctaaggaacatacttttgtgtatcggctgccatatcctgagtggtttgatagggttccattgccacaccgatacaaggttctagatttctccaagttttcagggcaagatgatatgtctacaatggaacatcagctgattcttagcacaatgtggagaggcatcggttgaagaaactctaaaagttagattttttccattgtctttgactggatcggccttcacgtgggtttcatcactaccatcagattctatccaaggatgggccgatcttgagaagcaattccacgagtatttctttgctagaatcgatgaattgaagctttcagacttaatatcggttgagcagcaagaaggagaattggctatggaatatattcaaagatttcgtaatgtccgcagccgatgttatggtttgagcctaagtgatgagaaactagcagatctcggattccaaggattatcagcatctataagagagattcttttgccacaagtttggcagcctggctcatctaatgcaaaaagtcctagctcatgaaagccgattgcaagaagcaaaggaagatcagttttggagttatcaagacaagaaataagataattttgaagcatgagttttcatactccaaaactggggggcatgtgttaacgccaaaatttggtaagccccaaggagaatcatcgcatcgccaatagttggattcctactatattcggttaaagaaattaatctatcaaaggaagcttatccagaagtgaccgagtttaaggaggatgcggcatgacaagttatctattaattaggaataatttgttagtttccttttatctttaggaaagtgtgtttagtgtcctataaagttatgttttccttttatctttaggaaagtttctttcttgtcctacaaggactagtatctacccatgggtataaatatgtacaccgggggtcattgtaaaatatcacacagatcaataatactctcggcgcatcgccaccctcttttctgagatttttacttattcaaccggcggaatttggcacctaacgcggggttgcatcagttcagttcgatctccggcgaaggggtaagtcctacattccgccggcctaggcaattgtatcgtctacgtcgacgttgtttaaggctgcatcagtacattcgacctcttggattgctctaattttgttgatatatttgcttggctatttatgatatgtcttagttaatctagtcttagtatctctatttagctctatcggttgtcttttgctttagggtttctaccgatatcggctaaattgttatactagattagattagctaaggcatctaccaccctaaaaatcagttaatggcttgattgtctagatattatgtttcttttcatacttagtgctgcatcagttaagtttgatctacgaagttatgtttagaaccataatctctagcatgctttttgactgctaataagagtttcatcggggtttcagccgatgagttatctggatgttgcattggcttacaaggattatatacaagttggatttaaccgattgcaacaaagattttattgtttaatctaatcttatggattgaatgacatcggacctccagccgatgtatgctttaaccttcggatcagtgcttattctgtcatgtcactgttagccgattggtctctactaggattatattattgttatatcttattatcactagccgattatctttctacattggacatatagccgattgctcaaaaccctatcgacatcggctggaatcggcatcggctgggactactccatcggcttgacagccgatcggctatttgaactattgtttgcatatcttgtcagttgcaggataaaactgactagcacacccgtatatcatcaacctttggacctgcactggagctaagcagatctctccggctagtgtgtgtttttcgcgtcaacatcatcggacatccgatttctaaaaaaaactctcatttatctatttgtaacactggctcgtcaatataaatgctcaattgcacagggcttcatgctaacaatgtctccatatgtatacaactttatatgtctattttagtttgttgttcgagacataaatacactttgcaccaacaatctaatacccctctcttcttaggaaatactcgaaaaaaggcacaggatacaatacaaaataagtgtattctagccgtatgcatcacgcaaattctcccagcaaactccatatgtcatctacatatggcatctagtgttacgtgttcgttacttcatttgcagtccgagataaaatacgccttcgcattcacttttgcgccagaaaatagatatacgcctctctccctcatacacgtataacaacaccgcaaccgcaaaatacgcctagcagttccctttatatagagcagagaaggctttccatgggctctctcttccaacccctcacacaaagcggcgcctccgcacctatgtaaaaaaaaaatcagaggtgaaaacctctcaaaccctaatcccctcgtcccctcatggtagtcactcccgtggaggagcagccacctcccgcggccgacgcatccacattggaagaggctgagcacgccgcggccgcagccaccgagggcgagggcgagcacaagagtgttatgcctgtgccggatgagctactggcaacgaccgaaggaggtgtgccgaactgaagacgtactatgaaaagacgttttcgagtggctatagcgtattgagtctatgcactgatttgtgacactggcttgtggggccaagggttgttgagtcgggtgtgtgttgtataaatcgccagcctgtaggtatgtgacatctatcgaaaaggagaaagaaaaatactacccgtcctctgcttctctctttctttctattgctctgttttcttcttcctccctactactcggttcctatcagatctccggtgagcatcgccaccggtgattggggtcgtaacaattttggtatcagtcacttacggtcctgcttgctccctcgcactctcttgacctttgatcggtaaatcctgtggccgagttggtggtcttccttcgggttgttgccgccgtcattctcgtgtctggttcggttgggttcggaggacgtgacgcaacaacgcccgctaagcagagtgtgtaagttcggcggatggtggtggtagactcgattgaggagtggatgatggctgtgctcacgcagctgatggcgaaggtcgacaacattgacgtcatcaccaagcatttgggggagatcgacgccaagctcgtcactcaaggggagcgcctggatcgggttcaagcgaagatggatctctccatgacatcactggggcaagttcaacaggagcagacacaagtggctcgcgctctgaaggcggacgcggcggctcccgtcgcatcggcaccatctacaccgcctcctcctcaacctccgcatctggcgactccgggggcgtcctcttcgtcttcgccaccaccccctccgcctcccccaccacctcccccacctccgcctccgccgtgcctggttcctcctgttcgggagcaggttccttacccacccatactccctgctccgcgtgattttgggtactacatgccacgtcgccagtggtcacctaaaatggattatccgaaatttgatggcaccgatgttcgtgtgtggttggataattgcgagacatactttgtgttttatcaaatcgctaaagggtttaaggtttctgctgcggcgttgaatttgttggagaaaatggacattaagccacgttcaaaactaggcttcgccggaatgccatcacgaaaacgggattcgctaaaatgccaggatgaagcgcgccgcactcgccactttgccattttcctccttttgctcattttcgaaatgaatttcccttctatgcaagttgacctgatggaattgcccctacggtcgggtcttgaaagcgagagggggttgagccagcccgtgtgttcgccgtgtgcgctcggtcgcctctctctctcattgccatcgcaatgcgccaccgccatgccctgcatctccggtccggctagtcgagtctagctggcaggtcgaggaggagttgacgcacgaagccgcagtccctccccaggcctcgatgctcgtcgcgggcatcagagagaagaaccataaccctaaccctagttagggttatggcgatgcagcgaagaattgctcaaggtagcgaggacaacatgtcccaaggtagttcctttcgtgctcccgggcgccaactctctcgttttcttcttggtcccagtggacttcctcttgtgaagtgcccaagatgtgggaatgcagtagtggagtgcaaatcctggaggcaaggtggtcgggtgtttttcaaatgcgagaagaatgaacaatatgttagtaaattctcttagtttgattttcagatgagatggttggaatttcagaatgtatagttaattttatttggtattgttgttttcataggttcaagatgcttgcacatttttcaagtggtatgatagttaccaaagaatggtggaaggaatggaattagatttcaatgaagaagttgcaacaccagttgcaatagcagcagcaggtgaagctgacagggttgatgaagggaagatggataaactaactaagtggatgcaacttcttgtgttgatcaacatagggcaaggcatattagttctaattggagtgtttgtttttcttatgaaatgatgtaattgaaattatggatgtaataggaacggagtgaagcaaaacttgatgtagtaggaatgcttgatgtgttgattttggtaatatttgtgctgtcaacccttatgtactagaatcatggattgatttggtaatatatgtgctttaagcccttctgtttaatatatgtcaagtctttatggctatttgagaatctgaagatgcctgtatagttaattcagcgtgtggcaaattttaatcaatcagaacaatgtcaggcaggcagtatttagcagcacaagcagcatagtcaggcagtatatagccattggtgcattcaggcagtaaatgatgatgcggtgtaacaattccaggcagtaatacaattccaggcagtgtaaatgggcacaatgacataatatctccaacaacatagtcattgctcctccacgagcctggtaagatagaaaaatgtacgcaagttaaatgatgcgcaaactacaacgaactcgcccacaatcgcaacatcaacaacattcaaatcgccaaaggtttgagaatggattcacttacccggcgacgagttcctgccacgtacactccatatttgccaccctcaccccgggatgcagtgcgacggcggcacctacatgcggtgtgccgacggtgagctccttccacgacgggccgtctccacggccagatcgatttcctcgccgacgagcagacaggatggggcggcggaggaagagagagatagccaagaaccacctctggatctcgatcccctttctacccgaccgcaggggcaattctgtcaggtcaactcgcatagaagggaaattcatttcgaaaatgaggaaaaggaggaaaatagcaatgtggcgagtgcggcgcgcttcatcctggcattttagcgaatcccgttttcgggatggcattccggcgaagcccagttttgaacgtggcttaatgtccattttctcaatttgttgggagatgctgctaactggtaccatgcatggaaattggaagtagggtggcatgattggccaatgtttacggctgcagttatgagtgagtttgaagttaatttgcaaagtgtgaagatggatgagttgttgctgttgacacaaactggttcggtgactgaataccgctctaagtttaatcagttggtctatcagttgaggctttatgatcctttgctctatatcacattttttattcatcactttctgttgggtctaaaggatgaactgaggttgcttttctggcacaacagcctactacagtaactcaagcttatttagtggctcttgcacatgaatctgctcagaatggggctggtgtgaagagatggcctctaagaaagagcattctgctgtcaagagttttgataagcctaagttggcccctggggaactttggaaggctcagcaactcaaggagtatcgcgagctcagggactttgttttaaatgtggtgagaaatatgttcctggtcatacttgtgctaagactgacaatgtccagttaaaggctattcagttacaggaggagtctgaggtattgtctgatgccctgttggatgttgtcatgaccctggatatgtctggcactgaggtgaatgtatcattgcatgctttagctgggacttgtccttctaatactattcagttgcgtgctttggttcaaaatcaagtcatcattattcttgtggattcaggtagcattcatagttttattgatactggtttgtgtcagcgcctacaattgcctactatagctcttcagtctactgctgttaagatggctaatcgggagactctctcttgttcagctcaagttccctagtttgcttggtggattcaagggcatgagttttctttccctttgagggttttacctatgggtggttatgatgtggtgttagggatggattggttatctcaattcagccctatgacctgtgattgggcagccaagcagttgcagttctgttataaaggctcagtgatttctctgcagggtatgcagattcctcctaaattcagtcttgtcagtgaagtttatgctgttcaggttctgaaatggactaaaggcaatgatgtttgggccatggctgctatggaaccatctgttacagtgccatcttcttcttctcaggattctgaaattcagttgttattacgagaatctcagtctgtttttcaggaatccaattccttgcctcccccacagagttctgaatcatgctattgcattggtgcccaatcctgtgccagttaatgctcgaccatatcggtattctcctgctcaaaaagatgagatagaaaggcaagtttctggcatgttggctgctgggttaatctctcccagctgcagtccctttgcatctcctgttattttagtgaagaaaaaggacaattcctggcgcttttgtgttgattaccacaggttgaatgatcttactgtcaaaaataagtttcccttacctgtggttgatgagttacttgatgagttggctggtaccacttacttttctaaattagatctgcgcagtgggtattatcagattaggagacaagaatctgatgagtataaaactgcctttaaaactcatcatggacattttcaatttcgtgtgattccctttggtctcaccaatgccccagctacctttcaatgtctcataaat

SEQ ID NO: 30715 - DNA, 5350 bp, Oryza sativa
cagtccctttgcatctcctgttattttagtgaagaaaaaggacaattcctggcgcttttgtgttgattaccacaggttgaatgatcttactgtcaaaaataagtttcccttacctgtggttgatgagttacttgatgagttggctggtaccacttacttttctaaattagatctgcgcagtgggtattatcagattaggagacaagaatctgatgagtataaaactgcctttaaaactcatcatggacattttcaatttcgtgtgattccctttggtctcaccaatgccccagctacctttcaatgtctcataaattcaatttttgcccattttctgcatagatttgtcttggttttcatggatgatatactggtgtattgcaagtcttgggctgatcaccttcatcacctacgttgtgttttacagttaccgcaacaacatcaactttgtgccaagttgtctaaatgttcttttgcagctccacagttggagtatttgtgacatattatctcagctgctggtgttgcaactgactctgaaaatattagagtaatgttgcagtggcctgtgccaactaatctcactaagctcagaggggtttttaggcctcactagttattattgcaaatttattaagcattatggtatcctggcaaaacctctgacaaccttactaaagaagaataccaagtttgtgtggttagataagtctcagcaagcatttgatgacctgaagcatactatgactactgctccagttcttgtgcttcctgattttaccaagcccttcactattgaaactgatgcttgttcttcaggcattggtgctgttctctgtcaagagggccatccagtggctttttacagtaaagcattgggagttaataatcagaaattatctatttatgaaaaagagttcttgactatcatgatggctgtggataagtggagaccatatttgttgggggccgttttgttatcaaaactgacatcagtcctgtgtcatttggatgatctgattttgggttctgagttgcaaaggaaggctatgaccaaattgattggtctgcagtatcgatttcagtaaaaagggggggggtctgaaaaccgatctgctgatgctctttctcgtgtgggccatttttttctatgtacattctatttcagtagttcagcctgtgtgggtgcaggaagtggttaactcctatgtggtggattcccaggctcaatccttgctcactgaattagctgttgcctcttctaatgcccagggttattccttgtctcatggtttgatcaggaagaagggcaggatttggctgggcactaattctgctttacacactaagatcatttctgccatccatgactcagctattgggggccattttggcattcaggccacatatcagagagtaaagaaattatttgtttggagggatctgaagcagtcagtggaagaatttgttcagcaatgcactgtttgtcagaaggccaaacatgaacattgctcttatcctaggttattacaacctttaccaattccttcaggggtttggcaggatatctctatggattttattgagagtcttcctgtgtctaaaggtagtgatgtcattttggtcgtggtggatcgatttactaagtatgcacattttttgccattgaaacacccattttctgcactgcaagtggctgaaagttatctgaatcgagtggcttctttgtatggcatgcccaaatctactgtgtctgatcgtgagaaaatcttcactagtcatttttggtagcatttgatcaagagatttggcattcctttgaatctgaccactgcgtatcatccccagtcagacagatagactgagtgggtaaaccagagcttggaaatgtacttacattgtgctgtggcttcagccccccactaaatggagttcctggcttcccttggctcagtactggtacaatactagttttcattcagcattgaaatgatctcaccacaaggctttatatgccagtgatcccacctatggtcttttgccttcagtacctgagcctgacgaagatggtgacactggtgctgctggtctactgcaagaacgtgctttgttttgatctatgttgcaacatcatctggctcgcgctcagaaccatatgaaacagttagtggatgcaaagcgcactgctcgttcttttcaagttggtactcttgatattacagccatatgctcagcgctggcattcatgtattttgggtcctttgaaatcttgcaggcaattggctcggtggcttacaaactgaagttacctgatgatagtctcattcatccggtgttccatgtgtcccagttaaagcaatttgttcctgacaacaaaccgatgtgctctcagttgcccacggctgctcaactggatattgccgatttcatcccttctgaagttttggatcggcgaatggtgaagaagcgcaatgctgccgtggtccagaacttagcgtgttggggttctcttcctgctgctttggccacctgggaggatgctgacgttgttcgcaccagatttctggacgctgtcccttggggacaagctccaattccagggggcaactgttatgcctatgccggatgagctactggcaacgaccgaaggaggtgtgtcgaactgatgcgaaaagacgtttttgagtggctatagcatattgagtctatgtactgatttctgacactggcttgtggggctaacggttgttgagtcgggtgtgtggtgtataaatcgccagcctgtaggcacgtgacatctatcgaaaaagagagaggaaaaatactacccgtcctctgcttctctctttctttctcttgctgtgttttcttcttcctccctactactcggtttctgtcagatctccggtgagcatcgaggaggtagaggccgcccccgacgccaacggcggcggcgaggaagccaatcggccccgcgtggaaggcgacggcgaaggtggatctcctcatccccccgcctccctccttccccacatgttttgcgcatagggttttccgtctcacgggatgatgcttatgtgttttctaattcattcggtgcttgaataatccgcgaagggtttatagtccgtttcatctgatcgtggtctctctttgaatcaggtgtcttgcagagcaacgagtcctccgcgaaggtcgatgagccggtagctacagagaacagtgacgctgctcctgctgaggcatctgtagatgctgtgaacggcaagattcctcctaccaaggttacttcttatgctggaaaggccgatgcctacatcaacttaggcttgatcgtggtcataaatgttcatgtagttgattccccaacatcctctggaaggtgttacattgacagaaagaactgtacgtattactgggaataagaagcagatagaagcggcaaaagatattattaagcaagctatgagtcaggtaatgtgattctgtgttttgcttttaactgttccttcatgctgtaaataactagtgatattagatgatgctgtgatcacacaatgattgtacaattcaatcatgctgtgaagaactgggtgatgcaatatgatgatgagatgctaaatttgtactttatgcatttccattctattcatgctgtgattattttttcgttgaaagtgaatttctgttacttgctctggaatcatggtgtgtattatcgaacctattgtctctagcatgaccttaccatcttcgtatgatatgattggtataattcaatatgtttttctgtgctccctgataatagaggtcttagaaatatagaaggtgttttttggttcttgttgagtaaacctgtgatttctttcaatcagcttaattaaatttgtgtcctcttatggtttgtgttgatgtcattttattgataccttctagaactggttccagcatttgttcatttcatttttaatagtttccataaacttgaaatgaatttcttttacacaaaaatgcttcaatgcaaatgcattttgttgaatgaaacacaattttactgcgtcaagggagtgctggttttttcctcgcttattacatcttaagtgtataaactaatgtctcttctacaatgggccttgtatgaagtatcgatcttgaaatatagcagtgcataattggactggaaggtaagttcttcttaattggtgataagttttagtgtcttttttgccaagtcaatgagatgccacatcctcgagagtatcatgtacatattaatacttaatttatacataataatttgtttataatctttcatgagttataatctcctcgtggtcaattatttttttgtggtaatatttgtcatcttccacataattcagtatcttgccttgcttccttttcaatggtgaaatttattccatgtccatgaattttatggtttttgcgttatcttaaattacaaatgatgcatgtttagtttcccatgaaaatgttgttcattcatggattaacaatatggaaacatggtgtgcatgatcatatatgtcaactatgaatgaagttagaataaatgatttgactctgcaatggatatcttttgaggatctgggagatatgttcacgttgacataaaaagatattctagtctcggtggcttgatagttcttcatagttcgtctagaagcagaacttaccttcgtgtatgatagtgtggttggaattcagtacttcatcgttaaaactttggtgctgtcacatgatcaatgaacaattactgtggtactagtatcaatctttagtcggttagtcttttgagttttggtaactgcttactgctagattagatcttattatgtttcctatataagaagtcagaactgactcaccaggttcctctcgcttccagtttccatgatttattttgtttgaaggtgccaatttggagttggatgaagggtaggtctgatgcttgaagggagtaggtttgaagttgaaccctaagataaaaccgacctccccagatgtaataagtaattagcataatctatttgcagtaacctagtcgaatttatgaattgcttgtgaactactacatgagtataaaaattagcagcgcgaatgaaatatgaccatgtatgtgcctataatcgccatggtgattaagaagtaataaaacattcaagccatccatgggcgatagtctactacagttgtacacagccgcatcagtaatcaaattagagatcagattgctgctacagacgcaatcgagcatcttaaaacaacctaaatggatcaatcgatactaccgaatcgaataaggaaaatcaacggcttattcgcggat

SEQ ID NO: 30716 - DNA, 3161 bp, Oryza sativa
attgcgtctgtagcagcaatctgatctctaatttgattgttgatgccgctgtgtacaactgtagtagacaattgcctatggatggcgtgaatgttttattattctttaatcaccatggcgattgtagtcacatacatggtcatatttcgttcactctactaatttttatattatactcttgtagtagttcacaggcaattcagaaattcgactaggttactgcaaacagattatgctaattacttatccagtgttaccgggacactgacacgggtgtcggagtccgactcggcaagctaagaaaaaataggattcggggactcgctccataaatatgatttttagtgaaaatattatatatatcatcaaataaaacatactcttagtcagtaaaacactaaaacatatggtgtcacacattattctgcacagaagatcctatcttcttattagttaggacaaagactgacagccaaaataagtgaatttcatgtgtagaggatcccttgtgcagttgtgcacaaaaaaacccactgctatcctgccatccacatgccactaccaatactactcatgagtactactagttgtctctggagtactactagtatgcctgtgcattgtagatgcacgcacgcagctacttttcccatcgagctctcccatcccattctctctctctcttctgccttctttttcccatcctctcccacaggtctgccagacaaccaccggcactgctcgcctatggcagctgagagagacaccgctagtagtgtctgatgcgtgtcgaaccgtgtcagacacgagctgacacggggatgcgtgtcgacatggaaaatttttttggactcgcgtgtcccggtaacactggttacatctggggaggtcggttttatcttaggattcaacttcaaaccattctgctgtagaattcctacaaataaaaaaaaatagcagtcttgtgtttgacccagattgtttctgtatcctctgttcgtctcaactggcctcaagaacacaactattttaaggaatatataagcagaatggagagtttaaactccattctaattttgttcggttttgtctgttgtgcgtgtaattaggcatttaattttcctatttcatgttttttttgccaaacggccaaatggccacactctggcattcgatgtaacaatttatcatatcgggaactattgttacaatctgtatcttctttgtgtgctgtctaccacaagtcttatctgtaagatgtcatattttttatgattggttctacctgttactgagaatatcttctactatttctctttttgccaggttttggtagaagcaaatggtgtaacacggacattggttttgaataggccaaagcagttgaatgccctctcctctgcaatggtatgacttctaaagacaaaaacatgacaatgattcaataagtaatggggcatatatggtattagcgactatatatagggtgcaggaacactgatttgataatttttttttgctttcattttctagataacgtgttttttgaggtgcttcactgcttatgaggaagatgatggagttaaactattgattgtgaaggtaacgatcatgtttgagtcctacaataatgaaatatctaatgtggtccatatttgaacaatgtatttagaggcttatctttttttaaaaaatgaataacgaggtagtagctaacatcaaacatgaattgcctgtttaaatttccaaaatcatgaattcaaagtttcatccgcttattgaagtttgtacaaccaagttgtagtaacgtaaaacaacaatgctgcccgtgccttttgttgcatgctaactgtccttttgccatttgtaaatgtaattgattttcgccgggatgaaatgtaattgattttctgctgctgatatatgagtcttgacttattgggataattccatctttagtacctcctgctgttacctttactgctgctgtttgtgctcagcttgatttttataactcgttgccattcttgtcatcacttgttttttcctttgtcagggaaaaggaagagcattttgtgcaggtggagatgttgctgcagttgtccggtctataaataatggtaaacaacacatatgatgcatccttgagactatgatgtcaaatatcttgagctggtttatttttggcttttagctgttttgctttgacttcctttgcctttccatatgctatatgctaattcactgttaacatgcaatatatagagaattttcttcttgacatctaattagttttactatgcatttcttatatcagatagctggaaatatggtgctcattttttccgaaatgaatttctgttaaactatatcattgcaacatatagcaaacctcaggtaagctgtcgctatggctttgaaactgcttgtccacataattgttgtcattattgctcaattcttaccactgaatgctacaacactcttatctaggtttcgcttctaactggaattgtcatgggtggaggtgctggtgtttctatacatggaaggttccgagttgtcacagatagcacggtatatattacggaacaaactctatatgaaccttccgtttttgcttaaatcatttcaaaaaggatgtagctggtgtgcataaaaagcttgtttgattcttttcatgggataaacagcttaccagcatatgcctagagattgactctgtatttttactactatttatacaggtttttgctatgccagaaacagcgttgggtctctttccagatattggggcttcatattttctatctcgacttcttgggttctatggtgaacttttttcctatctcatatctcctttattcaattgaactttcacacatgatcatatgaattctcattgcaatgtctaaaactgattatgaatactggaaacccatgtgcagttatgcatccttaaatgcttattttttagggaaaatccaacctcaaatcttgcaaattttggatcactggatgtgcttcacgattcgtgctcttctccaactccagcgaccacctcttcttctccggcgccagcgccggcggaacccaaactccggcagagggccgacgaattagggtccggggtgcggtggggatgggagggggggaggggt

SEQ ID NO: 30717 - DNA, 7048 bp, Oryza sativa
atcggcttgagggaagaaaaggacagggaggggaagggaagggccccggccggggggacctcgcctgcgccgttgactcccttcggccagccggcaagacgggcggcggcgtgttgggccggtggcgacggcggatcaggtggtggcgagatgggcgcgcgaggggagcggcggcggcggaatgcgcgagggggagaggaatgggagaaaaaaggttagggttaaggctgtgcacgaatctcaaagcatatccaatggtccaaaatttgaaagattggaggtgggatattctatcaacagatgtataaacagtccctattttttatttaggatgatcatattattacatgattttaaaatttgtgggtgtggaaatatatatggccactctgtttctcccatcatcttaataaattttggtaaaaacaagaaatgtatgtggccagattttttattgcctgtccacaggattcatctgttgaattttaatataatggtgaatttgttataattacaccatacaaagttataatttgatgggaaactatcattggagatcgttttcactgattttttgttatgtctttctcaggagagtatgttggtcttactggtgtaaggttggatgctgctgaaatgcttgcttgtggcctagcaactcattttgtaccttcagatgtaggtctgccagtggcttttgaattttatgttcagtgtgggaccacatatttgttcgttttatgtttggaagtcaactgttataacatgtcctacacacttgacttgttccaagtgtgattatagataacccgagtattgctggttttctaattcctactagtacactcactcttgcagaggctgtctttgctagaagaatcacttaaaaaggttgatacatctgatccatttgctatatgtggaattatcgatcaatattcgcaacaaccatctctgaaagaaaaaagcgctctgaataggtaagcgtgcaattgtccagacattaccttttcatgcacgtcaagcttattctacttcctttgtgtaccctgtaaaaatgacgtatcctggacaggtgggatattctggttcacaccaagtaatcttgtcgtacaaatcctttttggcatgttaaatttagattgattaatctacagtttttaagttactagtagctacataaagttccatagttataccatcaatataaatttcatgcaggaaaaactcctcatcctgggggcgtgtttgaccaatttatcctctccaaacaactttattttgggtccaagcctcagcccccagatagatagactagtccttttgaaataatattagcttgtaatgaagggcaggtggagaaatgtaaggaattggaatgggggagatataggaaagcaacagcatgcacttcccacatcttgtgtcttctttcaatagatggatgggcttcaacttatcaaaaagcttggtaatggttgtctggcctggctttaaataagccgttccctatgccctaacggcctaacctgttacccgtgtgttttctatattctcctcatctttgaactcatttttgggtattgcttttcttaatcttgtttgaaggccaaaaaggcaattgtcagtgcattgtaacttggaaggacttattttagtttgtcaggagattccatttgttcctctttcatttcaaggttttgttttctcatttcattctcaggtcaacttttattgcctaatccatatctgctacttccgtcatatgattgcaggctagaaatcatcaacaaatgcttttccaaaaaaacagtagaagaaatcatagcctctcttgtgagttatgctaagtcctcatttgctttctatggactctccagttctgttgtgctaaatttgatgtgtatcatgttaggaacaagaggctccaaatgttgctgatgaatggattgcttctgcaatccagtccatgaggaaggcttctcctactagtatgaaaatatccttgagatcggtatcctctcaaacatttccaaagcatacgtctttatgttactcaagtcattctatcttggtgccttctgatgcaaattattgtagtgtaaggcactactatttatttagacccatcaatcctttatatggtttcatatgaccagtatttatattgctcaagcgcatacttcagatagctttatgaactgaaccctactcttttgtcttggcagttggcacaacagatcagccctatagccaaaaaaacaaaccttctaagattatagcttttgcatagtcaaattgcatgtatgggcataccagttctaaaagctttgtaaatgtctttgaaactagtcgttggagggaagacaaggctcgttcactccacagaagagtacatgtgctagaaaaggcagccagcttaaaaacaccaactactttcttaagccttatttagtttggttgcctacgctgatctccggcgtgctatgcaacaccccctgcttgcttctttctgttcgacttggagcttgcagcctccctacccttgcttatgacctattcttaatagaaccgatctgattttcactacaagaggaattccgtgcttctgccggatcctccctatctcctgatcaagcttgtgttggtaaatactccctccgttttttaatagatgacgctgttgacttttaaacacatgtttgatcattcgtcttatttaaaaattttatgcaaatgtataagatacaaatcatgcttaaattacgttgagtgataaaacaactcacaacaaaataaattataattacgaatggtcaaacgtctgacaaaaagtcaacggcgtcatctattaaaaaacataatgtagtactccctccgtcccataatataggggattttgagtttttgcttgtaacgtttgactactcgtcttatttaattttttaaaaaaatattatttattttatttgtgacttactttattatccacagtactttaagcgcaacttttcatttttgatatttgcaaaaaaattttgaataagacgagtggtcaaacgttgcaagcaaaaactcaaaagccctcatattgtgggacggagggagtattgtttagtatggcctatagtagtacactgtttgggacagagttagtgcccttctcacaacatcccgtctggcggaaactatggagggggtggctagcgcgcgcgtgggcaccaggaaagtagctggcgagcattccccccttccctttagtcttaactacctatattagttaatatacttaacagtaatgatagtaattaggaaagattcgggagattttttttactaacagattaaaaaaaatttaagttagatttgaaaactttcgatttaagttttaaattttaaagtcaaattttaaaaactttcaactcatatttgaaaactttcaacttgagatttgaaaactttcaactcagattcgaaactttcaactcaagaatcgagattcgaaaactttcaagttcggatttgaaaattttgaaaactttcaatttgagatttgaaaactttcaactcgagattcaaaaacttccaaatgcagatttgaaaattttgaaaactttcaactcgagatttgaaaactttcaaatcgagatttgaaaactttcaagttcagatttgaaaactttcaaactcaaaatatgctaaagataaaaaaaaatcagaaaaaagtgagaaaaaaaaggaaaaaaagggtaaaaaaaacgaaaaaaaatcgtagcggaggcgcgcgcaccggcgcagcggcgctgttccttcttggccggaaacgcgcgccgccggcgcgctcgctacaactagcggaacaaagcagttagatggttcactttgtataaccactacaattttgacagaaaatagtgttatggttagtttctagccttttaagatcatgtgacctatcttttgggagttctggtctttttcaccaggccgacaacgaaggaagccctgaccaattttattaagatcaagaggagtaaagtattgtttacaacaaacatggttgtttagggatcaccctaacacaggaacacaacttaaaagctcagaattggccctaagtccgggagaggcacagaattggttgctgccacaacagggcagccctctatcggcgcacttcagtgatcaacattcctcccaagcatgcatcacgctaagtccattcttctatgatgcagcagattacctcagaggccgatttgctggcaccgtcaaacacctgagcgttccgttctttccacattatccaagagattagaattactactgcgtcaaatgggagttccaatctcaccatgagcttcgaggtgtcaaacctccagctatcactacctactaaggtctaaagtggagcttagtctctaagaaaagtttgttttacacctaacattcagtagggaaggtctttgttttactgtagtatatgtagttcgcgagacgctagccatctgtgcccccattatgttcttagcttgttgtatttactgtgagttcagataagagaaggccgaacacaacttgttggtgaatgcttacgtcgagaatatagaatggtttgccatgtgatgcgtggtgacttcagtagagacttctttgaggtaaatatctatctacatctccccatgacatgttcacttaagatgaacatactttggacgattcaattcctatttgcagggatgcagggctatattgttggatagagatcgaaacccaaaggtcagcttaacatcctgtttgtcagaaaattcgttcttcacatattgtctaatctggcatgggcatagcattaaatctaaccctgacatctttgctaattgcagtggatgcctccaaggttggaagaggtgcacgacgaggtggtcgaaaaatatttttccaaagtcgatgatccagagtgggaagatttggacctacctcctagacgttcccatggaaggaggcttgttcccaagctttgactgaatgaagcctctggtgaaaaactgaagcctttgttggtgcttcttaataacaaacagatcgtccccaatttgagggatatgtggagacaagcgatgaagtttataataaagctgaaacatataatactataggttaacaattttattagtagcaatttagagaagtccatctcatagtctcatgcgatgcttatattggtatcgctattgtgctttttcaaggtgtgaaggtacgcttcaagccaaagcccaactgcataacggcggcccatatgataccggtatcaggctatcctattaggctttgaagctatcttctgcttgtagattctaggtaatcttttatatatattgtataaaagaaattcataagtttgcactgtgttgttttttaagtaaggcctcgaaaaggtagatccctaatatcgagtgtgtcttgtaatgcacttgaactgattgcatttcgttgatgaaatgggaaaggtccactctctttgtccaaaataaataaatctatatctatatctatctatacctaataaaaaaattcgtaaggcttccggtaatttttcatctgtcacctatcgctcgcgtcagtacaatcgtgcgcgatgcggtaatcagcttccccgttcaaacaaaatcgaagacagagcggataccatgcttcttcttattgtatttctctgaaaggcaaggggttttctataaaaaaaacataacaggcatttaggcagggtaagggtcagatcaaaattttatacatggacaagaagttttttgcaaaatacctaagatgcgcgtggcatgcatgcattcttacgtgttcctagagagaaggaatttatccatttcatgtttcgagctctcaaaaaatggcgtggaaacagatagaaactcttgaatggaaattgaaaagaaatgtagccccagttccttcggaaatggtaagatctttgacgcaagaagaaggggcgacccatatcatcttgacttggttctgcttcccctctttttttaagaatacggctaaatcggagatgggcggtgagacaaaccggacactaggcagatcacatgcatggggaacagggatttgaccgaagaaactgctcagtggcagtctatacgcccaattgaggagcctctccccgcagtgttttacgtgtcgcacggaaagagcaaaaaaaaaaatcaaaaaacgagaaaaatggtacggtcaggctggttattgattgatgatttgtacgggaaaagtacacgcaaggtccctcaacttgttagccagatacaaaatcgtccctcaaccacaaaaccggacatccggcgtcccccaacttacaaaaccagtcacaaaaggtctctcggcggttttgaccccggttttgtcccacgtggcggctaactcagcgtgagacccacgtgggccccacatgttagtaagccatgtcatcacctctctctatctttcctcccccttcctctctctctctttctctctcttacttatctcctctcgacaggctggacgggccgggcggtgggtggggatgtcgccagggtgaggcgggagaggaggtccgacgaccgccgaccggcgacgcggtggcggcgacacgggagaaggggagggcggcggcagcccagcgcggtcgctgcggccaacagacatgcatggtacgggcggcgcgaagggcgacagcggtgcgtggttgtagacgaagccgaggaagacggtgtcgacgtctcccccaggcttagccaccggggaaggagccgggcagccgtcgagggcatcgcggctttggtcctcgagcgccgtcatggcgtcgccgtcgtcgccgcgttcctcccgtctcgccgccaccgccaagccgacgccgacgcgttcctcatgcctcgtcgccaccgcccagccaacgagctcgccggtctccccgcgcctccgctggctgcgcgtgtggctccagcttggccgctgcggtcgcccgccgctcctcctcgtcggcgagcacggagaggaa

SEQ ID NO: 30718 - DNA, 3765 bp, Oryza sativa
  unsure (1)..(3765): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctcccctgagccaacgccgacgcattcctcccgcctcgaagccgacactggcctccccgtgtttccccgccgtcgtcaccgcgttcctcccgcctcgccgccggatttggacttgggaggagctcaccggcctccccgcgcctccgccggccgcgcgtgtggctccaactctaccgccgctcctcctctccgccgcttcttccccgtcggccgcgccgaccctcttctccaccgcgtcggtgccgccgccgcatcggccctcctctccgcgtcagttatgatggccgcagccgcgcgccgccatcgccgaccacacgagggggacggggaggccggcgaactcgcaccgtcctgagcccgcgcgccgccacccgggaaccgccgtcgctagccacaccacctttcggccgcgcgcgccgccgcctgtgcgagagcagggagcgagaggaaggagagaaatagagaaagagagatagggtgctgacgtggcttactgacacgtggggtccacgtgggtcccacgctgagtcagccgccacgtgggacaaaactagggtgaaaacccccgagggtcctattgtgaccggttttgtaagttaggggacgccggatgtccggttttgtggttaagggacgattttgtatctggctaacaagttgagggaccttgcgtgtacttttcccgatttgtactagcatgagtgctactgctagctctctgcaactgtactactgtttgccaaaaggaaaatttcacattgaaggcccgtttaaaccccaggcaaaattttttaccctgtcacatcgaatgtttgacacatgcatggagtattaaatatagggaaaaaaactaattgcatatattacgtgtaaattgcgagacgaatcttttaaggctaattgctccatgatctgacaacgtagtgctacagtaaacatttgctaatgacggattaattatgcttaataaattcatctcacagtttacagccggaatctgtaatttgttttgttattagtctatgtttaatgcttcaaatgtatatatccatatatccgatgtgacacggtaaaacttttcaccctgatctaaagaaaacctgattgatactctcaccgactcaccatcccataatatagttactttactttttatgcgtttagattttatcccgaaatataactatatattatttaatttctttatttagagtaaattgcgttgacggtaaaagaacttggcagatgggtgtgattaggtgaaaaacttgaaaaccaagcgtaacggtacaataacttggctaggtgggtgcgctcatggtgcaaaagttgccacgccattgttccaccttagcgaaagtgccacattagcattgaccatctcattttacagaaaagtccctagtaacttttatattccaatcacttcttcttcaggtgtatctgttttcccattgtttggtactccctccgtttcacaatgtaagtgaatgtgaggaatactagaatgacttattgtgaaacggaggaagtagaaagattagaaagatctagaggccccaccgcggcatcgacggagcagcccgaggccacttagcaggcgacctcgacgtcctacaggttcggcaacaccggcggcgccatgaccagcgccgcgtccgctgctggctccttccttccacattcgctgggtgcagatcgagtctccgacaatatcaagtccatgttcccctcctcgtccacagccagcggcgccacctccgtcaggcacgatgagtactaggaatcccaccggacacgacgagtacacgggatccccaccggaccaccagcagacgcagggagctatgcctcaataatatcatcaagccataaggaagatcatgtgtcagtgtcgcaatgatcaaaccagtccaccttctcatccagataaattctgctactgccaactccgaaaaaaaaaccccaccatgatgcagttcaattgtgaattcttcctcatggcctgcaatacaaaataattggtgatgtgttatacccgcataaggaaaataatacactaagattatttgcagattattgaactaattatatgctgttgatcgataagggtacaaaatacatctagtaagaatttctcattgccaatgttactcttatatcgtatacagctacaggaaacaccaatcaataattacagtactaccaatatcgtggctagtaccattagatctcttcattgcattgtaataacaaataacaggatattcaagtgaaagaccaaaataatacagccatcgtataggtcaatgagaccttaactttgcaatcctccatcaattgatcgaacaataganatctacaaccatcagcaggtgatttaccataacaagctccaggaactcgccgagtcagagccatcccaaagtttgtggcaatcacgtcgacagcagcagtttgtggacttgaattggtttggttatggtttagggcttgaactagcgtggcacacagagccctcgtcgccgccgcgatgtagttgcacggcttcccttgttgtcatcatcgtcgccgcagccgccaccaccgccaccgtcgctacgtcgccgccaccgctgcgtcaccaccagcgcaaccacctctcgatcaggatcatgtcaagaaagataaaaggatatatttgtacgtcaacaaatcatattagggggttttctataaaatgagatagatctttcgtgttaaagccaatacggcaattgtgctaaggtggaatagtaatgtggcaatttttgtttacgtgacaacttttgcaccatgagcgcatccatctagccaagttattgtaccactacgctcggttttcaagtttttcacctaatcgcaccctcctactaatttcttgtaccgtcaacgcaatttaatcctttatttacttactcatctcaacaaattataaatagtttcttatttaattttattgaaaaaactttagaggagacgggtgaagtagttttgcagtactgctgtactagcaggaatagctaatgccatattggtaccagtttttacgagacgcagcacttgccaggagaagtgatgattaatcagtgcagttactgtgactaatggccgttcaagatcgatccagtcaattcatgacagtaataatttagctaggtcccccctccatggatacccaatcgatcgatcactgcataaattaattagtagagagaagatcggagcacgtacatagaagtgttttaaccggttaatactgagttttgtttgtgtggtgttaaagtgctaattagtcaaagtctcgcaagcttgccataatgcatcgatgcatgtgggttgcgtgtttggccaatcaggagctgcgaatgacgtggcattattatatatatatatatatgtatatatatgtatatatatatatatatatatatatatatatatatatgcggtatatatatata

SEQ ID NO: 30719 - DNA, 2138 bp, Oryza sativa
  unsure (1)..(2138): unsure at all n locations
accgcatctctctcgttccacccctcttctcggtcctccagttaaagtttttgtcctattattccgttcattcctgttagacggcgagtaaaaaaattactttggagcctacagccacgagtaatttttttattttggcgcacgctcccactcccgcttttctctcgctctcgttcgattcttctttccgttcgtccagtaaaaaaatcattccttgttatttcgcccctgttagaccgcgagtaaataaattactttggagcctaacaccgtgagttaaaaaattacttgttttgaccctacaacagtatgtcagcccgtgagtaaataaatcactgccggtcagatattattcacctccacactacattaccaattaacttgtattcaccagtcaaccaagctaccagttaacattctagcctctattaacaatattttcttttacacacgggttctgttacattcagacacactcaggggcgtgcctacgttatactacccggtgtcataggacaccgggtagattattcaaatcctatataaattacactatgttaattaatatattagttaataattagataattagtatatattggaccccagtaatttttgttctgggttcgccactggacacactatacaataaacaaattacatgcttaaactcaaaagtaaaaaagttacaaaggatataaacactccaacaaaaatcatcaaagaaattcagatcagcagatcctcctcttcaccgcgggatccatcgtctttgatggacgaatgttgtagtggaggcggctggctcgccaaccaaccagcttagaacaggactgtgtggcggtagcattaggaatcaggatgggcagcccaggatcaagcatggccgctattaaacatgcagaccataaaatcagtaatgcctcaaaagattagtgcactaacaaccaacggaggtgcattattagtgattgttgaaagttatacctccggcgctagtgacaatgtttcccaggtcaccgcatgatgcatttcatcatcttcgagtccaccgggttacattgtgctcctgcaagaccaaaatttgccatatatatgcactatgagtaggcatgccttagtggattgactcatagtatgaggctatgagcaactgagcattgcacaggacatggtgatgcttgcaggctgaaaagccaaaaattaatgcaagtgcaagctcatgggaaatctaaatgggcatttggtggtacatatcagggataagtggcaaaacgttgatcaagaggcttatgaattgttgatcgtgtggattaagcttattagagaatttttggctcgtttttaccaagagaactgctgcaagctacatagttgaaagcacatactcctaccagcgatcatatattttcagttaccatctgaatgccatggaggacatagaataacttccattgtaacgttcagtcaaaattatttacaggaaacaattgattgtatatacaactaatcaaacaaaccaaattagtactaataaaaaacaccagtcttggtttaccaaagcaatcgtttgtcagagaatgcgacacctaagctgactctaggccacatgtgcacatctacagatcatcctagttcttctattgttttcagaagctaagaacagccctgcatgcatgattcatcacatatacacttatagcaccaagcgaagccatccaccaaacaacttctaatgtgtttaggttggatgtgtccactcaatacacggatacaaaagacatgaatagattagttctgttaggttcctgacaaaacatcaaatagattagttctgttaggtacctgacatatattaacttcatcccgttggctgggaatgaagttggctgtgaaacaaaggttcacgttggccggcaattgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30720 - DNA, 1232 bp, Oryza sativa
tgttttgcgcatagggtttctgtctcacgggatgatgctggtgtgtttcctaattcatcggtgcttgaataatccgcgaagggtttatagtccgtttcatctgattgtgttctctctttgaatcaggtgtcgtgcagagcaacgagtcctccgcaaaggtcgatgagccgctgctcctgctgaggcatctgtagatgctgtgaacggcaagattcctcctaccaaggttacttcttattagggatgaaaacggatcgaatacggacggaaactagctctaccatattcattttcatatttttttcggaatcggaatcggaaaccccggatacgaaaacagaatcgaatattgtcgaatacagataggagcgaatacaaaatggaacgaatacggtgacgaatattaatcggaacaaaaacccctcaaactaagcatcacaaatcaacgaatatttccaaattttagtgttaataattttgctatatccaattttgtggttgagggtgacggcatctgcaaaaatcgaccttcattttctcatgcggctccttaagactagtttatcgcactcatatgaactccaaattggatgattcttttttctaaatgtttgtaaaatcatgctctattgtgttagtgtgttcttactgctattattttggccatatttttcttgtgactttgttttatcaattaaaattttgaatttcaaaaaaataacaacttcaaataatattttgaagcggtaaataattccagctgaaaaagtcatgaacataaaagttgtagaactcatcaagagctacaacttttattttgatcatttcttcatccgacaaagcagtagtaacattgttcacaaaatttacatatctctcttataacttatgaaactatatgtgagatatgtaaattttgtaaacaatgttactatcgctttgttggatgaagaaatgaccaaaataaaagttatagatcttgatgagttatacaactttgttattgatgacttttttagttgaaatcatttagtatttgaaaatgttgtttgaaggtgtcatattttgaaattcaaattcaaactgtttaacaaagtcacatagaaaaatgacacaaacaaaagttgtagatcttgatgcgttttacaactttgttgttgacagtttttttcatttgaaaacatttaatacccaaaaaattatttcaatttcatatattttaaaattcaaat

SEQ ID NO: 30721 - DNA, 10839 bp, Oryza sativa
aagtatggttacccttagctgtagtccatctttaatgtataatcaaactatttcagtacaatgtcaaacaaataatgtagagaaaatcccttgtgtacccatgaaaactcacctaatgccttctataccttcgaattttacccaatcccctgtgtacccctgaaatttcgctttgatcccttccatgcccctcctgataggtttctgttagatatgttactcaaaccgtgtgttgtattgtcagtatttttagaaaataccaaaatgcccctgccaaccctaactaaagtttcaatcccctttccttctcccgcatcctctccacgtgagtggcctcagtgtgccgccagcctgcagtcccgcgccgacatcccgccgccctcctgccgcgcgagccatcgtcccgccgtcctccgaccgaacgcgccgtcctgccgccctccggccacgcgccgtcgtccagcctccgtcacgccgtgcaggggcgccggccaccgccctccagctgcgcgggcgtcgccccgccgtgcgggtgtcaccggccactgccctcccgccgcacgggccgtcagccaccgcccctcccgccgcacgggcgtctgtagtcataactaatctggcaactgggaagaggcttggaagcttagataaagctgaggtaatttacttttgtagttacaacacttattcgatagaagctgtttgtgttgaagatagttttagcaatgcgtgtgatcccattgatatgggcgaccaaaggcctttgatcaacatctttgacagaacatgattcatccaagctctgtaaatgtttaaagaaaaagcaaagtacatcttcaccatccagtgactaatgatgattgtagttttcagatttgttttgtgtggcaaattttgttgggtgcatctagctagatatagcaattacgggtcttggtcctctttctgttatattaaattgagaatgaaaagcttgtctcttcgagtttcttagcgattgtgttcaggaggaactatgaagagatgaggtaattcaaattctattactgcgaagcaacaatttagtttgttctctgatgttagtatttagggcaattaagggaaaattcagtagataatatttaatttctgccagtcaaaaagcaactggattgtgtatgtatatcatggaaaatttagttaaggttgctttttgttgtcattttgcaggtgtacttccatgatataccaaccaacctgagccatctaacatgaatgtagccttgccatgtctgggggaggaaacacctatagttgcaccaaaaatgaccaagagcaagataaagggaaaaccatcatgttctaatactcctggtagcccaactatgcgcacaaggagcacagataagagtcctgcaatgggcactagaagcaaaagaaaactttatggactaaatcatatggcttgctgattaggttttattttggtactgtccatttctctgttgaggctgatggattttgttgttgtgatgccctgcaaagtggtagtcatagttgccatattttgctattgtaaggattgcttcctcatgatgtgatgatgtactgttatggaccttgtgccattatgctcatgatatattacctagctaatttggtttgttgattgcactattttgtatgaaatggaaagttggtttggttcctgcactattgggtatggaaatggaattgtgtgtgcgcatgatatgaatggttatgtatggatgatggaaagattttgttctgtgcatgatatcgagtgttctgtatagatatctctattgttatgtatgatgctattgatgctcttattgtaccataatcaatttcttgtatagaggaaccaatttttttatagaggaaactgatgactgtacagacagtcagcttttcctgatcctattatttttcacaaacaaaaagttcaatatattccattttttcagtgccacaataaatttgttatacactcattatttagtctcataaaatacacatattgttcagttaatattttttcaattttttcaatctagctgccacactcctccatctacaagtgtattttagacatttggaaccacacataacgtgaaaatgaaggaaacctatcgggaggggtatggaagggatcaaagcgaaatttcagaggtacagaggggatcgtgtaaaattcgagggtatagaagggattaggtgagttttcatgggtacacaagagattttctcaatgtagagaggttgtgggaaatatacagtgcaaaccacatgtgtaatgaaaacctgaaaaagtaccgttggataaaagatactaccaatttaagtgcagttgtaggttttcttatccaacatttgaccgtccgtcttatttaaaaaattatgaaaaaagtttaaaaacttagtcacacataaagtactatttatgtttaatcatttaataacaacaaaagcactaaccataatttattatcaactaagacgaacggtcaaacgttggacacataaacccacgagacggaggtagtagatacatcggatttttccacgtcattaagagtaaaacttttactcgcagatttaatcataagtaaaaaattactcatttttacttttgatgatgtggacaaatctcagacatatttttaagccaacagtagttttcaggtttccaatatgtatattgctgtgactatatttttcccatggtttgattcgttgagtgctgttgcagtgtataaatcgatcatgggacccagtcacaagaaaaaaaagaagtaaaagcttcttttttttttcttaatcacatggagcggagtctaatatatcagccaacaataaaataattctctattaagatgatttcacttgaaaatatggtttaattttgcatatacattaccaatttaacttgctgtatgttggttcaatttgttttttttttggatctgagagaatacaccgtaaaggacattaggctggttcggtttgatgcctaaaagagtctcaccaaattttggccatagacacaaattttggtatggccatagtttggaaatgttaaattgtgtttggttagtagccaaattttggctaaaccaaatttggttgtgtgccttcagatggctacgccattctttcttgtctcctcaccttctcacccacggatcgccgtttaaaagatgagagttttcatgttgcagctctaattaattactttccttttgcttcattcaaggtcggattattatatttttttaattcttgaataatgtattatattttgaatatttacaaattttctgctaatataagaatgaacgaagctgcagatgaatgctgtcgggtgataattaagtattggggaatggatggagtattcaactatgtacggaacaagagatcaaagcaaacaatgagcagaagtgtgagcaggaaatagaattaagccatcaataaccacaaatatgtagtcaacaaagaagataataaaaggagaatagattgcagattttttttagacaaagattgcagattaattaagctagcattacacttctggcagctaccacaaagctaagacgcatgggaccgcgcacatttctgatagctacagcaatctgctacaatgtgttcaacgtaagcaactagtgcctcctttcgacactctggagtgttctcctttcccctagggcccctttgatttataggaaaagtgtaggaaatttaaaggatttcaatcctatagaaaaaattactatgaaaccgtttgaaacaaaggattgaatcctatactatcctttaaattcctatggaatgggtaatctatagagattttggaggaaagtagaggtccatcctcttggaaaaattcatttgagtctatctctctcttccgattcctgcgtttttcctgtggtccaatcaaacggtcattcctgtgtttttcctgtattttccaatcctctgttttacacttacattcctgtcagaatcctgcgtttttctattcctgtgattcaaagggccctcaaacgagactttataagttcattaaggatgtgtttacttcgtgaaaagaaaacttttggttctcatgggatgtttgaccggatgtcggaaagagttttcgggcacgaatgaaaaaactaatttcataactcgcttggaaactgcgagacgaatatttcgagcctaattaagccgtcattagcacatgtgggttactgtggctaatcatgaactaatcatgctcgaaagattcgtctcgcgatttccatgcaaactgtgcagtcagtttttgttttaatctatatttaatactccatgcatgtgtctaaagattcgatgtgatgtttttggtaaaaaaaatttttggaaactaagggtgtgtttagttggggaaaaggaaatttttgggtgtcacatcgaacgtttgaccggatgtcggaaggggttttcggacacgaataaaaaaactaatttcagaattcgcctggaaaccgcgagacgaattttttgagactaattatgccgtcattagcatatgtgggttactgtagcacttatggctaatcacggactaattaggcttaaaggattcgtctcgcggtttcctccataactgtgcaattagtttttctttttatctatatttaatgcttcatacatgtgttcaaagattcgatgtgatgtttttggaaaaaaattttgggaactaaaccagacctaaatcattgattgacaaaataaatggtggatatcttgagctactatccgttgatgtgcccctctgccgtaggaggtatgacagggtctctaatcaccaggggccgtcgttgaggcaaatggggattctggtaatgaggtggagtagtttttatctatggctagtaaccggtagaaaagtgaattaattaataagaataatttatgcataaaacttttatatctattgtattcataagtgatttaaaaggcaatgtaattgtttgaaaaaaacataagccaatctagaaattgaactacgataaataatcaaaatcaacagttaaattaaaactaagggcatgcttagatcccctggcaaaacttttcaccctatcacatcgaatatttggacacatacatgaagtattaaatatagaaaaaaaactaattacacagattgcgtgtaaattgcgagatgaatcttttaagcctaattgctccatgatttgataatggggtgctatagtaaatatttgctaatgacggattaattaggcttaataaattcatctcatagtttacaggcaaaatttataatttgttttgttattagactacgttttatacttcaaatgtatatccgtatatccgatgtgacacaacaaaacttttcatccctatatctaaactcaacctaagtttttaaaatcttggatgtactcccccgtcacattttaagtatagctatgagtttccgtgttaaatatttgaccatctgttttatttaaaaaaattataaaaaaattaaaaataagtcacgcataaggattattcatattttatcatctaataacaataaatttattaatcataaaaaatttaagtaagatagatgatgttagacacagaaatttatggttgtatttaaaataggacggagcgagtaactgctattactaagcagcaggcagaaaaacaattcaaggacccgtcgccattttggagtaggtgtagtaggtagggagttgacaggatatcgctgtctcctaatcagtactccctccttgcaaaaatttgaaacctatttctttttcattaaaaccaagaagcaattaaatcactcaccatgtgacaaaatcaataaacatacaaccaataaatactagaatagcttcttgtttcgaccaacaatttaatttagcacatagtaactacaaataagactcaaatttttgaagaaaccaaagaatgaaataggtctgagatttttagaaagagggagtactccaaaattaaacaatggtattgtgttagaagcttctagtggttacaactatattttactgcctccgtcctaaaaaattaagagattttagacgagtggatatttcctaataatatgtatctggacaagctccctgtgcagattcatattactgtaggaaatgttccatctatctaaaatatcttgtatttcaggacagaatgagtagattcttggggtccggtgtaggatctgaaaatatagcggccagtccaaactttttaagagagtgtttatatctaggggtgtaaagttttggcatgttatatcgggtattatataggctgtcacatggggtgtttgggcattaattaataaactaattacaggggcattaattaataaactaattacagtatctgttagtaaacagcgagacgaatttattaagcctaattaatccatatttagcaaatatttactgtagcatcacattgtcaaatcatggagcaattaggattaaaagattcgtctcgtaaattagtcgcaatctgtgcaattagtttttttttctccatatttaatacttcatgcaggcatttaaacgttcgatgtgacggggtgtaaaatttttgtgtcggaactacaccgggcctaagtacttgtatgtggcaaaactcattggatgtaggatctgaaaatataggccctgtttagttcccatgcaaaaacttttcatcatgtcacatcgaatatttggacacatgcatcgagtattaaatatagataaaaataaaaaactaattacacagtttgcgtgtaaattgcaagataaatcttttaagcctaattgctccataatttgataatgtggtgctacagtaaagatttgctaatgacggattaattaggcttaataaattcatcttgcagtttattggtggaatctgtaatttgttttgttattagtctacatttaatacattaaatgtgtgtccgtacatgcaatgtgacacactaaaatttttcacccctagatttaaacacagccatagtggcctttttaacttgtacagatttgtgagatgactggctaattattgaactgcaccattgtagaatctccaacttctacgaacaaattatgggacagtacgcctacatcgaagcaccagctttggtgcattaaactggtcacattactaaaactaaacagcggcaaacattattatgaccaacaacaaggagcacaaaacttgcagataaatttttggaaggatagtgagtgagattgcctacttacatccctatatatatatatatataaacaaataaacattaaaattaggtatatactcaatttgaatcttggagtccatactccatgtagtaccagttaatttacctatacacatacacccctaggtatctgaattttttgtcccgaattaatatggtcgagcgtgtgggtggaaaatacctatcccgttttcactcctacttgtgtgattgtaacttgacactagatgaatagggtgattgctgatcgtgtatagttggaatatatactataatcgtgtattagggggcagtacttttatatgaacgcggagctgaaacaagccgatccaagccaaaagattcaagctttgttctttaccttccccctaaccactctaccacagtcagagtgattaattataatcgccgaccctggaccacgcgtagtatatataggccacaatcggcagtaaagcttttgtcgagtcaagtgcacgatagcgtggttagtttgtggcactcatcagagctaattaagagccatggccatggagaagagccgggtcctcatcgtcggtggcaccggccacatcggccggcggatcgtggcggcgagcctggcggcgggccaccccacctccgtcctgctccggccggagatcggcctcgacatcgacaagctccagatcctgctggccttcaaggcgcagggcgcgcggctcctcgaggcgtcgcttgacgaccacgatggcctcgtcgccgcgatccggcaggtggacgtcgtcgtctccgccatgtccggcgcccacatccgcagtcataacctcatgctccagatcaagctcgtcgaggccatcaaacaagctgggaacatcaaggtaatttattttctatcagctcaccaaatcagcacataattaattaaaataacttgatttggctgtatgaatatagatgaaaacgcttctactcgagcatccaacaaaaacagaaatatcatgagctcctcagttctcagccactcattttttatctcaatttccatagccgtgaatggtgagtgatgacagcttgggaggcaaggcccctctccgtctccctctcttctcccactcactccctcctcttcccctcttccatgactagacgatggacacaggcaagcgtctgaggtgacgtcgctacggtgggatgagttcaaggtcatagtggagcttgtgatctggggatggctagatttatctctgtggcacacgagtgaaggaggtagttgtgggagggggaggtctggcgctgaaggtgacatgcgacgacggcatggtcaccggtgttggagaacatgatttgatccggagctatgtgatgatttttgtgttgagcttcagaactaggcaacgaccgtccttctcttctcacattccagaagactggtgtgctcaaggacgacgtcgtcgcttcacgcacaatggaggagcatcacaaaagtggatgggcgtgttgtgaatttttagtgtttcagtccatgcatctgtatgtttcattcgttcgagaaaattgttgcagtgggtattggatggtgtttcatgttttctttcttcgattttactcagatctacagatgtagcttaaaatcatttgtttcatctacttatttgtttcactattttttcaagacttgaaacatattttcattaactattgaagcatttttgtataagcggttaaatagcgtccaatttttggataaaaaaacagacgttcgatttgtagttgtttcggaatatagatatatgatttctatccactatcttgaaaagtaaaagaagttttatatatatatatatatatatatatatatatgtatgtatgtatatatatatatatatgtatgtatgtatatatatatatatatatgtatgtatgtatatatatatatatatatgtatgtatgtatatatatatatatatatatatatatatgtacatacatatatatgtacatacatacatatatatatatatatatatatatatatatatacatacatacatatatatctcataacttcagtaaaattatggcaatttttactgatatgatatatcgatgaatgtgaacgatgcgagtagatggttttatcttctatagagtatagctcatggacacaaaaataagttatttaattgagcgatgttttagtgtttttttacttatattattatactaacagcagaaatgattaggggttaatttgtcatttatgttttattcccctctagatcgatctgtgctcatccgttgcgttggcattgcttatattctatggaaaaatcagaaaaaagagagaaaaaaatttagtcactactaaattacgattttttatataataatatcccttcatgtttctattaccgttaatcacctaattagggtgatagtacaaatagatttatttgaaccctttgatcaaaatagataatggatcatattgatttctacttttatagtatagaacaccatagtgtgggctcaattacattttcaatgagcggtacaataagatttgtttttttacctaaataactagtcggtttgatttttcttaatgcttaaactaaaaaatgtcacacattaaaggatgaggataatatcagattgccatatatttactatgaatacttatctgcgagcagcgtttcctgccgtcagaattcggcatggatccatcgaggatggggaatgctcttgaacctgggagggttacattagaaactattaagagtggcgggctgggcggccgctcgcgcgtgccacgtcggatagctacagtacgtgggtggaagtttttcgaaaaagtccttctattttttgtaatatataaactgttgcttcattgctttaattttcaggagaatgtttgttttaatttgctttaactgggagggttacatttgatgagaagatggagataaggagagcaattgagaatgcaaacatccctcacacatatgtttctgcaaattgctttgcagcttacttcagtcctaacctctgtcagatgaaaactctcctccctcccaaagagagagttggtgtgtacggggatggtaacgtcaaaggtaaaaaagttaattacttatctataaactgttgcttcattgctttaattttcaggagaatgtttgtctttttctcatggaaagttagatttgtactttttcttctctttttagaaagttgagatttatctttggatcgaagtgtacgtccatctttttttttctcattgtcagtggtcccattcgatccagattctgtgctgcaaataacctgttttcaattcttcattattggtatttccttttctttttcagccatttttagttgcacgttttgttgccacttcgtaaagttcatttcatctaccgacttttcatttaaaaatattaatttattgatattttaatgtacaaatttattagagcaggacaagattcctaatgaaccgcttttggttctccatcatttaattcaattatcattttttaccttattaactttt

SEQ ID NO: 30722 - DNA, 637 bp, Oryza sativa
agaaaccgagtagtagggaggaagaagaaaccccagcaagagaaagaaagagagaagcagaggacgggtagtatttttcctctctttttcgatagatgtcacgtgcctacgggctggcgatttatacaccacacacccgactcaacaaccgttagccccacaagccagtgtcagaaatcagtacatagactcaatatgctatagccactcgaaaacgtcttttcgcagtacgtcttcagttcgacacacctccttcggtcgttgccagtagctcatccggcataggcataacagttgccccccctggaattggagcttgtccccaagggacagcgtccggaaatctggtgcgaacaacgtcagcatcctcccaggtggccaaagcagcaggaagagaaccccaacacgctaagttctggaccacggcagcattgcgggatgaaagtggtacggataatttccgaattcacttcggtcggatttttttcggatattttcggattcggatacgaattcggatagtttttctcggaaacggattcgaatacagtagcgatggtatccgtcggaactcggattcggtcggaaactatccggactttttttccggatatccgaatcaaaatcaacagccaaa

SEQ ID NO: 30723 - DNA, 380 bp, Oryza sativa
aaagcaaattgcatatctgcttgcattaaaaaaattgcatatcaatgatagttaggtcaataattgtttgaaattgaaccccatgagtaatggtatttaaaaaaaagaaaatagctaaaagtgcacattatcaatttggtaatcaatggaaaacaacatcattggtggggtgctgaagctgtaattgtacggctccaaccatcaagagcacttaaatcaagtacgtcttggtgttcatgattagatgtgtgtgtatatatatatatatatatatatatatatatatatatatatatatatatatatatatatatatatatatatatatatatatatatatatatatatatatatatatatatatacatatatatatatat

SEQ ID NO: 30724 - DNA, 593 bp, Oryza sativa
cggcacgaagaactctccatcataacttggccactgcgatggatctaggtaagggtcaaacctaggggagtacgagtcctgcacagccttattggaagcttcataacacattcggggggccaccttcacatccaaacctcgcaacatacaaacggttatcatgtgggagcatggcaagtgatggagctgaaggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaa

SEQ ID NO: 30725 - DNA, 5170 bp, Oryza sativa
agctcgccgtcaaggcgcagggaaagtagtctccaataagccgtcaggatcaggatcgcccatcaacaagatgtccttcaagaaggccgacgaggtgcgcgtccgcacccggtggggaggctagggaccacggcgctgcgcctcgtcatgtggctcggcgcggtcgtcgtctccgacgccgacgacggacacctcgaggtcatctacaacggcaacttcccgcgcgacgaccccttccggaccgtgcgcgtcgccgtcaagaacgtcaagctgccggcgccgcgcccggccccgaccccggcaaacattgcggccccgcggccgaacaaggccggcaagaatctgccgcggctgaagatgtttgtgctgaagaaggagcagctgcgtgccaaatccgaggcctttttggcatcgtgatcagtgttcttcagtaggtgcagtagctgcagaagctcgtataaatcagaacatgtcttggttttgcatggaaggcaatgtggtcttgtaaattctcatagataggatgatttcttggcatgagaagaagaacatgcaatctgttggaactgtaatttctcattgattatgaatgaaagatcgaggtttctcttcttgtttcatttttttttaccaatatatgcatgcatgatgcatgttatccttggttttgttgatccaagtgtttggatcagaatcacaatccagctgccctctgattacatgtatgattacaatccacctgctgataactttgatcttatagctaggattcagcttccaattctttgaatgcctttggctttccttgcctttgttgatcaagagagcctggatatgcagcaaacaaagcatctagctggtaatgtcattttcacttttcgttcagacgaaccgtttggctctcaacaacgtcaacgaatcccaaaagaattagtagtagtctgttcacaaagaaatttagttgaggcggcaatgttattttgtttccctttgttgctccgaagagatgtaaactgccgaactgtggattaagtagtgggctttgggccaaatacgtcatgcgtggtggacaggatttatgtgacatcggttttctcggctagtgggttcaagcaaacaaggccggaggacctagaaatggggctccctatttttgttgtaaaaatcgggcattgtttcagttttttaagaagaatgtttcaccactggtttaacacatgtttcagactattaaaatgatgaaacatgattgaatcatggattgaaacatgaaacatcaaagttcaattactaaaacaccaacaaatccataaaaatcaaaagacaaaattgaaacaccataagaaatctcgctgtaacaatttgatccaatcacaaagaaatatcgagatacatcggctaaaacataaaaaaaatcatgaaaatatcaatcagatctggcttcctccctctcctccaatggctgcagtgcaggagtagaccgaaaaaacgacacccgtagacatccagcaagtggagacgagagctctggcgacaaccgcggtgaagaagacgaccattgccgccgttcacggccggacaggaagctgccaggttgctccgtgtgagtcgaccaaccttcgcctctgcctccatgtaaacacccctcaatcacagtcaggcggcatgccttgttccatccttggacggatgagctgatgtccaacatggtgtcgatggtggcggcggcagctgtggcatcaagcagagaaaacatcgtcgaacgtgagagagagaaagggaggtgcgagaaagacagagtcacgggtggttgggaaatagcgcccgatattttcttctctccgtcgggcgcacgataaatagcatttttgaaacaagaccaccagaaaaggttttttttttcttttttgaaaaactaggaagcaagatgccgtctatacaatgggataagttatatatgagtgaaccgttattttccatgatttagatatgttctaagtgcatgcgaaggtgggctaggcgtaacgtgaggaggcagaccgtggtaagctggttagaggctagagtagcatatactgtatactattatactagtttgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtactccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgaccggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaaggggtcggggtgcctcggccctcggggccgagacgggagcggtccgacccctcggggagacaaagagaagggcggccgcatcaccctcgggcccgacccccccccccccccgagggggttaggccacgtgggtgatcgtgtcttcctcaagtctctaagtcatgatactcccagtcccatgtcaccgacagcagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcagcgagcgtaattaacgcgcgcatgagatgttccatctcgactgccacagccgcatatccacctcatgcaccgcaaacgggcgaatgggattagtggaagcgtgggtgcgagaaacgagggtgcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgcctcacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcaaccgcttggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcgtcggaggagcaggctcctcgaggccacgatggcgcgggcgggagccgcaggggggaacaatctaccccgggagggggtcgtgcttctgggccccgcgacgggggcccggggagcggccgccctgccaacgcccgggggaagaggaagcaggaagaaacccctcccccatctcctccccgagggggcggggcggcgcgtgccagcagcaggcgcccggagggggccacgccgacgtcgcagcccgagggggagcggaagaagaaacggcttcgcaagatgggggggacagaaccatcccggggaaacctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtctggccagtctgagcccgaggacccggcgaccacagaggctcggaggcgggaatctgaccggcgagaagccgcggatcgcctacgggaagccgaggaggccgcccaggtggccgtccgagctcgccaagct

SEQ ID NO: 30726 - DNA, 32089 bp, Oryza sativa
  unsure (1)..(32089): unsure at all n locations
ttccgttgctccactgagcgcagaaccccttctgcaggccttggccgtcgcaaacaccacggtgttggacgggttaagtgcccaggtggaggccctgcaggcagagcgggcggagcttgacgccgcatgggcgcgtgtcgaagaggggcgacactcggtggaggccatggtggaggtgggccgcaaggcacaccgccggcacgtctcagagctcgaagcccgtcggaaggtgctgggggagatcgccaaggaggtggaagaggagcggggggctgccctcatcgccaccaccatgatgaacgaggcgcaggacaccctccgccttcaatacgggagctgggaggcggagctagggaaaaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagtgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgagctcgaggcgcgggagaaggagctggacgcgagggcgcgcaacggcggggcggccgcgggcgaaagcgacttaaccgcccgcctcgcagctgccgaacacaccatcgccgatctgcagggcgcgctagactcgtccgccggggaggtcgaagccctccgcttggcaggcgaggtagggcccgacatgcttcgggacgccgtctcccgtctagaccgcgccggccggcaggtgggcctctggggcgggcggactgcgaagtacgccgccaaccagggggcctcgcccagcgcctatcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggcgcgcgcgcgcaggtccgggacgtcgccgaccatatcgtccacagcttcgagggttcggcccctcggctcgcgttcgccctcaactccgacgaggaggacgatgacggcggagtgggcgacggtggcgacgaggctggcgacccgggtgcatcggagtgagcccccaggcccccgccaatctttaaatagcttcttcttttcttcttccgaggccttcgggcccccttcttatatagactaatttaatctgcaatcaaataaagaggaaattttttgtgtcaattctatttgttgtgtgtataagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacaacctttaggaaattgaaaatgcttttattgaagagagaatccattatatgccactgactttgtcacacatctacgatttaccatcgactttgtcacattctacaatataccatcgacttttgcttaacttctacgatttaccatcgccgtccaattagcctccgttagtactgtacaattttatccaaatgaccgaaatacccctaaaacaaaaacttccaaaatttggataaaaaattcaaaatatcatattataaacataagattgtaaacatccaaaatttggccaacaacttaaaatcttatatttcagaatttttatccaaattttgaatgtttttgtcccaggggttttttggtcattttgacaaatttgtacagtaccaacggagactaaccggacggcgatggtaaattgtagaagttaagcaaaagtcgatggcatattgtagaacgtgataaagtcagtggcaaatcatagacatgtgacaaagtcagtggcatataatggattctctctttattgaaatacagatataagagaaataagaatatgcatatgtggtagcccccggccaaccctgcacgcccgaggggggtgcggggttggcccgaggccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcataggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaagtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcaatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgtgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtccttgggtagagtcttatctgtgaggtatgcttggatctcagcgatccaagcaatcaatctcagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccagtggggtctgggctcgcgaggaagcgagccgtgagagttcgtcggcacccgtgttaccccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggtggtgtgaggcggctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcaatttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccgagcggcctcgcggggtgcactcgtcttctgtgccgacgacctcggggtcggaggatgacaggggcggccttcccacagtggcctcggggccgtcctgggggtcggggcctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccttcctgggggtcgggggcacctggcaccgtctgacaagcgggcagaggggcctgctccggtcgtcgggggccttgggccaccgttcggctcgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatatgccttcaactgagtgagggcacgttcagcttcctccgtccaaataaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtctccgctagatccaagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcggatctgatggtaaccagagtatgcatctaggaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccgaaccggccttgcgcccgaccttacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtggtcttggatgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgccgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccacctaaggtgaccgggaggtcgatatgacctagcggccaagtgtgaggcggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccctgggcaacgcacggtgggtggtcggtctggtcgaaggtgagggcaacctccgaccaccgcgcccggcgcgtcgcctcatgagtaggggccgcggccagaagctctcgcttcatggccttgaggctccgacgagaaaagtgagcacacgctcccccatcgagagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacggtgcaccacttgccggttgggcactccctgctgggagcgctggcctccttctttttgtcgctcgcaggcctcccctttcgggtggcccgcggagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcacctcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcataaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgtgtccgtgtcgaggtgacactccggacgaggaggcgccctccgttgcgtgggcagcacgtcggccattacgccggtgctcgatactgatgcgggcatctggccccctacgcagatcttcccgggtcggaggcgctgacgaaggagtggcggccgaatggcgagcaaccgccgccgctcgccgcgccctccgccttgacgacacggagccggtggtagcagctccagaggtcttggtggcggtggaccgctcaccagcacctaggcgctgtcgtgccgtcatgaccaagttggccacgtcgtccagccaacgttgggctggagactccaggtcagggacaatgggcgggtgacgtaggagcgcgcccgcagcttggagcgcgccctggggcgtgctgccgtcgccgtagacgaggaggcgacgctccccatctcgctgcccttctccatcacccgtggatgtcgaagtcacggatccttcgaccctctcgagcgcctcctcccggctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagaggcccctacctggcgcgccagatgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtcctccttttatatctcaaggggataccacatgccccctctctccctccaacttgacttctcttcattaatggacggagatttgtatggctgctgtccgaatgaccttctgatgggacggcccatacctacctccacttctgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgactggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgcatcaccctcgggcccgaccccccccgagggggttaggccacgtgggtgatcgtgtctgcctcaagtctataagtcatgatactcccggtcccatgtcaccgacatagtttttttagtaccgctgtataccacacttttctaagtagtactggcttttcattggtacacctttttatgcatccaaagttcacactagagacctgctctaagagcaagtacaatagcaggctataagccagctataaccacatatcgagaagaaaagagaagagagaaaagaaagcgggttacagatttgtaggcagctgcaacacggaccccaagccgttgtgtgtgtataagaggtaggacagtgtattaatggtgtagtatatttttataggtaactattgcatgaatgagttattagattagctatagatgatttggagctaatatttggctatactattaaacttgctctaacactcttctagtatgtctttttatgcactagagttaagagcttgggcatatgtatagtattcctcatggctctcgttggctcgaagaccttatacccacaaatcatacatgatacgtgcagtgtatttaatgtctatgtatcgagtccttgatacctagatattaggtaactggtacctagattattcgagttagtaccataggtactagacctgatagtataggtatcggggtacttggtccctagatcaggatggtatccataagtaccagacctggtactaggtatcaggtacctaaataccatgtacttagtatctacatcggtcagataccagtaggtaccagacctggtactaggtatcgggtacctaaggtattaggtacttggtccctagatcgggttgatacctataggtacctgatctgatattgggtattgtgtagctcttaccaggtatcaggtacccaaatctattaacttattaaaggaatagaaaaaagagcctccatattcactctcatggcctagaaattcctacattaattggagaaaaagaaaacagaatccatatagaaatacaatttaaaatagttaaaattcagaattaaaaaataaggaatattgggagaggagactagagtccatatagaaatacaattgagaaacaatagaaattcggaattaaaaataaagaataatagtagtagggtatagagtccatatagaaatacaattaagaaataatagaacttcggaactaaaaataaggaatattagaagtagagtagagagtacatataagaatttaaaactaactaaaatttggaataaacataataaatttaaaagtagagtttagagttcgtataaaaatacaatttacaaataactaaaattcgaaataaaaaaaacatgggaagaagagtctaaagtcaatataagaatacaatttagaattaacttaaattcgaaattaaaaattagggaatattgaaaaataagtttagagtccacatagaaatacaattagaaataataaaaatttagaattaaaagtaaatcatattggaagaagagcctagagtccatataggaatataatttacaaataactaaaatttgatattaaaaataattaataaataacttgtatataaaatacaatataaatattatacattactagtttcgtaaaggtagtacaaaatttaaaattatgttgtcattttaatatatttgaataatacattgagaaaacatattgtcatggttatggataccacatacctaatagtaggtgactaaatctcggcaggacccaccacataccatgtcctatacggaaacaactttcggatataggaggagttccgataaggaaagacaaccagagttctacatgaaaacgacaagtactactcggattgtagccatattggtttccctagttctacttggacaagaggacacctatgggtataaatacaagccccctaggaggacagggggacacccaccatgagacaatcaacacccaacacaatcgacatagaagcctacatacgccaagacacaccgccggatatcgacttcagggataaacacggctagtaccctacggtgtctccggatactgtcaggagagacgaaagcgctaaccgggcacgaattcgaggtggaaggctaccctgttgtcgactacgagtcagatcatcagaccgacatgttgacaacagttagataggctaccccaaacattgtactggtgtggttatcataaataagagcaataccagcttcggccaacaagatgtagggttattacctgacaactcatgggcccaaacctgtataaaaatcctcgtctccatctcttttacctcagtctcgcatatatcctagcaccgacgatccccatactgtccaaataccgtagtcgagacatcaaacgtcgacagtggcgcgccaggtagggggattttggtgcttcagggtttcgacgagatgagtttaagagatggattctccgataacatgctactcgacaacttcggttatggggagatctaatccgaccggagtatgtcgtccaataagatcggaaccatcattgtcaaattttcgatccggcgagatcgatcaatcttcatcaagacgtagccaccatggaggacggcaaatcggtattgccgcccgcgcgacttcggcccagatcgaacacggtgccgattcccaccaaccaaaatcgctcaacgcaggctgcacatgattcatccgagaacaagtgccgctgtgtcactgacgtgtcgtgtcatgcctagacacgtgtatgcatgtgacaggttacactgctctacgaccaaaccaacaagatacgtcaaagtctaccgcatgcacatatatatatcttctgtagatagtatatcgggcatgcaaatcaaggtatttagtggattaatttactaagttaatctactaatttcgtagatatattcggcatatatctacaaaggtacgcaatattttatatgcaatttatcgtacctattcagatcatacaacattgtcatatcagtaatttattatgtttacctagagcatattttttatacaatatcaattatgcgagtgtttccgatgttaaatcaactacggtttaacgctggcggctcgctctgttttcttctgtataaatcatgcttgtttacggtttacataatgcctgatacttacatctgctcgttatatcctgataattctagaagatccatgcagcttttcgaatacatactcgatattatctgctatatatcttgccttctagaaaatatttttcaggaacaattgagcactcgggtaggttatggtcgagtacactccattatcgagaacattctcgacaaatgcggagttatcgcacccaacctaccaacgaagaccgatgacctatctcatagcaccggccatcgctggactactcgagaaaaggttgttaacagataattcctggcgaacgccgttggcttgatcacccgacatgattgagaacggacatccggatataccacgagttgggtgtgtgagtcatgctggccacatgagacgcacatgtaataaaccaactcgagcagttccattggtgctcgagagataattctactcgctcgctggttctcgcaccaagacgtagcaatttctcacaccacagcttccattggtgctcgagagataattctactcgctcgctggttctcgcaccaggacgtagcaatctctcacaccacagcttccattggtgctcgagagataattctactcgctcgctggttctcgaaccggtacgtagcaatctctcgtgccttaacttcagatagttgaggtatgactacggcggcgtagcggtcctcgcaccatgacttcagatggtcgaggtatgactatggcggcgcggcggtcctcgcaccataacttcagatgattgaggaacagctacaactggtcttcgaccggcagcgtagcgatcctcgtgccacgacttcaaatgattgagagacacctactcaccggttctcaaccagttgatcgtagtgatctctcgtacatttgcttctagtggtcgagttacgactactgcctggtcctcgaccaacgatgtagcgtctctcccactacttccacttcaagtggtcgagttacgactactgtctagtcctcgaccagcgacgtaccgtttctcccaccacttccacttcaagtggtcgagttacgactactgcctggtcctcgaccagcgacatagcgtttctcccaccacttccacttcaagtggtcgagttacgactactgccttgtcctcgaccagcgatgtagcgtctctcccactacttccacttcaagtggtcgagttacgactactgcctggtcctcgaccagcgatgtaccgtttctcccaccacttttcactttaagtagtcgagttacgactactgcctggtcctcgaccagcgacgtagcgtttctcccactactttcactttaagtgctcgagttacgactactgcctggtcctcgactagcgacgtagcgtttctcccactattttccgctttacgtggtcgagttacgactactacctagtcctcaactagcggtgtagtgatttctcctactacctctacttcaacaaagttgatagcaggtatgcaatatcgccaagtgttttacccagagatcccttaccacgacgacacctagagttgaaacctatcctactgtccctttacgccgtcttgacaaggcctccgaggaacctaagggatcttcggctggggacgcctagaaccgataaggccttgtcggatcctgtagagaagaaagaccatgtaagatctggtcgtgtaagagttctcgccgtgcgtattaaccaagccgtgtaatcggaaattaactttccaacttcacggctgggggataggatcagttcttgttcaactaaggcaggtcaagggtccaagagccttatcctccgagaacgattctccgacgataaggctgggggctagggagagtgtatgactctacaaactgactgatcgaagtcggtaagagagaagacgcttatacacaaaacattggtcggtaaaattaattcattttttccatacatattataacatgtcaccctttgagcgttcgctcgggggctatttctatttgatattcttttctgagtattgatttcaggaaaattctattcgacattgacgaagactccatgtctccatggttctacaccaagatcgactgaggcgagtacgacaaatgtcgacaaggctccgtcgcagactctacgccttctcgatcactcgagaatggttgctggatctcgacaaggaatacggaatgaagaaatggtgtacccgccgagataaaatttcttgacttcgatccaaattctcgattacagcaagacgggagacttagtcgtacgctctgtactttttcggtcgacatcagagattgacttagacaaaccctttcggtgcccgcacgaggctgacaaaggaagtctaacgttatctctgaactcaccgaaaatggtcacgtgagctcgataacagttcctccgaagtctgcagttgagaatatgaactcgttcatttgcatcgaagtcgggggttactgtcatagttatggataccacatacttaatagtagttgactaaatctcggcaggacctaccacataccatatcctatacagaaacaactttcggatataggaggagttccgataaggaaagacaaccagagttctacatggaaacgacaagtactactcggattgtaggcatattggtttccctagttctacttggacaaggggacacctatgggtataaatacaagcccccctaggaggacagggggacacccaccatgagacaatcaacacccaacacaatcgacatagaagccacaacatagaagcctacatacgccaagacacgccgccggatatcgactttagggataaacacggctagtatcctacggtgtctccggatactgtcaggaaagacgaaagcgctatctctgatctcgccgggcacggattcgaggtggaaggctaccctgttgtcgactacgagtcagatcgtcagactgacatgtcgacaacagttagataggctaccccaaacattgtactggtgtggttatcataaataagagcaataccgacttcggccaacaggatgtagggttattacctgacaactcaggggcccgaacttgtataaaaatcctcgtctccatctcttttacctcagtctcgcatatatcctagcaccgacgatccccatactgtccaaataccgtagtagagacatcaaacgtcgacacatatatgttattatatgacagaaaatataatgatgctaaccgcgcaatctgcgcgggccaccatgctagtttacactgatgttagcatcttaacaattgaaactggtgtgttgtgtcttcagcaagacgacgtgcgctgacatgtggccccttgagagaacacgaagagatgtggattgacatgtggatcctcacgtggggatttacgtgaagttgataaaataacacaagtgattggttgatcaaatagtcacgctcatcaagtttgaccgtaatctgaagaggcccaatataatgggaaagtgatttcatccatcacggggatattccctcgtttcgtgcatgccacctaaatagtcaccaaaaaatttgaaaaaaaaattggtaacatagaataatatgagatatatcactctacaaatatgcatgtttaaattaacttctataagttataataaaaataaaaaatatagctgcaaatgtatgataactatttttagtttaatttattacttttgttgcaacttgtagaagttgaatttggtcttgtatatttgtggagtaatatatttcatattaatctatgttgtcaattgtttttaaatttttaatgactacttagatgacatgcaaacaaggacatatccctcgagagatcacattccaatataaccacatatgtattgttttagactatcagtcgatctctcgtaccattttcgggattggtattgcttacgacggcggtgcaaactgagccgccgttcccttaccttccggcgacaccttcagattgaacaatgccgcgcagagattgtccaagtagaatactggatcagttaatcacagccaagctaatagccgacttgaactcggacaccgacttcaattccaactcggactcggctggctataaatccatgcgcggccgcctccgcattcaccagcaattccttccgccaatcctcgcactcccagcagcgctctcgtcgtcaatggcgcttccccgccgctcgagtcacatctcctcgcgcccgatcatccactgccgcagtgagctcgccgtcgaggcgaaggggagagtagtctccaagaagccgtccggatcaggatcgcccatcaacaagatgtcctccttcaagaagggcgacgaggtgcgcgtccgcacgtcgttggggaggctagggaccacggcactgcgcctcgtcatgtggctcggcgcggtcgtcgtctccgacgcagacgccgacgacggacacctggaggtcatctacaacggcaacttcccgcgcgacgaccccttccagaccgtgcgcgtcgccgtcaaggacgtcaagctgccggcgcggcgcccggccccgaccccggcaaacatggcggccccgcggccgaacaaggccggcaagtcgctgccgcggctgaagatgtttatgctggagaaggagctgctgcgggccaaccccgaggccttgttggcatcgtgatcagtgttcttcagtagtagcagtaggtgcagaagctcgtatgaatcagaacatttcttcctctgttcttggtttgcatggaaggcaatgtgatcttgtaaaatgtaaattctcgtagataggatgatttcttggcatgagaagaaggacatgcaatctgtcaactgtaatttcacattgattatgaatgaaagatcgaggtttctcttcttgtttcatttttttaccaatatatgcatgcatgatgcgtgttatccttggttttgttgatccaagtgttcagatcagaatcacaatccagctgccctctgattacacgtatgattacaatccacctgctgacaactttgatcttgtagctaggattcagcttccaattctttgcacgcctttggctttcctttcctttgttgagaaccagggtatgcagcaaacaaggcatctagctggtaatgtcatttctattctgaattggatagtggtttgtgctagtctctgtgccatttttcttttctgaaaggaaggcaagggccatatgtatttccctcactttggctctcaagaacatcaacgaatcccaaaagaacctagacatagctaggcttagtcttttttttgacggcaagagtatttggtcctcttgttttttaaaatactagcaaaatatctatgcgttgtaacgggtgaaatcgctcataaatcatgtcttttaccaacttaatcttataaggatagctttaaaagtcatgatgttcgttttggaggactaaatattgtttacattaattaaaaaaatattttgacatgataggttctgattataatgggatagattgatgaataaactcagaggcacataagttattttcacagaaggatcaacatgtaaattcgtatgtgatccaaatatatttgagaatcagtttgatctatgttttgtcccagttgtcttggtagcttcatcccaattaggggtgaaaacggtcacggaaattcccgatcgatcgagcgccgtttccgtatatttaaaatttctaaacatgaaaacaaaacctatatacaagttgtagatatagatgcgatctacacttttcatttgagcttatctatggtattaaatatagattataagtttggatgatagtagtcttaaaagaatagcatttgtttcgaagacaaacagtattcttttcccctctttcccaactcacttctctcattttccacgcgcacacttttcaaactactaagcggtgcattttttgtgaaagttttttatatgaaagttgttttaaaaaaatcatattaatctattttttaagttttttaggctaactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttgttctgacggtaatatgtattatcgattttaatttatttttaatcttaaattgttggtttaattatgtatagagaaacagttagattagatataatatgtatagcttaaaataactaataactgtggttgtttttttttatcataactactaaaaaaatatagatcagtggagggggcagaaagtgttgtgcgtgtctaatggtgggggtgaggtggaggggactttgtttttctattttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcgaattagctacgtaatatcacggtaaagccatgtaaactgatttaattagctgtatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatatatatatatatatatatatatatatatatattgccgtgcatataataaatatagctatgattagtagtaatacaatatgacagctaattaatctcaacttctaacaaccatagatactaatcatccttccggcaaaccatacatacgtacgggagaaaggtagatctaattcattggtataaaataatgggtccaccaatttaagtgaaaatcaatgacagataaagatctaatctaacaatgtaaaataatgggtccacaatttaagtgaaaatcgacagtgaaattatattgtgccatatggcggcctaggagcatttgtaggagcgccatgtgacggcttgaaagcgtttgtagaaagtttaatggacttttagtatataatagatagatacttaattaatctcactataatcgcgtgctttgttttctgtgtcgggaggcaaggttggtaaccatgcttccgaaagtgtttgtaggtgagatgtaaggtgactttgtttgaagcaaaaagtcttgagtttgaatttttcttagtacgtgtatatgaatatgggcacatgtatcatgtgatttgtgggaacgagagtatgaattttgcttagcacgtgtatatgaatatgggcacatttatcatctgatttgtgggaaagagtgtgtatatgaatatgggcacatgtatcatctgatttgtggggaagagtataatggtatagatgcctaaaaaatacatcaaatatttttttttgatttttttagcacctgcaaaaataaaaaacgggtgcacccctacacctataatactggttcaagaaccgacggtaattggtgccggaacctatatatgatataaacttttagaaccggcacattagtgcacggaagcaaggaatacatgtccctccgttaatatctcgttccatttatcggattggtatttcttatggaggcggtgtgctggtgcaaaccgagccgccgtcgtctctttgccctccggcgaggcggcgatacctccatcagttcgcgttcccgtagtagcgatctcagatttcgtatcggtctcgattgatcaatgccgcgtagagcagaatcggattcagaaggattaaccgttaatcacagcctctaagcaccgacttcaactcgaactccgtctccgacttgcttccttcaccgatttcaactcggactccgcttcggctgccgataaatcctagcgcgccgcccctcaccgtctccgcattcaccacaattccttccacccatcctcgcagcagcgctagctcgtcgtccatggcgcttccccgtcgctcgagtccccgctcctcgcgcccgatcatccaccgcgccgtcgacgccaaggggagagtagtctccaagaagccatcagcagggtcgcccgtcaagaagatgtcatccgcgccgtcgacggcgacgcccgtgtccttcaagaagggcgacgaggtgcgcgtccgcacgccggtggggaggctaggcaccacggcgctgcgcctcgtcatgtggctcggcgcggtcgtcgtctccgactccgacgccgacgacggacacctcgaggtcatctacaacggcaacttcccgcgcgacgacccattccggaccgtgcgcgtcgccgtaaaggacgtcaagctgcccgcgccgcgcccggccccgaccccggctaacatggcggccccgcggccgaccacggccggcaagaatctgccgcggctgaagatgtttgtgctggagaaggagcagctgcgggccaaatccgaggccctctttgcatcgtgatcagtgttcttcagttgtagcagtagctgcagaagcttgtaggaatcagacatgtatctgttttcctctgtttttttgacagtgattgtcgtaggtaggattattttttcgagttcttcgcatgagaagaagaacatgtaatcatcatcgattatgaataaaatatcaagaattcatttatacgctggctcgttctctctgttatctcaagaacaataaatgcatgctatccttatttgttgacgagccaaatgttcgatcacaatcatcaattcatcataactcataaggtggccaaagtgaaattaactctaatctgaaagaagatataagctgattgcacacttcacaccagtcctatgcactggcctatcctggaacggtggtgatcaaacttatcgacactcgatacagttatcctgcagtcctacgggagtatgtcaagaaaccaagacggtttggtgtttgacacttcaaaacttatctttcaaatctcgttttccatttataccacctttactggataggccagtgcataggactggtgtgaagtgtgcagtgaattagtgaaatcagcttagatcttctttcagaattcagatcatcactgttgactgttttaaacccagaaacattctggtatgggcgtatgacaatcacggtatttgcaaatttgcaggtagcaaccagaagaagaaacagacgacaagcgatatttgttctagctaagcaaagcatgaaaactccagcatatacgagattgtgccccataggcatgatgatctgatctcaaaacacatgagaatacataggagatacggtctctactcaacgcctcagcaatcaacatcacaacaatagtcagctaaacggttgcaactccttgatgtgctccaaggagaggatcagaggactgcctcaatggtaacctagtaacctaccaatatacggccacatcaaacttgctaaatttttcttttcagggaaggatcgaggagttaattctcgataatcacagcaacagtctatgatcacgcttcctgccatgctcaaagaaaaggatctcaggacggagattggcctgactgtaccggtcgattaatcctttccaggattcagcttgctgcaaggagacgaacatttacgaatgatgatgatatcgaataattctgaaaccaaattcgagtgaaaactcaagtgcgaaagctgacaaggaattgcctggactgtcgtgctgtcatgtatgagccaccttgcctcgtcacgaccaaagcagaggtattgccgcccctcatcatcatagcataccttccattaaaaacagtttgaaaattacccagatgctatcgcgcgaataccagaaacagaactccatactagtcaggcaagcattacttacgataatctgacactacaattgcctattgccaagcaactgatccgaccaaagaagataataaaatatactcctacaatgatctaccaacatgatagcaaagcaatatttgaactgatttgacaggtataacataaatgacaaatcatacataaataaaccccagactagtacattagatactattcatatacaaaaacacactgaaactgagaagaaaaggtaaagaacgaatcaacctcaggaacaaatgaattcactttttttttcacagatatgcataaaaaggaaagacttctctcagcacgtactgcagaaaccagagtgtacatgctttctgattgcagaccttcgtagatatgactaatgtccaactccgctgctaggctgatcaatactttatgcatgttaatatggtttcccttgttgtctggccatctcaaaactgtgacaaaacagcaatagaagagaaactaaatcagcttgcgtgcatccccagtcccgaccaaggttcgagtcctctatctcagatctagcgtcttcttctcaatgacaccagatgcctaggtcctcctagatattctcgatttaggctctaagtttaggtcgattgatgaaagatgcagacatctgtccccattactcagcttaaaagtccccttatatttcttttcttcatattaataagaagaatgcttgttgtctcctaggttttccctaattgccagaaatgaataaatgatgtatgtgcacagaaggctggcatcaaattgtcgcaggaaaggtcgtggcgattaattattttatgttgcagccattacaatagcagatatggtgtaatttatattcaacgattgatatggttttcaggataaaattaaagatcagatgatacactgatccaatgatttctttcgcttatctttcctttctcctacatagaagaaacatatgcacacaattacattgaaatgttagtcgagaaggcggtacctatcatgaaaaaatgtggtggataccataggtatcgggtaatcctatgcccacagccaccattcctgaagtcacaaactgactgcttgtctacagctttcaagagttcactgaaagactccaactgaataagtaaaaggatgttagtttgctaattaaagaaaagatggacatataaaaaaggaaatatcaaaaggatacactgtgcagtatgtaccgtagttccttcaacagaacccaaattaatactgtggaagaatgtagacttggttttcatggggacctcattcacacagttgcatttcttctcaataatgtgcaacccaaaaagattgtgtgctaggcatatacaacccagaaggctgggcactattgctgtttgtggcaccaaagattcacccttgaactcaaaatgcaaaggagtttgtgccacgtgcagcctctcaaggattgattcaacaactctatacgcagaaatgtttccagcctaaaaaaaaagaagaaccagtgatcttattggctacgagagcaacatgctcaaactttccttatgttacagtcaatatgtacactcggaagtgcaagtgggacagaacttggtttgcagtcaagactcagacaatataaaggtgactcttgtatcaaattagtaaaataagcatttgcagaattgaacctgcaacattctatcacgacaaacagggttttaatttaatttactttaaagaacggcaaattgttgcacaaaatggccaaaagattagcacagattcatatggatcacagaaatgtttatttctggaaacatttctgtttcttttaataaattgtattatctctcaaattaaaagcctaaaatactaaacaatcaactttgtgtattatttgagcaatgagccaatgagaatgtaaaacaagcttgggagtagtacgtaccaataagtagtttaagaagaatgccattttgcctatcttttccaatagtgcccaaacagaactatggagtcaaaactcaaaacttgaaagatatcaggcagctatccagttcattttatatgaaatatttataacttatccattataaatatgagtaaactacatggagacggttagcatttgataagaaagttgctctctggtattttccctgaggtcacaggctgcatttagataggtgggaaacagaaagcgaacgcaaaccttttcatcaatcacaaaacttctcaaagaatcaaccatgaatatcgctgaactaggtaggtcacatgttttgcactggtcccaagaacggaagatacgcaacaagatagcgcgatatactctggctttaacatcaggggatatacatggtatctcccagagatcaccgcagaatctccttatgtgccacaaagactgcagttatgcagagagaatcagagataggaaaactaatagctaaatattaaaaactgaaggatccaaacacacgttacccggagaatggcatccaaaggaacctgtggtttatgacaattttgtggatgagcaagtaaagcatcctctaggggatcattaaccaattttgcctgtcaacaatgaatatcatacacaaataaagttacagacatgctttacaagttcagttcgtgctgaaagaaccatactgacccaaaggcaagcctttgcaataggtgaaataaccgcaaggcaatcaacttgacaagttttcagaagactttccttccagtaatccacctcagcatcaattaatagcatctcaactcgtgcagagccaatctgcaaatacagcaactaggatttaagcattgatcaacgagattaaaatgatggtataaaattagagagcaaacataattttttttttaaaaaaaggaaaacatacccaagaatcaaaataagtcttgatgtcaatatctctctcaaaaatggccttaggaaggaaataaacacctccttgtattccttttagctcttcccatgagctgaatttcagcttcgctttacccaatgctcgacttatgttgttaagaatgtcaggtccatcaacaaaacattctctccacatgctgaaacacaattccatgggatcctcaagcaaaggttcagataatagacaggcaaaaagtcgatctgcctggctagaaccatcagtttctcttgatgcaatcttctcacaatcaaaagatagtgtgcctgtctcttgggaccaggtaatcccaacaagcgaatcttgctggctctcttgttcgccattgcgacgcttatgatggttgcagcctctatgggtatgcacaacgagcgaatcttgctggctctcttgttcatcattgtgatgcttctgatgttcccaacctctctgggtctgcacaacgagcttaagcggcttgagcaattcacacagttcctgaaggtgtgtggaactcaactgtccaatcccacaagacccacacatggatactaccaaaggtgctactggcctgacccggttcattatgaacttgtgcatgatgtacagaaggttgagagaaacgacttccaaatcaatgagctcaaagacgatttccttaacctcgcgcaagatctttgtcctccctgccaaatcatctccatcggttggctcccatctccatgatctgagaagctccctctcactgtcagatattctttcgggtactaatgacagaaattctttgcccacaatatgttcctcatcgatgtgactcttgaaagccgcgaattccacgtagatcattccggagcagaaagggcaagaccaacccttcttgacgaacacctcagcatcggaaagcatacttgtcatatccatcaaccctcgtgagcggcagtacgacttcatctctccaaaactcaccttgaggagcgcttgccgctcctcctcgctcatgcggctccagcgatcgccggcgattccgaggtcgacggtttccggcggccactccggcgtggacgcgggctccggtgaagccgcggcttgccccttgcccttctcgatcctcgcacgctgcccgcggatcgtctctcggccgtgggctttcctgtactcgagatcgaaggggttgtcgtgatgatcggcggaggagtagcggttgctcacgaaggtgtagtgcaacgccgggtcggtgggctccgccacgcggagggcgcggtcacgcacctccgctgcctcgtcaaacaaatccatggagatgagcgcgtcgatgagcagcgaggcgatgtgggggcagcgcggggcgagcaccgccgccagctcgagctgaaccctctcctgctgccgactgttgcgctgaaggtagcagcgcgcgaggatggcgcgggcgagtggcgaccacgggtacctgccgacgagcgccgtcgcgagcgagagcccgtgcgcgtgcccttgctcgccctcctccgtcagcgcgacgatcgccctgcccgcctcctcgcggaaggcggcgtcgcagtccgaccagtcccggttgctcttgctccccacgacaacacccgccatgggatgggaggagctgcggcttcggcctcagcctcagacgtgctgctgctgcggcggcgtcgtcctcgtcgtcgtggacgtggtcacggcgcgaggcagaaggcggcggattgggtcccgccgcaccgctccccggtcggccgagggggaggggcgcgaggtgttcgacgaaatgccgaagcggagaacgaaggtggcggcggaggcggaggatgaggaggcgggtggggagcaagtctctctcggcggagcaggagggggaggagacatgtagccggcgacggcgaggcggttgctgaggtttcggccgttggggtggggcccaactgccagagagacggagagagagagaggcccgttgtggtggggcccacgacacccgctagcgaagggatgcggtgtcggcggcggcgcttccattctagaagcttctggagacagccctgacctgcgccgacgagaggaagggagggaagagctatggaatggaagagaaagggaagaaggggaagaaggggaggggggaactttgagattcgtgcgaaagccatcagaatgaatgggtagtttgtgatcggcccaactagtttttgataggaataagttcacttcaggtctttgtccaacaacaatactggatcgattttgctatcgatcactcgcgtgatttttttgctgacatttcatgtttttttttttgcagcctcgtcagccggcgcgtcggacaccagcacatcggccttcgtgtctagctagcccaagcgcacacgataatggatattggagaagcacggtgacacggtggcctctaaccgtcgagccagccgctggtagcacggccaacactgatcggcgagagacaccgtccctctcgtcgttgtcgtgaaatataaaattacagtcctatataactaaacttgtatttgtaaatttagttgatttgacatgtaagtgcactgtaattttaataaaaataatatgtaagtaaatatgtacttattattttctttaaaatataaaattacagtcttatataactaaaattacatatataaatttagttgatatgacatgtaagtgcactgtaattatgataaaattgttgtgtaagtaaatttgtattagttattttattttgtagtccggtggatgcaaatccaagggaagaaaaaatctggttgattttttttaaaaaatcacccgagtgatgcataggcggtccaacatacatagtggaacgacttccaggaaaagcaataatacaaaggatcatgcttacttttcctaagcacttggaggcaactcaaagcttctggccagattattgcaaaacgaaattaaaatcagaacatttttctttgttcagtacggcaaagcatgaaactaaactaaaccagtccacgcactgaatgagaggtgaaagcaagacgatactattatttcttttaagtaagaaaagaactaaacccatcctaattaatttactatcgcctggaagctcttcgacaacactattatatatcgtgaggcgcagttgaatctccagttctccaccctttggattgtccttggcacctttttcatcatcttggtaagactgtatatatacttcaggtgtgccgatattcaggcctggtaagcacacaaaatcatgcaaagacgattaagtgaaactaatcaaagtttttatatcttctgagtaagaaaaggacattatattcttgtcacattaatatcttcttgaactgaatctatgtcttaatacttgcctcagcagtcagcaacattaccatcctcggaacataataccttttcaggtggatcatcgcgcagtttatcctgttaaacatgagtaaaacaaccatgaaaagaatgataattaagcaaatatataggtggtatattctaaacaaattaaataaagtcctatgtataacataaaaactatagtagtagactaacccataggtaatccttcatggctggtaagctgactttacgataatcacaagtacagacttccacgagctttttcttcaaatcatcaacttcggcatccaattgcaagatatcgatatctaatttagcctgcagcacattttacagccaaagcttagaagattggttcagtataatatcaaaggtacaaacactatctgaaaattaacagaaattcagggtacagtaaaatgaacctttttagtaaaataactttcatgcgtattcatctctattaagccacgttttagctcgattttctctaccaatgcagctgcacttgcaatcaacttttcgaggacacgagctccgttatcaagacaggcttgcctcatgttgttccatgaagtaaccgggtcttgtctccgaggtctagatagccagcgaaagagagcatcttgattgctagaagaaccatcgataatgatccttaacgcatcctcttcgacaactatggaaggaacgaaatcctcacgaacgaccgagacataatcaaaatgatcattactatcctgcagcttggcatcatcatcaccagcactcaatccaggcatagtcgatcgttcaaaaaatccaggcacaatcatatccagagtgagtgccaggacgtgaagcgccacaggatgcagcttagcgatgctgcagataggattctggggaggatcagcagaagcagctgctgctgctgtttcttcttcaatcgtccatctgttggtgaattcgcccaggttatccaagagatcgacggacagtgccttgcgatccttgatgcgctggagcgtgctcttgatcttgctcaagaacctctcgctctcatcatcatcatcgtcatcggatggcgctaatttaaccgcgcaagatccgatcagctctgcctcttgttcttcagatattctctccggcacgagcagcggcgatcgttggagatccgggaagaactcgtctgcgacgtgcgactggaagcactccgcggtgaggaaaaccatcatgcattgcggatcggggcacatccagcagatccaatctccggtgtccttggccaagtccaccgcgcaggcgagggcgctcatctgagcgtccgatagtggctctcctgtgtagtgcgctttcagatcctcgacgctcaccgtcaggaagccgcggcggcgctcgtcgtcgtcggcggcggcggcggcggccatggcgacgggcttcgacgaggcctggaggaggaggaaccggagccgctccttggcgagcatccgcgcctctttggtcggcggcggctccagctgcaggtgcagaagctctccctccnccnccccncccgtgtcgtcgccaagggcgaggcgaagcgcgcgctcgcactcccgcgccggaggatcgaaccgctccatggcggcgtacgccctggcgagcgcgagggcggcgtcaaggtcggccgggcgaaggtccctggcgtggagaagagggccgagctgccgccacctggcgtcgtcgtcgcggctgtccatgttactcgtgagaggaggaggacgcggcgtttacgtgaggagaaggcggcggcccgcggctgcgttgttgttatataggagtaataatcgggttgcaatggtgtccctaacaagttctctaattacatgtaaacccttcaaaatttcagttgcaattttatccctaacacaaatattcgtcacgccaaacagctcgctgagtttccctttttttagtttctcgctcagttccacttccacttttttttttgggggggggggggggttggctaagggataaaaatattatccatgtctcactgtctcacgccgcccctatgtgccctcaccttacgggataaataagttatatatatacttcccgtgtatgataaaaatatcaaactgatagatggtatgtttcctaaaaaaaaactattttgttaaaatattaaataaattatttttgaaatgtatactagttaatagttaatcaatcatgtgctaattgctctttgatttttattgctagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30727 - DNA, 1228 bp, Oryza sativa
ccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcatgacaactaatgggtgattctatgagtggactttcattaaggtctataagttctttcttccctatcctaccatctttcttccatgcaaacacctcaagagatttgaaatgtgaccccaatactatatctatatatgttggccattcgatctctccattcaagtctaacataaacttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacattcatctcccatcaaaccctagtgcatcaccaaacatccatcccaaatatattttgtcaaatgtatcaataacaaccaaatggataaagatatgccacctccacacttcaggcccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaac

SEQ ID NO: 30728 - DNA, 777 bp, Oryza sativa
ccatcacaagatgtcctccttcaagaagggcgacgaggtgcgcgtccgcacgcccgtgggaggctaggcaccacggcgctgcgcctcgtcatgtggctcggcgcggtcgtcgtctccgacgctgatgccgacgacgcccacctcgaggtcatctacacggcaacttcccgcgcgacgaccccttccggaccgtgcgcgtcgctgtcaaggacgtcaagctgcccgcgccgcgcctggccccgaccccggcaaacatggcggccccacggccgaccacggccggcaagaagctgccgcggctgaagatgtttatgctggagaaggagcagctgcgtgccaactccgaggccttcttggcattgtgatcagcgctgttcagtagtagcagtaggtggaatcagaacatgtcttcctctgttcttggtttgcatggaaggcgatgtgatcttttaaattctcgtagataggatggtctattcgcatgagaagaagaacatgcaatctgtcaactgtaatttgtcattgattatgaatgaaagatcgaggtttctcttctttattttttttaccaatatatgcatgatgaatgttttccttaatcctttggttttgttgatattcaagtgttcagatcagaatcacaatccagctgccctctgattacatatgtatgattacaatccacctgctgacaactttgaacttgtagctaggattcagcttccaattctttgcacgcctttggctttcctttccttcgtttagatcaagagcctg

SEQ ID NO: 30729 - DNA, 4567 bp, Oryza sativa
  unsure (1)..(4567): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggccctctttgtttagacttataagccaacttataagtcaaaaagtctaaaccaaaacaaacaagcagcttttttatttggcttttttaagccataagccactctaacactattaaggccttctttgtttaggcttataagccaacttctaagtcgaaaagtctaagcctaaacaaacaagcagcttttccgtttggcttttttgaagccataagccactctaacactattaagccaaaagctaggttgaagaagcttttttggcttatgtgaggtagatgtatgactcaactactaaacttaggacattaaatccaccggcttataaatcatttaagccaataagctgacttaaaagtctagcccaataagcctaagcctaaacaaagagggcctaagccaaaaactaggttggagaagcttttttagcttatatgagatagatgtatgactccaccactaaacttaggacattaaattcactggcttataaatcatataagccaataagctgacttaaaagtctaggccaataagcctaagcctaaacaaagagggccttaagctatcattaagcttattagctagcgctgtttacgagctctagtttattcggtggcagatctagaaatttttacaagcctgggcaaacctaataatagagaactacaattaaatccatacaaccacgtgcatgatttagtatagatcgaggtctaatttataaagaagacaaccaatgcacgaaattatattgatgaaataaaactcgttaattggtaatggtgaatactagacattataattaattatatgtatatagctagtcattttgctagtatatgtgctgatccactgatctcattcattagaactagttgattaagcatgtaatttgctactagtagtattttactcaattgtatgtggctgaacacctgaacttgtatctaagcatggtaattaacataaactaataactactcactactataaaatatcaaataggtgtcggtactatagatgccggaagtgctaaaaccggtacctataggtcttttaccacctcagcggtccgaaaacacaaaaaaccggcacttttaagtaattataggtgtcggttctataaagaaaaccaacaccttttattaagaaccgacacctataataattaaatgtgccggttttttttaaaaaaacgacacctttggaattgagccgagccggaccggatgagatatttcttctcccggcggggctcacacccggtggagataaggtcgatttttctcgacttctcgtctctcgctctcgaggcgccctcccctgcgctagatccgacagggccgggaggggaggcgcggtggcggctgacggcatgaaggggaggcgatggtggcccggcaggggcaggaggggcggagacgccctcccctccgccagatccagcaggggcgggaggggaggcgcagtggcggtggacgacatggaggggtggcggtggcggcccaatggtggaggggaggcggtggtggcccggcgacggtggatcctcggggcaacggcggcggtggcgccctcccctctaccagatctagcgggaggtgaggcagcggcggcgaaggcggtgacgtcgacgtcggggggctttggatccagcggcctcttcggatctgaacacctagtgagctgatgattgtctgaacatttgattcaatgatgtgaaaatttgatgaacatttgatcaacttgttgttcattgtctaatgtgaaaatttgatgaacatttgatcatgagcttattgttgattgtctgattgtggattgttttatcttcttttttatttatttatggtgctttgaagcatcggctcagctcaaattgagccgagccggagttttttttgcaaatcatatacctcaaaggtgccggtttgtctaatcagtgccgccaacgtggtgccggttgggaaaaccggcacctaagggggtttcccaaccagcaccaaaggccctttatgtggtagtgactgcacagtacggctacatccggtggagcttgggcacctgccgaggctagctgggccctggctccgccgctgagattattcatatcacctcaacagttttaacttcaacttattatgtgtaaataaaataataaacactagctagcaaagtactaactaaatacaaatagattggaaatataacaaaacaacaagcataaattgatagtgtggccttatatactaagtatacactaatcaagctcacccacatgttgggtcgagctagctagcgagctaaaattaagctaaacttgaccggatttattatgactatgagcccctttaaatcgtagaaataaaaaaaggggaaaaacacgtgattctgataggaatataagtacataaagcacagaattacaaaacacagaaaaacacatgaataatcatttagttagaccgcaagaaaaataaatacagtaatcggatgagagagttaggtagactcaaaggaatttcttcaagaggttggacctcttgctgaatttcctccaaaacctacatgcaatgacccattccatagaaattttatagaatttggaaaactccaatccttcgaattaaagggccaaatagaaaattttctataggatttcaatcctatgaaattcctgcataatcctttgattcaaaggggtcttgtattttaggctgactttgaaactattgatatatataccacttgtgttatagtgcatagcttggtccacatagtatgtttaagctgatctgtaacatcccggcctagggcttaataggattaatagaatactcatatcaacaagttgcaacttcttttccggaagccaatctccaaagaactccagggttaagcgtgctaggcctggagcaatttgggattcgaattttccgggtgcacacgagtgaggacaaagtgtgcagaaaagacatgtgttggtctgtgagggcagtctatgacctataaaagctatcagatataagtgggcccggcctgggggaaggcgggacgttacatgatctccatacgggcccggcctgggggaaggcgggacgttacatgatctccatactagttgatataccacttgttataagctagttgtaccacctgttataatgtgtagcctggcccatagagtatgtttgagctgacctcgaaacgtaccgtgcttgttatagagtgtaacccgccccactaattatgggccacccaagtgtaaagaccaacttgactcgatttattttgactatgagctcaagtatgtttaagctgatctcgaaattaaacaagttgatataccacttgttatagtgcgccggacccactaaccatggatcacccaagttacattgggtctgttccaccatggattcaatcagagtcataactttagatcgtggacttacacaatccaaaagacagtctcatggataagaactactcatgtttgaagttgtgttttttcatcatcaattatcgatatgagatttaacccaacatctacacaaacacgtcaacatatatactccatatatatgtatatgtagagacatatatctataactaatataaatattcgtatttttccggtcatcacatataatttcgtccgatttttcgtccatacacaatccgattaggttagagatagcgatggaaaaaaaattgcaaaaaaaaaaaaatcggcagccgccgacgccaccaccgcctgcctccggctatccgggccgccgccccgccgggccgcagccgcctccatgccgccggatctagagaaggcgaggcccggctcgccgcctcgacgccgtcctggccgcagcaccgccggatctggcggaggcgaggtccggccgggcgtctccacgccgtccgaaccgccgcctccatgtcgacgccgccactgccaccggatccgccgcgggaggaaggcgagagggggcggagcgagccgccaccgtcgccacctccggcggatatgccgcgggagggaggctagaggggcgccagatcatttccaccgcggccctcggccgttgccaccgcagccgacgccaccaccgccactgaagggagaagagacgggagggagagagggaggtggaacgtccccgcctgtgggaggaggggaaggggagcgtc

SEQ ID NO: 30730 - DNA, 15966 bp, Oryza sativa
ggggaaaaggcgtcgcgcgcgtcgccgatgcagtcgtgagagagagagagaggggagggaaatgatttagggttagggttgccgtccttttatatatgtacgaatcaatcgtgaccgtcgattagatcggacggctgcgaattctcctgcatcgggctgccgttcccgggccgccacacaattgggccacgtgtacgctccgcacggataagttcagttttggtccctcaagttgtccccgaaacttactaaggccctaatcagtttatttttcaaagcaactgatttaattttttaaaaaattacagaattttgtttggaactattttgagccatttaaaattgctaggaaattatgatcaattatttaatcactcagtagattcagtagattgtttcaggtcaaaataattattatttccttaaatattaaattatttctaaaattcgaacatattccactacagattttatttcgatactacaaggtgtgtgtttcttttccattacagatgacttttacctttttccttttgtagcactaaaaaaatgaaaacatataataatagagtgcaacgaaacgtttaacccctcttactagatctctcgttgcaaagcacgggcatatttgctagtacttcatatatatgcatatgtagagatgtggttggatcggataagctgagtgacgagacggggtagcggaggggctgcgattgggtgggaggctgctcgaggcaagtacagattcgcctgtgccccttgtctgcaggaagcaagcagccacagccagccagcgaaccagcattatattcatccagagcggccggatcgattcacgtccaagatcgatggacgtgaatgatcgatggatgtgatgagaggtcggccatggcgcattggcgctgccgcagcaggtgaagaaagaggcgcgcagatggaccgatcgatgcgacggcccggccgtgtcttcacttgcgcacaacgccacagtcgctcagacctgtactgtgtactgctgtacaatactactggaatactcaagcacaggtcgatatatatttggcacgacatcttggctagctgcgtgtgtgttttttaatttggggggcacaatagttatttggaaaattggttgtttcaatgtcatcgaaagttcgcaagtgttactgttaagttttcactcataacgcctcaatgtcattatgtcatgtgtgcaaagacgagattaatattaattgccctcatctctttcagcgtcttatgcatggtcttgtattctcgttgtttctcttcgcgaacgtacccgcagcagccagcgtcagtgcccaagctcatatcgccccgtgcccaagctctcttgcttcccatggcacaagctcgtgtggatggcaatggagggacaccgatggctgcgaagccggtgctgacaccgaactcatcaccaaagaggacatggaacatagtatgggcatgttggcttcgtttgatttagattattgaacggattgttgccatgaattattcgcttgatggataaattgaatattttgaaaaaaaaacttaccaaatactctctcaatttgaaaaaaaaccaatcccagctatgaatctggacacgcacatgtctaggtttataggaaggattgttcttttcttgggatggagggtgtagtttaaaacaagtgatcttagcaacatatctttttaatttggagcaaacaatatgtttcaataatttggtgaataattaaaaaaaacctaagcagaccaaaaaggtgcatgtccaggttcataggattgatggctaaaataatagttatattttaaatctattattgtacgagtagcctagtaggtaaaatatgaaccaacacatgtatttttatgcattgtcgaagcattagtaggcactcggaagcggaaagggattcacaagaaggggaaacattccttaggccgagtttaattcccaactttttcttcaaaatttcaacttttccatcacatcaaagctttcctacacacataaactttcaacttttccgtcatatcgttccaatttcaatcaaacttctaattttagcgtgaactaaacacaccgttattcaatcaacagttgaatataaaaattagagttgtctattccgtgcccttcctttctacccctaccaacgacttaatttcgtacatgcatttatgtccagcgtgtatccctaccaacgaggagagaagctcgatcataacatactagccagagggaggaggaaagtttgggcatttatggatttaccgaagtaaaatgtgacatataggtgtgaattttaaaattatatgacaaacaaagaaacaaaaataagagtatgtcactcaactttatggtcaattataatttctcgtttcttcaatatgcatgtcttaaggggtggaggaaaaaaaacccgcaagccaatgcaaagaccggaccaaactgaacaatagtttcttgttcgtttttttctcaaattttttaaccttcggtttctgggtttttctattggccttgtttgtttgaacccactagtcgagaaaatcgatacgtccctaatcttagtccaccaaccatctggcccaaggcccactcttcggagcaacaaagtgaaacacagtaacgttgccgcctcaactaatttctttgtgaactagtgtacttctttttgggattcgtttgatgttcttgagagccaaagtgagggaaatacatatggcccttgccttcctttcagaaaaaaaaagacacataatagcacaaactaatatccaattcagagtatgaatgacattaccagctagatgctttgtttgctgcatatcctggttcttgatctcaacaaaggcaaggaaagccaaaggcgtgcaaagaatttttttttttgcgaggaagggtaaatctattactcaaatttagcgtcatcacagattatctgtgatataaagttacaagacccttccaaccagaaatcagagacattctccgaccgtgctttattcgctaacgcatggctaacctggtactgactccgatgaatcttcttgacgacgaaggcgtgcaaagaattggaagctgaatcctagctacaagatcaaagttgtcagcaggtggattgtaatcatacgtgcaatcagagggcagctgcattgtgattctgatctttaacaattggatcaacaaaaccaaggaataacatgcattgtgcctgcatatattggtaaaaaagaaaaagaaaaagaaataagaagagaaacctcgatctttcattcataatcaatgagaaattacagttgacagattgcatgttcttcttctcatgcgaagaaatcatcctatctacgagaatttacaagatcgcattgccttccatgcaaaccgagaacagaggaagacatgttctgattcctacaagcttctgattccacctactgcacctactgaagaacactgatcacgatgccaacaaggcctcggatttggcccgcagctgctccttctccagcacaaacatcttcagccgcggcagattcttgccggccttgttcggccgcggggccgcaatatttgccgggatcggggccgggcgcggcgcgggcagcttgacgtccttgacggcgacgcgcacggtacggaaggggtcgtcgcgcgggaagttgccgttgtagatgacctcgaggtgtccgtcgtcggcgtcggagacgacgaccgcgctgagccacatgacgaggcgcagcgccgtggtccctagcctccccaccggcgtgcggacgcgcacctcgtcgcccttcttgaaggacatcttgttgatgggcgatcctgatcctgacggcttcttggagaccactctcccctgcgcctcgacggcgagctcagtgcggcggtggatgatcgggcgcgaggagcggggactcgagcggcggggaagcgccatggacgagcgccgagagctgctgcgatgatgggtggaaggaattgtggtgggggcggcgcgcttggatttatcggcagccgagtccgagttcgaattgaagtctgtgaaggaagcaaagcgtggctgtcagacacaattcttcaatccgagctcgactcggaatcggagacgtccgttacgcctcgccaccatcatgcaatcccgaatggcgccaagcaggcgggaacgcgaagctaggtgtgtgtcgccgccgccgccgccagcggtggacaaggagatgacggcggctcagcttccaccatctccatatgtagaactggtcgcaaaaatttttattatttctaattgtatttctacgtagactcatgtttcaatattctttaatttttaattttgaatttcagttacttctaaattgtattcatatattgattttagactctacttcccatgttgttttattttgaattttagttatttgtaaattgtattttttacatgaactctaaactctaattttaattttattatgtttattctgaattttagttagttttaaatttctatatgaactttatactctatttctaatatcccttatttttaattccgaatttcaattatttcttaattgcatttcgatatagactctatactctacttctaatattccttatttttaattttaaatttcagttatttataaattgtatttctatatggactctactcttctcttccaatatttccttttttaaaattttaattctgaatttcagttatttataaattgtatttctatatagactctaatcacctcttccaatattccttatttttttaattccgaatttcaactatttctaaattgtatttctatatggactctgtttttctttttctccgattaatatgagaatttctagtacgtgagagtgaacgtggagactcctttttctatctatctattatatattatatactaaataaaaggccataaaactttctacaaacgctctcaagccgccacgtgggactcctacaaacgctcctaggctgccacgtggcactatctaatctcaccgttgattttcacttaaattggtggacctgtttatttacaccattagattagatctattattaaaaaggtgatagtttttccccttaaaaaacatatgcaaccggtggctgggaaaaggaaagaaaaaataaatgtccctagggaagtacaattaaaaaacggtattgctaaatttgtgtacagtcgaatgttttaaccgtgagatcgtccagtaatattcgtttcaagcacttgaaggctgcaccccatcttacagcttatgcgaaagaaccaactgcacctaatcaagctctaaactcattagcacttcacctccatcgtaaaactaataattatttatatatttatacgaatttacactgtagttacactccacttatatatataattagtatataaatttaggatttacatatgtaattttgggacttatattataaatacactaaaattgcatatgtaattcagggaattacaatgtaaatacataccgactattttttggtgaaaaatatggcgccataaatatagctactccctttttaaaaaaaacatataaagctacctactgttagctggaagaaaaaaaaatagacatctatgtacgataaaataaagcaaaaaaaaaaagcgtactataaagaaaaaaaaaacgtacttagtatccgtggaaaaactacggtctaaaaataggattttgtataatataaaaaaataaaatataatactacataatatacggaagtatatgcatgtaatcgagatctataataaaccaatagattagatcttgtaattaaattataagaaaaatcaatttaatttgatttatccattatttttaactattaaatctattttttaagaaaaaatcttgagtcaccgtgtgtcacgtcctataaaaagggaaaaaccttagaaattcttagaaaaaatgaaacacctcatcattggctttcacttaaattatttaaaaaagttagaaaaatataatatccacctcctcaccatcacatgtacacaacactgccatcccctccctattgttttatctattaaataaaagagaaacaataaataatatttgatgtttttttttaaacaaagtacaaacgcgggcgctcgcaacgcacgcacaatcacttctgtgaacgcacacatgcaaatacccctttgagtattttgaagagactaggctgatatattttgagattgacgaaatcaccacgtacgtcttgatatcgacgggtacattgcctactactgaaagaatttgttaagtctgaactcgagcaagttccatcacaagaaacctaaccggttgagctacgttcatttcacaataatattggatattaaaacaaccataatttttaagctacattcttggagtactcctatatctttaaaaccggtagaaccattatttctaaccgttagaactatcttataaaaggaaacacaagcgtgtattcatggtatgtcacatttcaaaaatattattgtacaattatatttcatcgttatcgtatgcacgttagcttgcgtggaacctcttacccactctacatgaaatgttcatagatggaccaactctcaaactacatcaatcatattaggctatataaacccatatatttagtggagcttcatgtctcacccaattcatcatcgaataaaccataataatacatatgcaattgaaaaaaaaagaaaaataccttagtttaccttacacttacatttcgttgacatgttttctaaagaaaataagtctaccttcttttcaaatgatgaagaagattataaataattgcttataaatatcaggtaaatatgatactgctataatataaaactaataggttagaaaattaaaaagcaattaatgtcgacgaaaacaatttacgaagaaatcatggtagatgttctatggttgtagatgttctacggttgatattttgctcttataactgtgtcaaacatagtgtacaaaacgcatgcccacgcattcgcgcgggctacattcctagttcctttaataagttaatagatttcccttatattttgcctaactggaaaaaaatccacaagagattgggtacctgttgcgtccagaactatgcaagaatcaagatacctgcataacatctaatcaatatttacaatgttcttcgatgacaagtatgacggtctatcactttgttttgcagcctgtctaggtgacgtaagcacatattcgttgaacttttttttgttgtcgtgagagcagggtgtcattgctacatttatagtttttatgtgcctaaactattcatcaatgtcctatatttgcctagtggttgcagtgacctgagtagcacccaaggttctaagttcaaatctccataggagcgaattttagattgggttatttgagagctaaaaggttctaagttcaaatcttcataggagcgattttagattgggttatttgagaactaaaatattgcatatgtctagttggatgaagagttcacgtaaaaaatacccttctcaaaaaaaaaaaaactattcatcgaggtcctaggtcctatatttgcagtttttaacataattgttggatgtagagttcgggtaaaaaaatacccttccctagaaaaaaaaacttttcatcgaggtcctttctatatttgcagttttcatttttaacattcttagtatacataattgtgtatttcctatgatgctcttctttgtaaagaactcattgatacaaactaaatgaacaatttggcacttctataatctgtacaaatataagcctgtgaaaaacattatatgttcctgaccttagtgcgctaagtgtagagtaattatacatttaacatggattggtcaatttatgttattgatcaattacttgagttgtgatgttaatataggtaattaatttattgatcaattgcttgtgatgcttgcagagatccaaatcgttaacgcgcctgtcttgtgcagtcgtgctaatggatttcataaagggagaaaacagagtctgaggacgaaaccttcatcatgagtgtcataacacacaacatgatctacgatcacgcgacacgccctgcaaggatgcacaaacgttgctccagcaagcgttgcaagcttgagctaagatgcgagctatattcgaggccactagggatgtaagcagtctaatccacaaatctatttataggcaaaattaatgggtaacccatagattataaatgagtttatggatcgatccacttgcatttctagatgcggcaatctaggttacgatgtggaaatccatgggtaaccacttatttgacacgtaagtaagtttgcaggtcggttcgcttgcatggccactattgtcagtgtccaagtcattgatgggccatggtcagataatgttcgagggcaaatcatctgccatatctcaagcgtcgataaaatggatgttctgctgcttgattcacatgtgagggcatagcatggattggctgccaattagcagttgtgtttcaaagctctttagtattatggccctctttatttaggcttaggtttattggtctagacttttaagtcagcttattggcttatatgatttataagccggtggatttaatgtcctaagtttagtagttgagtcatacatctacctcacacaagccaaaaaagcttctccaacctagcttttggcttaatagtgttagagtggcttatggcttcaaaaaagccaaacggaaaaactgcttgtttgtttaggcttagacttttcgacttataagttggcttataagcctaaacaaagagggtctatatctacgtgtatttaccattacctagcacgtgtttggacagttatccggctcgacaatgtttagatagtttttagcataaatttgttataatagcatcgttataatgttaacacacgcttaaagagataaggtggtaaatcactttttgttgcacattagagatagccttatatgtagtggtgattttgacacctaaagttatctttagagaaacaaacgaatgaggattgtttttctttagcagtagagtaaagcattgtgattgtaaacttaatatttgtctcaaacaataccaacaagagagagaggcaaagatagtattgcattgatcatgagataatagacgaaacagatcgctcgtgtatatataaaaaaatcttgatctttcattcataatcaatgataaatacacttcacagattacacgttctcttgcgaagatttccagtaaaccatcctatcacaaatacgagatcactgtgccttccatgacaccaaataaacagaggaagacatgtctgaatcctacaagcttctgcacctactgaataacactgatcacaatgccaagaacgcctcggagttggcccgcagctgctccttctccagcatctgcatcttcagccgcggcagcgacttgccggccgtggtcggccgcggggccgccatgtttgccggggtcggggccgggcgtggcccctgcagcttgacgtccttgacggcgacgcgcacggcacggaaggggtcgtcgcgcgggaagttgccgttgtagatgacctcgaggtgtccgttgtcgtcggcggcgtcggcgtcggagacgacgaccgcgccgagccacatgacgaggcgcagcgtcgttgtgcctagcctccccaacggcgtgcggacgcgcacctcgtcgcccttcttgaaggacatctcgttgaccggcgatcgtcctgacggcttcttccccttggcgtcgacggcgcggtggatgatcgggcgcgaggagcggggactcgagcggcggggaagcgccatggacgacggctacgagcgctgctagctgcgactgcgactctgcgaggatggggtggaaggaattgtggtggatgcagcgctaggatttatcggcagccgagtccgactccgagtcgaaaccaatgaagctagctacgtagcacgtcggagacggagttggagttgaactcggtgattagcttgctgtgattaatggctaatccttgtgaattctgctctatatatacacgcggcattgttgaaatcgcagatttctcgaagcctaagccgaactggtggaggtgtcgccggaggggcagggagacgacgtacggcggctcagtttgcaccgtctccatatgcaaacatcaatcggagaaaaacggaacgagtgaattatccgcttcattgacaaatcaaatataagtccctgtttctttcagcttgggattattataatatagattattgagttagattactataagttagattgttataatctgtagtagaataagcggttagttgtttcttttctagattattagagtctagattattgggtttgcaagtctaaaaagggagtggggtggcatggtgggtaatttttcacccaataatctagaaaaagctcacctaaatgagcttatcatattataataagctgggctccagattataagaagctactttaataagttgtctgtttctttcagtttattcccaataatctggattataataatctcagactgaaagaaataggggaaacaagcttaacaaataacttaaaacaaatgatattagcaatgcagcagaaaatatattgtttgaagaaaatatatcgtttgaagtgtggaataaatagagagaacctacggcttgggcgcccgatcggctgggagcaaaatccggcgctgatgtcaacatgacgtcagcgtccgatttacgtacaaaactattttaaactgatttttttctcctaaattacttatccaaatcatgatccgattgcaccattaaattcgttgcaattaaatcttcaaaacaagactacacatggatatatttcgacgaaaaaaatagcttattattgaattatttttaaatgttgcacgatgttccaccaagtatatcggaattgtttcactaagttgattgaaaatgtttcactcgtttaaatcaggtgttgtttcaccttatataaaaacaatgtttcagcaaatagcgaaagaatgtttcagttcactgcaacattagatctgtacacaatgaaacattattagtacactaggtgaaacatttttcggtggaacaaaaaataaaccaaattcccttaatagggggtttccaaaatatatgggtttttttgttgcaatgggatgtttcgttcactgcaacattagatctatacatagtgaaatattgtgagtacacgaggtgaaacatttttggtggaacaaaaaataaaccaaattcccttaatagagagtttccaaaatatgtggattttttgttgcaaaagagtatttttattcactgcaacattatatctataaatagtgaaacattgtaattacattaggtgaaacatctttttgtggaaaaaggggagagagaagtgagtgggcccaataagtgtgcacgtggggggaggggcgcacagggggagcgcccgatcgggctccccccgcgccggacgcctggctctaatcattctcggaataaatattctgtttcaataatccataaataattaaaaaataaattgagcaaaacatgactagaaatatagatggtcaactgggccgcccgacacagcacggcccacgcccagccatgcctaggctgaggctagtcgggccagcacggcccgaccgacacggccgtgccgtgccacgggcggcatacacggcccaggcacgacccaataccactcgggccgtgccgggccgtcccgaaggcacgatggcccatcgtgcttcctcatagaaaaagtctattattcgtccctcaactctgtgggttgtgttcaaatggctggaaaataagtctattttgtattcctcttctctttgggccttgccttatacagttatttaagtctattttgcatcccaatatttttttatttgatcgggccgtgccgggccggtccaccgtgccgagggtgcagcccaggcacgacccggctgtcgagccgggccggtacgggcatgaccctagtcaggccgtgccatgcttgggccgggccaaaatagtgtgcttcaggccgggccgtgggcctcgggccatatggccatctataactagaaagttaagaagtcagggatgctagtccaccaatgagtaggaatgcaagtggggtaggcttgtgggctttgaggcccccattgtagttatatttttgcatctgtttctgattattaggtaaaaaataaactaacatgtgtgcttttatatgcattacagtgtcgaagactcaaagtgttagtaggcactccaaaggaaaggggaaaggggacaccacgactcttgttcaatcaacaattctctactattataaaaattgaagatgtttttgccggtactttggtacatcatctatatatgagtaggtttttaagttcgtcctcttttggaaatacatttccgtatttgagtcggtttttaagtccatttgcttttgaaaatacaaaaggagtcgtataagaaatctcttttaaaaaaactcacatgctaacttgagatgaacagactcctatttgcaactcatgattttctaaaaaatattgtcagagggtgaactccgcaaacgggggacagtgaggccccccttgttggttcggccgggggcagcgggtgagattcgggagctcggtgagtagtttgacgtagagggggtcaggcccctcaagaatgatgagacaaaaggggtttatacaggttcgagtcgctgagaagcgtaataccctactcctgtgcttagttgatcgtgtgatgatttacaagatttccttattcgagtagaaggtgttgatgataagggggcaggaaaattcctctagtgaaaagggctcatccactccctaagtaggcttggacctccttttatatctcaaggggttaccacatgggctcaccgagcctatctagggaggataatcacattaaatgcatgtcttgttgcttgccttagaagccactagcacgcctgctgtggcgtggggccagccagatctatccggctgagacagggaacacgcacgtctcattcgtcatttaatgagtgaagacttttgggtccttactcatgccgggaaacggaaaccttgcactgaccgggttagacggaccgcctcccgactcatcatcgcgacatgacaggggatattaggcggcacgccgcctgacatgcaactagtatgcagacacactaccctggttacatcggtcattcgaccggtcgtagactggtcgcaatctagtcaggtgcaccacgcaccgcatttaatgcggcgtggtgcgctcgctcacactgccttaaatgggggcgtccacctaacccagcacacgcggcaccgcatggaaggggttggggtagcccgatcccaggcaaggaggggccgccgccgccctgcctcaggccagacccccccccccctcggggagagggccacgtggctaccgggcacggcctcctccctatggacctgatacctccggacccatatcaccaacaaatatatatatccaagcgaattcccacagaatttcaccttaacttaaaaatataaccatataacaataataagataaaaatagtcgtcatcccttgcaacacatggcattttttctagttaatataaaaatccgagtttactattttgtgtcatttcttcgtcaatgttgtctttgccaaggacttatcgtagctgtatttcttccggcttgcataacatgcatggtagctagagggagtaggggaggttggacatttaccaagtaaaatgcgacatatatgtgtgaattttgaaatcatatgacagacaaagaaacaaaaatgagactatgccactcaactttatggtcaattataatatcatgttttttcaatatgcacgcggtaagccaatgcagagatcgaaccaaacagaaccgtaagattttttttattttggcattaattttggggtgggaggctaaggccgtcaaggtggtcacgatggaggagagggtgaccaggctcgatcggctcctcgtcatggccgtcggaaccgctgcggcgctcgcgggctgctacgcgaagggcagcggtgtcagagacggtggtgcgtgagagccggagcgcgccctcaccaaggtggagcgtctcgtctgattgagaaggggcaaattagtacttttcacgatttttctctatcgatctacatcggatataatcaaataaggttttcagtaactaattaccaggcttttgcggtgttctataaccaatttacatctttacggtttcccatagctaattacatgttttctgggtgttctgttgtaatttttgactttacgatacctcccactactaatgatagtagggtggtagaggtttgatcttaccgttgattatgatgggtgttttagacatttaatccaatatcatattatattcgacttccaatttaatttatttgtgcagaacagaccattctattgacctgcacattaatcggcttctattggctatgatcatcgcctgctagctacccatcgtgtggcatcgtcggcgagctcgccgtttagattgatcctctcgctgccgctagatctcacctaattcctatgcatgcaaactgtgtacgtaaatgcacagaatcacaggagcatgcctattttctctccaagtaactcgcacatataatccaatgattagccaagaaaatcatattcgtattacggatcagtgatcagcggccccaccagctgcataagggtttcacagtgcaagcctcagttgccaactagacccaagtccctctaaagtcacatccttcaaagtgcaagttcgttgtagtgggcctcaccattatcttctttttttcaatctttccttcccctctctctcctcgtagttcttctttctcactttccccgtcggtttagacggcaccggcggagcctcggtcggagcagcggcggggcgatccaagcggcagcggcgacgacgggcagagaggtagtgtggtgacctaggcggcttggcggcccaagcggtgatggcgtcgggttgagcggccagatctagcttcgggcgacgagggggggggggatgatggtgcggcaagctcactaaatccgacggatgcggcggcttgtcgggcacggcgcgaggtcggccgtggccatggcttcctcgtcggcgtcatagccactggttcctcgccggtgctggtgacgagctctgcagccgccaccctgccctcctcacctgcaccgacaagaacctctcctctccgccaccagcccaccattgtctttcctcctcctgctggttccggccatgcacggaactaacgaggctttcactcacccaattttttctgacaaaactgacgaggctctgggtacccaaattggacatgggaacaccatgaaaacatggtccccactccattctctcctccacgtaagcattttgtctattagttgttggggctgaatgccacagaggcgcactataaacgccctaagaaggccatgcaagaatttatacaaatttacttttctatcatgatgctttttccccaaatttgccacttctactttggatcaaaagatatggatggctcatatatccattggagggtcctcttcaaaaaaaaaaaaaactttttctattggtcttgtttgcttgaacccactagccgagaaaaccgatgtcacataaatcttatccactaggcatgacgcatctggcccaaggcccaccagctcagcagtggacagctcttcggagcaacgaagtgagacaaaataatgttcccgcctcaactaaatttctttgtgaacaagagtcaacagactaccacta

SEQ ID NO: 30731 - DNA, 27133 bp, Oryza sativa
  unsure (1)..(27133): unsure at all n locations
acgcgcacctcgtcgcctttcttgaaggacatctcgttgacggcagatcgtcctgacgccttcttccccttggcgtcaacggctcggtgaatgatcgggcgcgaggagcggggaactcgaacggcggggaaggcgccatggacgacggctacgagcgctgctagctgcgactgcgactctgcgaggatggggtgaaagaaattgtggtgaatgcagcgctaggatttatcggcagccgagtccgactccgagtcgaaaccaatgaagctagctacgtagcacgtcggagacgaagttggagttgaactcggtgattagcttgctgtgattaatggctaatccttgtgaattctgctctatatatacacgcggcattgttgaaatcgcagatttctcgaagcctaagccgaactggtggaggtgtcgccggaggggcagggagacgacgtacggcggctcagtttgcaccgtctccatatgcaaacatcaatcggagaaaaacggaacgagtgaattatccgcttcattgacaaatcaaatattttaagaaacaaggttaacaaatagcttaaaacaaatgatattagcaatgcagtagaaaaaaaggttttttttaaagaaagtatattgtttgaagtgtggaagaaatattccgtttcaataatccataaataattaaaaaatgaattgagtaaaccatgagtagaaagttaagaagtgggggacgctagtccaccaacaaataggaatgcaagtggggttggcttgtgggctttgaggcccccattgtagttatattttgaaaaaaagtacgaattaccccctcaatagttatggtcgtctgatttttaaccctgaactctaataccggttatttttaaccttgaacttacaaaagggacgaattacccccctagatcgacccagtgtagtttcagtcctacgtggacgcacacgtggcagtctggtcaaccaaaacaaaagaaagatacatgggacccactgtcagccacaacaaataaacatggtggggcccactgtcagcccaatcctcttcttctccccctcctctttgcgccttcccttctctccatctctggcacatcaaggcaggtagtggagctcgccgtcgatctcaccgcctccacggcgagctcgtagcggcggctgatctgtgcacacgctcgccatagaggaggagcatgagcacgcctagcatggaggcggagacgagagaggcatcgccgcgcacatgctcgtcggcggaggacatcgccatcactgatccatattatattcgacttccaatttaatttatttgtgcagaacagaccattctattgacctgcacattaataggcttctattggctatgatcatcgcctgctagctacccatcgtgtggcatcgtcggcgagctcgccgtttagattgatcctctcgctgccgctagatctcacctaattcctatgcatgcaaaccgtgtacgtaaatgcacataaccacaggagcatgcctattttctctccaactaactcgcacacataatccagtgattagccaagaaaatcatattcgtattacggatcggtgaccagtggccccaccagctgcataagggtgttcacggtgcagctatcgcacttggtgagcctcagttgccaactagatccaaagccctctaaattcacatactcaagtgtaagttcgttgtagtgggcctcaccattatcttcttttttcaatcttcccttcccctttttcctcgcagttcttctttctcactttccccatcggtttagatggcaccgagtggagcctcggttggagcggcggcggggtgatccaagcggcggcaacggcggcgggcagagcagcgatggcgtcgggctgagcggccagatccagtcagatctggctttgggcgacggcagcgaattgtgggcaggggggaggggagggggggatgacgacgcggcaagctcactagaactgtcggatgcggcggcttttcggacacgatgcgaggttgaccgtggcttcctcgtcggcatcgtagccaccggttcctcgccggtgctagtgacgagctttgcagccgccgccccaccctcttcacctgcaccaacaataacctcccctctccgccactagcccgccattgtctttcctcctgctgctggttccggccatgcacggaactaacgacgctctcactcacccaattttttctgaaaaaactgacgaggctctgggtacccaaattggacatgggaaccccatgaaaacatggtccccactccattctctccttcacgtaagcatttcgtctatgtagttgtttggggctgaataccacgaaggcgcactgtgaacgccctaagaagtccatgcaaaaatacatgcaaatgtacttatctaccatgatgcttttttttcccaaatctgccacaacttctactttggatcaaaatatatggatggctcatatatccatcggagggtactcttccaaaaaagaaaaaaaaatccttttctattggtcttgtttgcttgaacccactagccgagaaaaccgttatgtcatataaatcttatccaccacgcatgacgcatctgtcccaaggcccactagttcagcagtttacagctcttcggagcaacgaagtgaaacaaaataatgttgccgcttcaactaaatttctttgtgaacagagtgaacagactaccactagttcttttgggattcgttgatgttgttgagagccaaacggttcgtctgaacggaaagtgaaggaaatacatatggcccttgccttcctttcagaaagaaaaaaattgacacagagactggcacaaactgatatccaagtcagagtagaaatgacattaccagctagatgctttgtttgctgcatacccaggctcttgatctcaacgaaggaaaggaaagccaaaggcgtgcaaagaattgaaagctgaatcctagctacaacatcaaagttgtgagcacgtggattgtaatcatacatgtaatcagagggcagctggattatgattctgatctgaactcttggatatcaacaaaatcaaggataaaatatattggtaaaaaaaaatataaagaagcgaaacctcgatctttcattcataatcaatggcaaattgaagttcacacagattgcatgttcttcttctcatgcgaacaaatcatccaatctacgagaattcaaaagatcacatcgccttccatgcaaaccaagaacagaggaagacatgttctgattcctacaagcttctgcacctactgctactactgatcacaatgccaacaaggcctcggagttggcacgcagctgctccttctccagcacaaacatcttcagccgcggcagcgacttgccggccgtgttcggccgcggggccgccatgtttgccggggtcggggtcggggccgggcgcggcgcgggcagcttgacgtccttgacggcgacgcgcacggtccgtaaggggtcgtcgcgcgggaagttgccgttgtagatgaccttgaggtggccgtcgtcggcatcggcgtcggagacgacgaccgcgccgagccacaagacgaggcgcagcgccgtggtgcctagccttcccaacggagtgcggacaagcacctcgtcgcccctcttgaagggcatcttgttgacggacgatcctgatactgaccgcttcttggagactagtctccccttcgccttgacggcgagctcactgcggcggtggatgatcaggcgcgacgagcggggactcgagcggcgaagcgccatggacgaacgagagcgctgctgggagtgcagaggattggcggaaggaattgtggtgaatgcgaagggaggcggccgcgcatggatttatagccagccgagtccgagttggaattgaagtcggtgtccgagttcaagtcagccattagcttggctgtgattaactgatccggtattctacttggacaatctattcattctctgcgcggcattgttcaatctgaaggtgtcgccgaaaggtaagggaacggcggctcaggttgcaccgccgccataagcaataccaatcccaaaaatggaacgagagatcgactgatagtctgaaacaatacatatgtggttatattgggatgtggattttcatctctcgagtggatatctccttgttgtttgcatatcatctaaatagtcattaaaaaatttgaaaacaatagacaatatagattaatatgaaatatatcactccacaaacataaagaccaaattaaacttctacaagttacaacaaaagtaaaaaattaaactaaaaatagttatcgtacattcatagctatatttgttatttttattacaacttataggagttgaatttaaacttgcatgtttgtagagtgatatatctcatattaatatatgttaccaatttttttaaaaaattttttgatgactatttaggtggcatgcatgaaactcccctcgatggatgaaaacactttcccgttatattgggcctcttcagattacggccaaacttgatgagcatgactatttgaccgaccaaccacttgtgttattttatcaacttcacgtaaatccccacgtgtcaacccacatctcttcgtgttctctcaaggggccacatgtcagcgcacgacttcttgctgaagacataacacaccggtttcaattgttaagatgctaacatcagtgcaaacttaggtacctaatacccaatgtagtacgaggtatccaatacccaatatcaggtttggtacctacaggtatcaacccgatctagggaccaagtacctaataccttaggtacccgatacctagtaccaggtctggtacctactggtatctgaccgatatagatactaagtattttaggtacccgatacctagtaccaggtctggtacctactggtatctgaccgatatagatactaagtactttaggtacccgatacctagtacctggtctgttacttatggataccatcccgatctagcgaccaagtacctcgatacctatagtatcaggtctagtacctatggtactaactcgaataatctgggtaccagttacctgatacctaggtattagggactcgatacacagacatcaaataccttgtgcgtatcatgtatgattcgtgggtatcaggtctttgcgccaacgagagccatgaggagtactatacatatggccaagctcttaactctagtggctagtgcataaaaagacatactagaagtgtgttagagcaagtttaatagtatagccaaatgttagctccaaatcatctatagctaatctaataacccattcatataatagtacctataaaaatatactacaccattaatacccggtcctacctctcatacacacacaacgtcttagagtccgtgctgcagctggctacaaatctgtagcccgctttcttctctctcttctcttttcttctcgatatatagttatagctagcttacagcctgctattgtacttactcttagaggtctctagtgtgaactttggctgcataaaaaggtgtaccaaagaaaagctagtactacttagaaaagtatactaaaagtatagtatacagtagtactaaaaaactactagtatagtatatagtagtacacaggatgtgctattctagcctctaaccagcttaccacggtctacctcctcacgttacgcctaagccaccttcgcatgcactcagagcatagctaaatcatggaaaataatggttcactcataactaatcccgttgtatagacgatatcttgtttcctagttgttctgaaaaaaaaaaagaaatccttttctgttggtcttgtttcaaaaatgctatttatcgtacgtgcgcctgacggagagaagaaaatgccgtgcgctatttcccaaccacctgtgactccctctgtctttctcgcacctccctttctctctctcacgttcgatgctgttttctctgtttgatgccacagccgccgccttcaccaccatcgacgccatgttggacgtcagtcgtcagctcatccgtccaaggatggaacaaggcatgccgcctgattgtgattgaggggtgtttacatggaggcagaggcgaaggttggtcgactcacacggagcagcctggcagcttcttgtccggtcgtgaacagcagcatggtcgtcttcttcgtcacggttgtcgccagagctctcgtctccgcttgctggatgtctacgggtgtcattttttcggtctactcctgcactgccgccattggaggtgagggaggaagccagctctgactgatatcttcacgatttttttttatgtttcagccgatgtatctcgatgtttctttgtgttggatcaaattgttacagcgagatttcttatggtgtttcaattttgtcctttgatttttatggatttgttgatgtttcagtaattgaactttgatgttacatgtttcaatctatgattcaaccgtgtttcatcattttaatagtctgaaacatgtgttaagccagtggagaaacattcttcttaacaaactgaaacaatgcccgatttttacaacaaaaatcaggagccccatttgtaggtcctccggtcttgtttgcttgaacccactagccgagaaaaccgatgtcacataaatcttgtccaccacgctatttgtcatttttagatttggcaattaattatttgtcactcctatctcaatgacatgtgggtccacatgggtctatgatatatgggcccagtggtaaatcgttaattgccacacctaaaagtagcaaatagttaaatatctctgacgcatttggcccaaagcccactacttagggtctgtttggtatagctccaactcctaaatataactccaggaattgagtctggagtggagttgtggagctgccaaaacccagcttcacaactctagtatattttgtgagagagctccacccaactccactcccagttttggtggagctgaaactgtttggctgagctccagctccaggaggggtggagctagagctggggctgtgccaaacagtcccttaatccgcagttcggcagtttacatcttttcggagcaacaaagtgaaacaaaataacattgccgcctcaactaaatttctttgtgaacagactactactaattcttttgggattcgttgatgttgctgagagccaaacggttcgtctgaatgaaaattgaaaatgacattaccagctagatgctttgtttgctgcatacccaggctcttgatcaacaaaggcaaggaaagccaaaggcatgcaaagaattggaagctgaatcctagctataagatcaaagttatcggcaggtggattgtaatcatacatgtaatcagagtgcagctggattgtgattctgatccgaacacttggatcaacatgcatcatgcatgcatatattggcctcgatcttccattcataatcaatgagaaattacagttcacacagattgcatgttcttcttctcatgccaagaaatcatcctatctatgagaatttacaagatcacattgccttccatgcaaaccaagacatgttctgattcctacaaacttctgcagctactgctactactgaagaacactgatcacggtgccaacaaggcctcggatttggcccgcagctgctccttctccagcacaaacatcttcagccgcggcagcgacttgacggccgtggtcggccgcggggccgccatgtttgccggggtcagggtcggggccgggcgcggcgcgggcagcttgacgtccttgacggcgacgcgcacggtccggaaggggtcgtcgcgcgggaagttgccgttgtagatgacctcgaggtggccgtcgtcggcatcagcgtcggagacgacgaccgcgccgagccacatgacgaggcgcagcgtcgtggtccctagcctcccaaccggcgtgcggatgcgcacctcgtcgcccttcttgaaggacacgggcgccggcgacggcgcggatgacatcttcttgacgggcgaccctcctgacgccttattggagactactctccccttggcctcgacggcgagctcactgcggcggtggctgatcgggcgcgaggagcggggactcgagtggtggggaagcgccatggacgaacgagcgctgctgcgaggatgggtggaaggaattgtggggaatgcgtagacggagagtggcggcgggcttggatttatcggcagccgagtccgagtccgagtccgagttgaaatcggtgatggtagcaagtcggagacggagttggagttgaagtcggtgattagcttgctgtgattaatggctaatcctcgtgaattcttctctatatgcgcggcattgctgaatccgagcccgattagaaatcgcagattcgcgcgcgaagcctaagccgaactggtggaggtgtcgccggaggggctgggcgacgacttacggcggctcagtttgcaccttctccttatgcaatacggagaccaatcggagaaaagcagaacgagagatcgacgatgggcatatgtgtccggcgtcagtcgggaatgaagctcgctgaggaagctctggacgccggcggcgtcgttcttctccgatgatcctgtgaactgctgcccgtcaaagttgctaacttgcagctaatagacgacacgacactgtttcagttgtgcacggtgaagcagcatcacaggtttgcttgctcgaggaaagtgaagcaaacagaaaagaaaaggaaaggaaaaaaaggaagtgtcgtcaacaccaaaatcacacaagaaaaggaagaaactgcatacggcgatatccctcctaatctagaaaggcaagtagaggagattgcaagatagtagtagaatactctgcttgtacatttggcatcgctgaattgaaatcttgtgtatctcgcgcgattaacaattacatcgatcgagtcggatcgatcttttttccttttttttttcgtgctatcacagaaattacagacacaatagcaagagagaaaaaggaagtaaaaaagaatagagtagtatatataacagcagcaacctcagcagctcaagcgaggtggatgggatgaagaaatgagttgattggatttaggcgagggcgtcggcgccggcgacgatctcgaggatctcgccggtgatcttggcctggcgctggcggttgtagaccatggagaggttcttccggagctcgatggcgttgtcggtggcgctgctcatggcgctcatcctggcggcgagctcgctggcgagcgactcctggagcgcgcggaggatctggctgttgaggtagagcgggaggagcgcgtcgaggatctggacggggtcctgctcgaactgcaccacgggtgagaagggctgcgtctcgatcttcaccttctcccgctccacggtcagcttcccttccttggtggtgagccggaacagctcgtcctcggtggcgtccacgcacacgccgttgatgtcgcagatctcccccttgggcgacatggggagcagcgtctggatgatggggtcggagcggacgagggagacgaacttggagtagaggagctccaccttgtccaccgcctcggacacgaacagcgagtagacgaggtcgcagatggactgggagtccttcacggtggggatgccgttcacctccagcgtccgctcggtggggatgaagggggggcggatgaagtaggcgttgcccttcttgccgacgctgacgacggtgtactcgaggccgagctgcttgagctcctcgatgcgggtctcggccttcttgaggacgttgttgttgaagctgccgcagaggccgcgctcgccggtgaggacgacgagggcgaccttcttgacggggcggatgcgggtgagggggaggtcgatgtcctccgtctggatctcctggttcatgttgtagagcacctccaccagcgcctccgagaaggggcgggaggacaccaccgcctcctgcgcccgccgcaccttggccgccgccaccagcttcatcgcctccgtgatcttctgcgtgttgcgcaccgagtcgatgcggctccgcagctcacgcagcgagcaccgcaccacctgcaggcggccgctgctgccgcagctaggagcggagcggcggcgggtggccagggcggaggaggaccaggcggtggagaggtgcgagcacgacatggctggcgggtcaccggcaacagcggcggcggcggcggcggcgagtggagggaaagatttcggattgggtttgggtggaggtgaggcgaggcgaggcgaggggccgaggctctccaggcggaagtagggcaggtggggttttcaaggcggggtgagtggtggaggaggcagtggtcggatcatgtggatggatgtgctgctgcttctgctgcttccatttcactcgaatcattttttggcttggcccatctgaaactgaaagaaatactagcatattggaaaaatgaaaaataaaaggaaaagagatactagtaactcacactggctgggactcaggatcgtgctgaggatatcctggcatcctgcagtagatatcagatactacccaaaaaaataaaaattaacacaagctttagacatgatggttaggttagccaagtttagttcccaactttttctttaaacttctaacttttccatcacatcaaaacttttctacacacgtaaacttccaacttttttattcaaacttccaattttagcgtggaactaaacacagccttagtacttgtgcttgttgctttcaattttagcaaggaaatgattttatttattttaccagttttgctgtaattcttctgcatatatagaattggtgagcacaaaacttcatggcagagggaacaaacagatgtaacccagttctttccagatgtagaaacaaggtagtacatgaatatagaagggcacagtacaggtacaaggttcaggtttaatgaaatggaagtaacttcgaatgtaaactagaacctcagggtacaacagcagcagcagctaaagtctcggattgatctgcagcaggaggtttctttgatggcttgtagacactgaaatcgccaaaatcccgccgtccactacacagcaaagaacacaaggtatgcatgtccagagggtcaaagataattgtccaggaaaaaaaaatcatctaacagaaaaaatcttccaaatctacctacacatagttgatagataaccagggtgattttgcaccacaaacatgcgcaattatcaatgtgtgagaacaaaccgagtagcaaaacgacaggtgaattcacctgtgctttatattccagcccgaaggcaaataacgagggtgaagagaagctacgaagacctgcctccaccgttggctgaactggttaatggcctcctcgccaccgttggaaagcaaaagctccacgacctgtttaccgtgatgcccatgacctaacagggagatcttcttgtcaccgttttggggaatggcttggttagaattgttactgccgcatggatccctgtcaagatcaccgtttgcaggattaccacctaagcttgcttgctgcacggtgtctgcctcaatgctagagtcagaaatgggattagccatacggggtggatagattgtgctttctttgctcagagttggaccatgtatcttattacccccagagcctggctgactggtatgttcatcaatacctagctgattgttattctcatcaatgtctggatgactgttattctcaactccatttttagaaaattgctcagcatatccattttctggatcatgttcattattctcaacaatgccgttgctgttgctttttctaataacattttgagcctgggatcggtaagaaaaaccatttttctttgaatgtcgccttcgctcattgggactcatgccaacaagtaatgccatctcaagatcttcaggagtcacatccctaccaccatagtatgacttcacaatctgcaaagaaatgaataggtcagcaatacagatttaaggctaattataagaacaaatttggtctactgaaatattgatgataactagcatgaaaagtttcaataagacaatgttgaaactgtggtgaagcccaaaatacttgaagattctcatcacctgcattagctcttcatatctcttcaaaggcatattggatccatgtcttaaaagggccattgcagcagtcctcagctgcaaaggagacacacctgttccatttgatttatcttcagataatgatgcaccagctattaaacttatatcacctgagtttaatatcttctgtacaaaaagcggcaccccaaattctttggctatttgcctcttgtacttctcagctgctgaatgagcaatttcatggcagtctacgcaaagaagtacaatatcatgtgaacgatggctcttcagatgctctggaaaatgcatcctgtagcacgatggtataattctatatctgatatagtggctcttttctccacatccgacacaaatatttttcttgctctgaatatagaagtcattatcctcatcctctgggcgacccttaggttcaaacaagagcacaattgctggaggattatcttctattaattttgctaaattacgttgaatatacctggaaagaagagtcggtcagtttgataagataaccatgattttacatacctataaacactaaatagtgcatctaagtgacaaaccattccaactttttacggtcacagtagcaaagcagtcttccatcactggcgtagatcctgcaattgtgatatactggggacttgcatgaaaactttttaatgaataattcccgggaagcctttttgttagttggtgccatcaacaacttctccccacttgatgcaaaggagaacatatttttttgcttcaaactcagctgtgatacaaggttataattaaaaactgatagtcgacataatctacttggatctttgtacttctcaagcaaatttttaaagatggcatccatgctgacagtgatgtcctcaatcagatagcgaagttcttcagcgtgagcaacaacaataggtgaaggtggcggcaaggaaggatacacagttgaattgcttgtttcagtttctaatatggcagaacacacctcagttggacctcttggaacactaacagcaagggaagctatagcttggtctgacaggacataccgtaagctctcatcatgcatgcgagcctgcaatgaagtaatcaagataattgaagagtctggaaatccagagaccagaatcacaagaaaacagatatgtcaaattattgggtgcagcaacttaatatatgcagaaataggaaaatacaatgtgtgaagcaccaaatacagctaatagatttaacaaaaagctaagaatataccctacgaaaatgcgaaaatcaattgttctaaaagaataagaatatgttggctgaccattaaatccctccatgcacaaattttccaaacaagatcctacaaaagagcaacaaaattgagaatttattgaaatcactggcaagcaggcaaacaaatacagaaaacgagcaccttcacttcacttgatttataggagtcaagtccatggctttgcaaattttttgacaaaatagacgccgcagaggatgctcctggtggacattcaatttcctttgcatacagttgcatacacaccatatttgagcgatggctggcctcgaagaaaaaattgattttgtcattgggagagtctgaagcatctgattagatattacagtttatcaaaaaagtgagacagggaacaatggaaataattatgtaatttggtttcaggaagcaataaaatatcatcaattcaacacggaatctcattttcttaagctgcataacaggattgtataggctaatagaccaatatattttcttacaaagctaaatatttgctgatattattatcaaataagttttagatacttgatccagaaggttccagtttatgcacaggttaaggtattagtacatgaaattttgtttttacttgtagcttgaaagttactgatcccctctgtcctataatgtaagatatatttcatcttgaacatagaccaaagagtcattagacgttacttgattactctctaattagtatctctaagggctgcagtccaaaaaatatgccttacattcttgggtggaggaagcattcaaaagagagtacaatagatagtgcatatctttatataattttttcatagatggtcctccagacacagctcaaggactggaagctttttaaagtttaagcataacagactaaggctgtgttctaagctcccctttccagtttccaaacttctactccctcgtttaccatgcgcaggcttcccagattggtaaatggtgcgttctttgcaaaaattttatattggaaagtttatttaaaaaaatcatattaaattattaatccattttcaagtcttttaagctaatacttatttaatcatgtgctaatgagccacctgtttttcgtgccagagaggaaacgttttgaacctctaggttggaacgcagcccaacagagctacatcagtaatttacatttgcagaaaacaatgtgctcagctgaactgaagggtgaacatagaacaatccagataaactgatgcttgtgagctcatgtgaaactaatttagagatgcagggagtcatgagttctattgtctaggactctaagatgtcaaatgtagctgtctgtggtaatgctgtaatgtctggttggatgggatatgtccatccatgtttggttgaagggcaaggttggatgggatatgttcatccatgtttttaaggatgaggatatacaagttttgtgtttggttgtatggatgggatgagccaactttttgtttggttgataggatgaggatgcatcggatgagattaattaactaattataatatcttaattggcataatattactagttatacacttaccggttggaattaacacttgttgacactaatcttgccatgctaactactaattaatagcaaaacatgctaataccgttaatcatactctaatcaactcactaatcatgtactaatcagcgtcctaaagaaggtggatggcttcatccggccaaaagaaccggatcccttcatccagcatattgagagaatattctctattctgggtcaccatatccaccctgtcctccaaccaaacaccccaaaaaatcaggcggccatctcccatccagtcccatccacccaaccaaacacaccctaattgccttgttgactcagtttgctgaacaaattactatcttgtaacaactaaaagtagcatatagtacatattggaagggaaaagttcccctccaaaaaagcaaggggaaactcgacataggaacatagatcataccgtaagtttttgcatgaagctctgatgccaaacaatttgcaatgtacaacagataatgcgcatcacaacgggcatactgaatcatttctggtgttagtgggcgtaatctccaatcctcacgctgaaatatcagaatcaaggagaatgaaccgtaaaaatgagagcaactgtgatgctggaaaacaaactgctctttccggtcaagtatatctgacgttgggagtatcagttctagtactccctatgtcaaatatacttgactggaaggagtaaattttgcaggcacaactaaaaggtcatcgattacaagtaggcagaaggaacttgtttatcattttcttttacatgtcacctatttaataacaattgaatgcataaggaaacaggcttctaaatatcagctgagattgattaatggaacagagtttcgatcaagaatttgtatgaggatcaaatggaattgagtaaaagggcaagggaatcatgcataaagtaatgcaagtagtgacaaaatataactaaagatgtgacaaccattttagtgacatgctttaaaggatgtaaaggcacaaattcagaaaaccaccacaatttagggcttagtaccactgaccaccattaggtatttaggtcaacaatcatttatttcagtaatggtgcttaatatttgtaacaacagatagtgcagaaatgacttagaatctactgctacaccagtagattctgaaatcagagtaacaatgcataacatgagcttccataggtgcaaaaatgaatttgaaagaacctactgctacattattattctgaaatcacaatcaacaatgcataacatgagcttatgcaactaatgttttctaggacatgaaagcttcaacaaaagctaaacatatatcttgctaagctcataaataagtgcaacacaaatgctctaaatgaattggcaaagattctctgtaactaacatggttaaacattttgtagcaccctgtgcaccattgtgtctaaagtgctaaaaagaagtaatcatgtaaaaattgaggcggcagatgaaagctaaccagctactaaacagtaaacaaaccagtaaataagctgatgaaaacactttagtggctttagcaagccaaccttaataaatggcctacctgcattgtcttgtctgtggtcactccacaatataattcaagcaaatatgctaatgacttctgtggttttgatagaacctcacatgcctgcaataaattactttcataaggcaattcagaaaagggcatacatgcataacataaataataaagtgaggtccggtgaaaaaaaaatgaacatctaagatagcataggtgaataactttaggggcaaagttgccattaaacaaccaatgttcaatgaccaaaatattcataagaaggtgatctctactctagattataggaactggtaccaaaaaaagatgttttcatcgtaaacacattgtaaatccataaatcttttcatattgcagtaaaccagttatgaaatcatttcccctgcttaaaccatgaatacatttctggttgaaacttgaagctaaaatcaaatatataaaattgaaacataagaaattgtaatcaagcgtgacgaactttaaactatcacatatcataatattggtgatgatgcttagcagctcattatgttgtcccatgaaaaaactataaccactaatgcaaaaatgaacgggaagcacacaaatgtaggtcagcaattgattggcactgctgatgttctttcattacattaaagaaagtaaaatatgctcacatctaatgagatgtccaagtaaaatgatgtttcatgacctattgccatatctacgtacagtatggcatgtaacttgctacagtgaaaagacatggcaagcaaacattatatgcgacaaaaaacaggcacagttcgctcgcatgctggagaaatctctgcggaatggtattagatgtttcatccaagacatgcatactgtagggggacttaccttggcagtatcaaacatattcacaacataaatatgaaagtctctctgaagccaaagaacatcattgtcagctccatggaagatctgacaaataagtagggagaaggtaaatgaaactgcatttaataaaagaaagcaacacagatcttctgctgagacgattatacagcaattgattttggctaatagtcaaaaactcattagaaattagtgtaggtgtctaaaaaaggcctctgccactacattgcaaagaaatgagattacaagctaaaatagttatgagctctgaaggaattcatgagactatcaagtgccagagacaatactgaaggttccatatgcacaaaggacagaaaaagaaaagggagcaaggatggtaatgaaacaactcaaaaccgtagtctaggggttagagctagcatcagttcatatacataaggatgtctatacggctttgtaaaagtttgcttcactgtggtttatttttctccatggtgaaatatcaagcagacatatcgataactaaaactctaccaatgtccaaatgttcacttgctaaagtgtgatcatcagtttgatagtgagtaatagacagagaagagtaaacaaaagagagagagagagagagctgacaaagaataatacatgaaaaaagttaataataaccagacaggaaaggaaaaaacaagaaccaaatgattcatatagcattgattctgaagagccaagggtaaacggaccatttctgggcaaaatagtaaaatgtctatgagaacactgatggactcattcagcaatcttatcttgatcaaccaaacacccaccgtaccatgtaaatcatccatgctgttagggccccatgttccagaaattcaaatttacaagaagatttaagggctttaggtttgttggattgatttgttaggccaaataccaaactcagcattcgttcatttagagtgttcggggcccagcttctatagaaattacatgtcttattaggattggctgaaaaaatttttgacttattgtccttcaaacttccatattttggttgtttgtgtatagtggttcctggccctgcagtatcaacaacgcagcatgattcttggaaaaaaaaatatattactacctctaatgcagagacacataattatctttcatgatggctgagaaagaacaatccaccatcttatggatatcataaattagagtttagtgggtttaagcttgatacaaacaggaaattagactgtcaaacaaaccacgtttaggagggatgaactatgaaagctctaggcttaatccctcctgcacatcagacaatgtgaatcatgtgttatggtgaaaatataataattaaaaggcatttttacattgttttatttatggaccatggaccatggctcagctctttaaccagaaagaatcaatctctgaacttctctagatatcttttatagtaatcttagtaccaagggtgcacacaaatgtgacgctggtggaaacaacttgtttacaccatgttctcctacaccctatctctgtaatcacaagtgtaatttaaactttattggaataacatgtaaatcaattcacaccatcatctgtactgcacattccataattctagagcttccaaagttggacaacatgcaaatccatcacaattcaaaaatacaaatggtaagtggcaaaatcactttaagcagaactgaaaatgaaaactaatggtttccagtgatatcagatataagagatgcacaaccttacagattgaaggattggcaaaaactggtcgtagaatgctcatcacgtcatgcagcgctattgtgtctattaaataatctgccttctgggtagagatctaaaaatgatatttatatgtcataatcttaacaggccaataagcaacagagcaataagaaggtatccaccaccagttacctgcattagtgcagtgtatcccaagaatgaccgaaggctatgttgctctgtatcaacagcaaaagctttttcatcatccaacaacctagccaggtcctccaactgagcatctgtttcgacccaattgtatgaagtgctcatttctgggcatcgatcaccaggcataaaattctgaaaatcaggtgggttgttcagcaaggaagtgatttcctcctcaaatggatgcaccttttgtgatgactctgtatcgataagaaaaggaaatgtgtcacctactcaatgtgcagtcaattcgcttgcagtatgcgcatagagactatggtgaaaactcatgcaatcaaacttaaactcaggcacttgtgctttcagcatctcctcttactaactatcaataacggtttatgcacttgtagtaatttaatcgatcaatcttttcaatttacttgcctaactaggagtccctaaacatgagatgcagtaactgtaccaaatattgtgagcaaggctgtgcagtacagccttgtagtaaacttactaactcataatatttgagaagtaggaatctttggtaaagttaataaaagtcctcgtgaagtagtaattttgatcgatccacctttttaatttttgtctaactaggaatcctaattcctaaacaagagatgcactaactgtaccaaatattatgggtaagggtgtgatgatgtacagtaatgcattgataaagaaatagacaaagcatgcaatgtaaggactacctgacgaagctccacgttgtgttttcagtgcacgttgataactacctgacgaagctccaacaagggaactggcatcatgaaggccccttcctatgccaagtaaggactaacacgctgtgcaatcaactaagcaatcgtttccttatgttcctcgtatgcaaagagacaggtccagatctccatagtcaatcctcaagctcggagcaaccttgcactcaaaatgttcgacgaaattccccgaagaaccaacacgctattacgtcccccctaatcctgccttagtctccttagcgtaccaaccgttcgcagaattcccaatacaaccacacatctacaagggcaaggcaatgccgagatcaaaagaaacaggagcagggtgaccacaccttgagacgtcggctgggcctcgctgccgtggtggccggagccaaccggtccagcaccctggcggcgcaggtgcttgaaggcggagtaggagttgtccgcgaccacgcgcctgaaccgggcctgcggcttctcctcctcctcgcaggctcggcgcgggcggcgccctcgccgtcccccgaggaggccgggcgaggctggtgcgcgagcgcgaccccgtctgcgccggcggtggaggagagccgccaccgcgagggccgcgaggcatgcggcggcggccgcggccgcggcggcgcgcgacctgaggttggcggtcggcatgacgtcacgggtgggacgggttggcgaccggagacgacggcgagaggtggctcggtttcggtttgaccgttttgggactcgaagcgtcggtctgccctgcaaccagctgacgtcaggcaacggtttggcccatcactgatttttctatgggccacaaaatagcccaattattgggatgaaattctgggcctatttgacttgcaaataaacttttggaccaatttacgtgcacctttgggctgaatttattcttgttttagtgacattcaatatgctatcgcgtcccgaaagtttttcatttttctttgccaaccgatctgcccgtctcccgccgccgccgccgccgtcgccgcctccggcaggaggcccaatccccggatccgcccgcgccggatgctcctccgccgcgccgtcgccgccgtagcggagcgctcctcccgattatcgcactcgcgacccctcctccggcgcgcgggctctgcctgctctagcctcaccaccaccaccacctcccaacatcgtcacggccgccgtcgcgcgccgccggctgagagcaacgccctcacaaccaccggcgcgccacgcccgttcccggactactccccgccccgcccggactcgccggccgacgacgacctcgcgcgccgccttggcggcgccgtcctctcctcccctaacccgggctctctccctcccctccccttcctccctctactgcgccactttacctcctnctcgcgctccccctgctcgcctcgcacccgcacctccccaccatcctcctgccgctcctcctcctcttcccctccgggcctggcccgcaccctcacctgcttcagtccttcgcggtcgctgcccacctcgccgccgttcgcgatcccggcgccgcgcgggccatcctcgttcgcgcccttcgcttcccgtcccctcatcggcatttcgtcgagcagttcatctccacctacaaggccttctcctccgaccctgtctcattcgacctcctcctcctgtgcctcccctccgcgcctctcctcctccgcctccgccagtacggcatctctccctccccggagtcctgtaacgcggtgctctgccgcctcccgcttgatgaagccgttcagttgtttcaggaactcccggagaagaacacctgctcgtacaatatactactcaaggcgctgtgcaccgctggccgcatcaaggatgcgcaccaactgtttgatgaaatggcatcgccgccagatgttgtaacatatggcattatggtgcatgggtattgtactcttagtgagctggagactgcgattaagctgttaagtgaaatggcagcaagggggttggaactcaacccagtagcctatactagtgttattgcattgttgtgcgacgaagggcaggtttcagatgctgtgagggtggtagaggatatggtgatgcatggagtggtgttggatgcagcggtgttcacaacggtaatgagtgggttctgtaggaaaggtgatttggcagctgcaaggaattggtttgatgagatgcagaagagagggttggcagctgatggagtgacgtatactgcgctgatcaatggcctttgtcgggctggagagttgaaagaggcagagagagtgcttcaggagatggaggacaagggattggatgttgatgcggtcacatatacagttctcattgatgggtactgcaaggttgggaagatgacggaggcctttctggtgcataacaaaatggtgcagaaacgagtgacaccaaatgtagtgacatacacggctctgtcagatggactctgcaagcagggggatgtgtgtgctgctaatgaactattgcatgagatgtgcagcaaggggttagagctgaatattttcacatacaactccctgatcaatggcttgtgcaaggctggcaatttggagcaagctatgaggaccatgatagacatggatgaagcaggtcttaaaccagacgtttacacatatacaactattattggtgctctttgccagtccaaagagcttgacagggctcacagccttttgcaagagatgttagataaaggaattaagcctactattgtgacttataatgttctaatgaatggcttttgcatgtcaggtagggtagaaggaggtaagaggctgcttgaatggatgctggagaagaacatccacccaaataccacaacatacaattctcttatgaagcagtattgcattgaaaagaacatgaaatcaaccaccgagatctacaagggaatgctttcacaggaggtggtaccaaatgaaaacacatataatattttgatcaagggacattgtaaggcaagaaatatgaaagaggctctgtatttccatagtgaaatgatagaaaagggattcaggcttactgcaagctcatacaatgctcttataagattgttgaataaaaaaaagaaatttactgaagcgagaagattatttgagaagatgaggaaggaacgtcttacagcagaaccagatgtatacaacttttatattgatctcagttttaatgaagataatttggagtcaacccttgcactttgcgatgaactggtggaagtcactcttgtgaaatctatagctgacacggatgatgactttgcagaagagcatatatgtaagtaacatgctttggcaaatgatatcatcctaatctattcaggattggcaatgtgtaaagtgaaccaagaacacacaacagacaaagcactgccctttttgccatgctgaaataacagttgaggtaatcattcatttcatctaatcacttaaatcaatcatccatggacactttagcaatttcctgcattttcttatgattgatgataatatcctctatttacagcgatcatgagattccttgaagagatgtgggaggttcttggatattacagatacgtatgggattgctcatcatggttattatgcaatttgcaaggtaagagacaaaatgcacattgaattcattgttttattttccgagtattgcctgccgttttcttgtacagttactatatgacgacatttctgggctctgggagcacctaaattttggtgattgcaaccaatttaaacccttcagaaatttacaattttcttaaacaattggtaacatagaaaatgatttcattaatcactccacaaactttcaagtaacattaggtgatgacattgtcaaatctgtaccgactacatagtgttaacctgtgtggacttatgtttgtacctcgcattgccattggttaggaaaaagttttggagagccagtgcttttattatttactacttatgtttcaaatcgtactaataagaattcctagagctgtccagctacgtagagttaactgcttgacctgtgtggacttatgtttgtaactcacatcgccattggttagggaaaagttttcgagaaccagtgcttttatgtacttatgtttcaaattgtactaataggaattcctatagctgtccagcgtttgaatggcagtttttgcataatgctgtaaaccttgtagagagttggatatcattttttgtaattgtgccttgcctacatggctacaggtctattactccaggctgcttgagttgatctgccactgtattacatctgttggtcaaatcaggactcttctgacaccagagtcctggtgaactgatgatgtcatgttgacctcaaggtcacaacacacataagatcacaattttataattaagtaaggttaagccacacgatcacacattcacacatatatgcataggaaaaaaaagggaactgtacaagtatctgtatttacatatagggttaaaatcattacctgtgttaatccatgcagttagatcattcaatattgtcatgccttgacatatgcgtactcaacatcctcttcatgacgtgtgatcaataaatttgtgatattttttgacagatagaccatcctgttgctgtggagcatgtaaagaaataaagtgatgattcttacaagcacttaaggccatgagaaatgaatactgttcacttctacagggccttttgtatgatccatatctgatagtgtgatggagtaagtactcaagtcctatctctactatcaagttcaactacttcagaacatatcagtgaaccaaggacttctttagctgaacttgtgctaaactgcttagcgtttaatctttatgattggatgttatttttgcaccattacaacaacattgcaataccttgtctgctgagtcctatacatgtgctctgttgatcctactagtaccttttttttcctcttagttatatgctccattttttatggtgtacacaagtatatacaccgttctttcaaacttacattacgttctggaattatgcttgtgaatcttagcatgctttatagttccttgtgttgcataccataaatatactgtactgtcaaactacttatatttgtaatatggtctgattctctaaagaaaaaatatatatagcctgtacgaaaaatgttatgtactaatgtacatcttgttgtgtgcttctaagttcttgcatctgattatgagtgggaaatacaagtctgcaaactgcaattgtggctcattccttgttcaatggcatgattgtagggaaaattttccatggtattgttggcaatttcttatcacactgaaagtattacaatgatgatggtctagcccagagttggatgtttggactttggagcacagaaggtaataacattagtttgcgagattgccctttttggccttttcagatgatgatgatatacaaggagataattggattactgttgcatagcttcagcttcccacataaaatgtgtttggtgagagtgagtgagtgacaaacttttacctagtgttgatagggagttgacatcatggagctatgctatcgacatcttttcactacataatagggcagtgttacccttctaaccatgtctcagtgtgaagcaatatagctgtactatttttacaacagcagggacattagctgcttaagtcaagcaccaactagcgatttttgtcctaactgacacttttttcgttaagatgcatttgttcagttttacaaggcccaccagatatagcaaccttgagcaatttctttatgatgatacacttgtgtaaaagtaagtagcaaaaatgacctccgcttgtaagttctaattcatatcgatacacaatctttgcttccaatggcctcagatggtatacctgttggtatagcactatagctaccgggaattctggaaccttgaactatctgtggctaaagacatgacaagttcccttaacccttgacagatggcaccatctcatttcattttgttagtgctttcctacaaacctgtgattctttcggttcttttataattggatgccacgtactctctccttcagttacaaaaacatgtcgttttggacatatctcaagtcaaagtttaaaaactttgaacatccatatattataaaatatttggattaaatttataaaaatcatgtttatagatttgtcttgaaaaggaaaaaaatattttttagtattataattagccttttgaatattttgcaatagatagaaattagtgatcatagctgcattttgaagaccacatcgatgtccaaaatggcaagtgttcaccgttttttttgacaaattgacccttttcaaaaacttatttcgaaactaacccctgccaaaaacttcaaccaaaaataggccgtcgcctcagcgccaaacacattggcgctgacgttggccgtgttagcgccaacgggactggcgctgacattgtgccaccgtggcggccggggccgatccccagctgacgtggcagctatctcagcgccaaccggactggcgctgaggtgggacttggccgcaaccccaaggcccagaccagcaagccttctggatggcttgcgggctgggacctcaacgccagccaaaatggcgctgatcttgggactggcgctgaggtgggacttggccgtttcggccttggcccagcgaagcaagccttctggatggcttgcgggctgggacctcagcgctagccaaaatggcgctgactgtgggaaactcagcgccagccaacctggcgctgaggtgggacttggccgtttcggccttggcccagccaagcaagccttctggatggcttgcgggctg

SEQ ID NO: 30732 - DNA, 2918 bp, Oryza sativa
tacaaaacatacatccatccatcaatcccaacatcattccatacatccatagaatccatcaatacatccatatatgaagtccatacatataagaaataaaaacatcccatcgatcctcggctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcaagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgtgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtcctttccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacttcatgcaactaggaactttaattttgggattgagcaagaaaactgaaaagaagatctgtgtgtttacatgctctgctttgaggctcatgaattttgatttgagatatctctatgatggatgatctatctgtacgaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaattgaatcattagtaat

SEQ ID NO: 30733 - DNA, 763 bp, Oryza sativa
tctattaggaccgatcaacttgtttctcaacatgttgatgaaccactcccagttggatgtattctccttctctaccagagcaaacgccaagggaacaagatgtaacccggcgtcgacccctatggccgtgagcaatgtaccttggtatttaccggttaagaaagtgccatcaattgctagcgccggcctcaagtgcttgaatgcttctatggactggccaaatatccaatatgcacgtccaaatactcgcctctgtactccatccaccatcctggacttctcgggatgagcctcaacacggaaatgcatggtagggctctttgctttgatggcacgcatcaatgtaggcaagcgaacatacgcctcgtgccaaactccccaaataaccttcatagcaacttgcttagcacgccatgctttgccatacgtaggccgatagtgccatatttgctcaactgcctcgacaatcgctgctggagataaagttggttcagctcgcacaaatgcttgtaacctgtttccaataaaccttgaagtaagttgcaaatgcttgccggttacttccgcactacagcatgtgtggtcttcgcccaccctagtcacccgccacctatttcgtccactcttccttacattaatctgccatttgcaatggcgatcgagacaagccccagtatactttactgacgcgttagattccttcacatggtacggccggtggacacggatagaataactctgtggccatattttcagatcatcc

SEQ ID NO: 30734 - DNA, 6693 bp, Oryza sativa
tgtacaatcaagcaatgaatcattatccatcaccatcaccacagcaagaagtagccaatttacatgaatgtaagagtgcaagactatccttctctattacaagacccccggtcactgatctagaacctgtctgattgaatgctgttgtcgtcctgatagtgttttaggaaaagagacatcaaatattatcctcaagtttcctttcaatccctcgccgattggccatccttcatcctttattaccagctcataccctgggtacacgacctcatcaactttgatcttcaagtagcgcccatcaagtgtcttaagatttatggtacactttgcaagtgcatccacaagacgaagaacccaatgaactaccaggtcatttccatagaggatgtaggtctcatgaggtgcgatgtcaagggtcaaaattaaatcatggggcggctggccgtaaaaatgggacccttcataaggaagtgttatttttgttcctttccttgatccaggcagcactttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttggatctaataaaataaatcaccagttatcaaaagttcagattactataaacaacacattaaactgcaggaaggaaagaatgatagttacatcacttacatttccatagaagaaaaacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaatacactgctgtacacctagtttcagaacatgaacatctatctagtagctgtacacctagtttcagaacatatatatctagtatctaaacccacaaggcattttttctagtgaaacaagatgatcctttttacacttttcaaagtcaatattatgttattcggtaccattgcataaaagtatttcaacatatgaacagtatagtacttataccctgtagatcaagtttgaagttggttcttggcggagtattagataccagtataatctacattgtcaatttttaaaattttctccacaagcatttgcattaaattttaagagaaacatgcatacaagaagatatcctctcaagagattagaatccattcccatatcacgaacagaaatcatcattatgcataagatttgagaaacagaattgaccccttgttgaaatcaagagtcttaggatgaactggcacaggcatgcgttctttcttcaagaacatttcatttcttgattgagagagacaaagcgagagagagatggcgattcaaccttaaacgaggcgatgctctcaatcaagaacgtttcttgattgattgagaggagagagatggcgactaaccttgaaacgaggcgcagctcggcgtgagaagcgtccctcctccccctccctggcgcagctcggcgtgagaagcgtcccgttcttccctccctgagcttttgttcgtagacgaaggagaagaagcgacgttccagcaggagaacacgaaggagaaatgctggagaacgcaaagaagaagatgacacgacgttcttctcctcttcctcctcccaggagaggaggcgccccctgctgatcgccggagatgacctctctgctttctgctttcgtggcagaccaaggaggaagaaaggaggtgtcaagccgttgtagaagaagaggtgagtaatttaagtattggaccgccaggcccaccacagtctaaccatccccatgggccgtatagcccacgttcggcccactcctcctctgtcctgccatcgccgccgcatcctcttctgtgcgcgtggacggtggccggcggcagcggcggcgcgccggaagtcttcattcagcagccgccacccccgctggttagcagggctcctctcgtgctgcccttcaccatccgtagcggacttgcatagcgccccggcggcccggacctcagcgagtgagtgaaatccctcgggcggcagtgtcgccggagcaacctgccgccaccgccaactccacgatcgccgcacatactggatctcgcactcgatctctctctcttttcctcagtacttcttcgtgggggcggtgaagattggggatcagctcggtgggaggaggcgagcgacggaggagacgaggagtcggatggggcgactgaatcagaggagttgttttttttttttctggttccacgcatagactggagtactggacccaccacctatacaatgacacattttagggttaattagatccatgccactataacttttgccaaatttaaaaaatatcgctactattcatcatatcagctatgtaccactggaaatttttaaaattgaaaccatatcactcccgtcactttttatgtctcatctctcgcgccgtctccgttcccatcctcatcccctctaggacccaagcgttcacgtggcgcgattcgcggcagagtcgttagacgcgcgcgcggaagcgaggggggatggtggcaggcgggacgccttcgcgccggcgacgaggagcagcagtaggaggacaggccggggcggttgcagccgggcctagcggggttcgcggcagagtcgtcaggcgcgcgcggtgtaggcacggacgcctctgtgccgatgacgaggaggatcaggaggaggaggacacgctccgcgtcctggtgtacatctccctgatatgccagaggagcgccgtcagcaaggacctcgttcgctaccgcaacatcctttgcgccatcgccgagatgctcaagagcggtagcccctgactccgcctcaagtccctccaggtcctccgtgtcctcgtcgaggacaacgatgacgacaaggtcgcaaatcccattccccaagtttcaacatcccccaaagcagataaattttgcaagaaaccaagtaatagttgatcgattcttagtttcaattttgcagaagttggggaagggcgacacaatacacaccatcatcaagttcttgtcgaacaagctatcggggcatgagccgacgtgcaagcggatcgtcgcggtcgggacggggagtagcaagtcggagagcgtcgttgccgtcgacaaggtggagagcatgctctgcaacctcgaccgcttcgaggccaacgcccaacatgaagtagggccgacaacgccagactgcaactactcctcaccaggctgcttcaacgccaacgtcaagcaggccgcgatggccacgcgttggcgaactcggtgaactcggctagatcactacctcagcgagctcgcactggcgaacgatgacaaggtgtcatgccccgaactagccccgagtggaactagcccgtgacactccaaattaacctgttaatcgataccagtcccaggaaacagtgatggtatcacaggaagacagaatatcacagcaacagaggtctctttattatagagtaggagtacagtcattatattgcggacagatcccgagctcacaactgcattacaaaagggaaagcggaagccaagacttggaccaaacatcacaggcgcgacttgggaactaggtcgaaaccctaaaactcatcgtagccgacttgctcctggaagaactccttgtcagcgggatccgcttcatcttcttcagcaactgggggggttatttatatagagcaagggtgagtacgggagtactcagcaagccatggggattaagtgtttaaatgcaggcttcaaggaatggctattgttttttcaattgattttatttaaactcttttctgaaacaactaagtgagtgcttctcaaacaacacggatgagacagtgcgtctcgtccggtcggagtatgtgcaaggtatcagtcttttgaattgatcaaggttggcattcggccaacagctttcaaacggccacccgggcctggctgatcccatcagccgcagattttccaaacatcgaacccaaaccacatcagcaaattttacaaagcagtagtcaaacaaaactacgctaggaatcacctcacatccgcccatgaccgtgggcatggctattcgaacagtttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccctgacaccaccccgttgaatccacatgtctcttggcatcatggttcccccgattagctagttactcagccaggggtgtcccattccacccatgtggtcgcacttgtcttatgttcggatgaaattccaaggaaacggtccttaagtgcaagagcgggagactgtacacccggtacgttccccggtccgcgattttggaaattcatttagttcgcaagcaccgacccaggtgtcgggttttccaagtcttttgtaaaacccgagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccacctgtctgccttgcagacggggcaaacagattaagtgcaatcctatcaatgcataatattttgcaagcaatataattaagttcaaatataggctcaatatgttcaaaggtggcttgccttgctcgagatcttgagcttgatcctcgaaatcctcgcactgcggatcttcgggctccgaaactacacgcgaaacgggacaactcagcaaacggcgaaaataaggccctattattgacctctaagcgtgtcattaggtagatctcaagatttgaggaattttggaagttgaacggagtcaaacggacttacggttaggaagatattgaatttctaagattattggatttttggtctaaaggaaaaaggatttatttaaatcctttttgaaaagaaaagaagagaaaagaaggagggaggggaattagacttccctcgggcggctagggcgcggcccgagagaaagggggcggctcggccgaacttaacgggccggtcggcctgagaaggcggcccaaggcatgcgcgcgggtggggaggagtgaggaagccggtgggccgggtccatcccgcgtggtcccgggtgggacccgcttgtcggcggcttggctcaccgtgagcgaggtgcacgcggggcgtgctagggtttggggaggggaggcgcggtgcatgcgcgcggttcgcggagaacgcggtgcgcgaggcccacgcacagcctcacggctcgcggtggccgcgcgcgcgggcagggccgaagggagcggcgtaccggggtcagcttgacccggtcgcg

SEQ ID NO: 30735 - DNA, 1277 bp, Oryza sativa
acaaacccggtggcggtggaggacgagggagctcgcccgagggttgtagtcctcgcctgcttcgcgcaccatcgtcatcgtcgtcgtcaccttctgtgttggggatgttcaccggagggaagaggggaccatcactgttgtcgtcgctcgctcgatggagacgcgaagacgaagagaaagacgtatgggataaggtagagagaggaagaagagaggtaggctgcacataggcctcgcgcacgacttcctccgtcagcatgtgtgcgctaggtgcccatgttgctataaaagttgcgaactgagctcaggcctcctttctcgcgcgtatgcacccgcagcgcacattttggcccatctagcccataatgctgccatctaaaggagaaaagacagtcaacaagaccactgctttttctctcatctccctgcctcttttcccattgaaatccgtcaaatccagatacggaaggggaaggggaaagaagatgaatatggaccaaggtaaaataaaggggcaatttggtactaaaaattttacaactgcatcaataggttaaatagtggcatatctcaaatacatgtaaaattgtaatgacatgtttaaaaatagctgaatagtaccatccgtttcataatgtaagactttctagcattgcccacattcatatagatgttaatgaatctagacatatatatgaatgtggactatgctagaaaatcttacattgtgaaacagatgaagtaatggtatattttacaacttacgatttttttttttgaggttcatccgcacattcttattactggggagattcagtacgatcacgaatcaccagagtacgtacaaaatacgggagggggtcaacccagaccacagactgatccgggtcccaactcacaccaatcttggctagattatgagcaacattattacaggatcgaggggcaaaggaaaccttcgaattagcaaaatgaagttgcagcagcatcttgatttcagcgaaaattgtagccccaacagcttggctatgggaggatgacgttactgctgagaccagaatagctgagtcagactcgatctccacctcagtcacaccttgcaccgagatggccaggagggcagataagcatgcccttgctttcgccgaaacaacatcatgaacgaattccagccgtccagctcctgccagtaatgcatgcccttcttcatcccgcagcacaaacccccaaccacccgtcttgcgatttgcttggtatgcagcatcacattgagttta

SEQ ID NO: 30736 - DNA, 2108 bp, Oryza sativa
  unsure (1)..(2108): unsure at all n locations
agcctcgctaattaagctacagtacatacgatacgatgtgtttgttgactactagtatggcgggaaaggagcggagccacgtgcacttgtgcctcaccgactacagggacggcacctacacctacacggtgcaccacatcgacgtcgcccccttctttctccgctccgacgaccccgacgtcccggacccgggagccatggaggaggctgttctgcccccacccgccacgcgcctcgccacgcgcccggagaccaacggcctcgagttgcaccacacttctnctgcgcccccccgcgacggaggcgacatgatcgtggccaccgacgaccagcgccgcaccctcatctacgacgtcgccgcccgcgccgtcggcccggggcacatgctggtcttcgacaagcgcgtnccggtctcccgcggcgtcggcgaccggctttacgttctcgacaccttcgaacgccgccggggcgccacctgcttngaggccctcgtgtacgacgccgtcgaggacccgctgcgcgccgactggtactggcgcccccttccgggccctccctacgccgacgacgcgatggggccccctcttcccggctcccgtgtcaccgccctcgcggtggtcggcgcaggcatctggaccacgaccgcgccgcggaagaacggcgtcgcctccgtccgcccntgctcccggctcgacccaaggcgcggcgtctggacgacgcccaagggcgccggcgccggccccggcacctactcgttcgacaccgagcggcaagcctgaaggagagagggcgactggaagctgccgttcgccggcaaggccgagctcgtcccgggctgcaacctgtggttcggcttctcccgcgccgacgggtcgtcgtcgctttgcgccgccgacctcgccgcggcgccgcacagggcgtgcggtgtgtggaagaacttccgcccgcccaaggagtggttcagctgcggccgccacctcgtcagcctcggctccggcaagctctgcgtcgtcaggttcttcgccaccgaccccctcgacaaatggaggcgtagggaccctgtcgccatcatcaccgccatggaggtgcggactatgcctgcttgcgacggcgacgacgacggcggaagaggaggagaacggcggatcaaggtggtgaagcacatgtctaggtgtatcaagctcccaaattacaataaaggcagaaattgggttctctaatactcgttaaatttcactctaaaatgcacaagtatgatttctttaattaatttatagatctaaaagatgtatgtatctacataaaattcaatgcaactccaacatttccttccaagtaaatggtattaataatctctcaaaagtgaaggataaagatgatgtactcatggcggcttctcaactctaattcccagtggtttgcttcatcctcctctcatccaaacggatagctgctgtttacaattggcttattaatccctgttcagtccccagatagttattcacttgtccaaagcctgtccattgtcttgattcctactactttcctaaccaatttgtgcaggcagaaagaaacttctcctgcaaagcagacaacttacaaattaggttgagttattccacctccaaacaaactacagcttgaagatgcagttgagactgtaaaaccagcccttgaaatttgattcaccgcatcggaaccagatcctctgacgtagcggacgtccgatggctctcgtccgtccatgcggcatcggacggagtcgaggcgagcatagtgaataggctcggcccatatggtataaaaatcgacccacgcgattcacaaccatcgacgccagtcgccacctccgagccacggccgccggcgctgctagaaagcaagtcgtcgccgtcggcgtcaccaccacagcctgcgcggctgcgcctccatgtcctccctcgaacgggagcctccgctgcgtccgccgtggaggtcgcggaccgtccgctttgacgaaaccatgactcttggaggtcaacctgtcatggaagatgcagcaagagggaagcaacttgtccaaagcaacaatgcattgttgtgagatttattgttaagagcatcataag

SEQ ID NO: 30737 - DNA, 13693 bp, Oryza sativa
  unsure (1)..(13693): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgtgacaaatgttgcatgctagcatacacaagtcatgcctagtgatgagagagcaaagagtgtggtggaatgggacaacaagtgcagcacgagagtcgcatcaatgtaggtgaagcgacgcatgtgagtaaggctgagatgggcgctaacaccatgttcgcaacttctcgtctcaacagcaacaataaggtaggccctgagttggcctacttatctggtgtcgccagtagtgccagcgactcgagcactgccgccccatctccgtgttacctttgccacaaggtagtctgtgagggagagagagagaggaggaagaaatacgttatgtgaaacatgtatcttttatttttctaactggactaaaaaactgcccgtgcgttacaaagggaagaaaagacaagaaaattgagaagaagttgagaaagatttacattatttaattaactaaaatacaatttttctggaatactggggtatttctaactaggtaggtaaagtaagcgtgacaaataaaattgcatgctgatttaacttttgttaaattatccatgattaatgctatgttcttatgtgagtgttgggaaccctcacctccgacacgaaaaacggagaaatagattaatacgtgattaattaattattagcttaaaaaactttaaaaatgaattaatatgatttttaaattaacttttatatagattttttttgcaaaacacgtatcgtctagcagtttgaaaaagtgtgcgcgcggtaaacgagagagtgaggttggaaacatagacttaagaacacagcctaattacactctctgaatttttcttggaatttttagaggccaattgctaattctaataatacaaacaccatgttagtatttatttaaataaaaatctaaataaaaaccctcttttctatatgggccatttatagctcattttcctcctcaacccgcacaagagccagcccaccttcctcccttattctctcctccacctcagcccgtgagcacatgttcggcccagcaagcaaccgaatgtctaattggtctcccctgttctctctcacactgtcacgtggacccatcgcgacagtatcatccctaacctccgtccggactccctcgggtgcctgacgccgcctgaaactgcctcctctgtaaaatccagccgtacccttggagataatccaaacttaattgagaggtttctatcctcatctcctactctttccgttttctcaagaatcagagcaaatccgcttcgtatcgagctcgaaattgagttctatcctaaacaagcgaacctacagtttagtcatccgtttcgtttggaagaaaataatgtagtggatgatgacaacgatggacgaaaaatcgttccggaagccttacttatttttaattaggtataaatagattatcgtatcggataatatcactgtgtagagaaaaaaagataaattgaactggttttgacatgtaaggatacggcgtgtctagtttaggcaaaaaaaatgggactcctgattttgtgggtgaggaaggaaattcagacttggagtcatcactagctggagtcagcacaaggaggtaatatagcctttattctttgctccggagcctgccgcgttgcatgtgtttgggctagcaggccgctatgtgtttgggtcggtaaagagggaggcctacctgagtcaagagggccctagaagtggccggactccgaacagaatcgcggaatcattgccagtccgtgttgtgaacgatttcggactacgactccgtgtcgtaaccaaccaaggccctataaagccacgtcccccgaggcccatcgacgctatcgtgttcgcctcaatcgaaacgcgcaatcgccttcgaggcttcgatcgatcgttttgttgctcggcgcccccgagacgtacgtcttcctcccgagagcaagagagacgatcgttctacgcgccaatatcatcaagatgtcgtcggagcagcaggcgagcgccggccaaccggtcctctgtgccagtggctgcggcttctacgggaaccccgccaccctcgacatgtgctccgtctgctaccgccagcactgcctcctcaacggcgccacgatggcgacggggccttcctcttccgtggccgccgcgagcgccgctaccgtcgcgaccggcgcagttacgtctgattcctgctccgtgccttccgctgaggttaatggcgccgcattctcctccaagaacaaccctgagccggcgacggtagtagagaagaaggcgccggcgaaccggtgcgcgtcgtgcaagaagaaggtgggactgttggggttcgcatgccgatgcggggctacctactgcgggacgcaccgatacccggagaagcacgcctgcggcttcgacttcaagggcgccagccgcgacgccatagcccgcgccaacccgctcatcaagggcgagaagctgaccaacaagatctgatcgccgtctggtgcaaactagccatagatgcattttaaattgttaattcagcttcagtaggctcacaagtcaccactcccatgataacggtgtcgttgatccgtgtaatgaatcgccgtaccttgtcttatgcaattacatcagttaatttgtatctcttctctgacgatccatggtgtatcggtgtttgcttaggccatggtcgtacgttgatcgaggtcgcgaaacccggtcgtttctggcgtgcgcggtgcacccgacgccggttaccccagacgtacgctgtcgtgagctcatatctgaacactagacgagcaccaagctagtcaggttgtcacggccagatacagtggccttgtaatctgtacttgccgtaagtgaacatgtcgcgcagccatgtggtcgacggagtcgaacagatctgagtagctgaacattgaccaactttatctttattctgctctgctgtaaaacgatcatactacattcatacttaccgcagcccatgcacaattgcaatggaatcgtagcaaacaatgtgacacgcgtagcgttctattatatctgtagtatgtgtagttagaatcttttcgcttcaacttgcttcttgaatggttggcagctcaacaccccctccccacacctttatccgctcctctgctagcatggcctgccgtccaaaaacatttgaaaaaaaaattgaaactaagccgagacgatcagcttcgactagtcctttgatgaagcgagctcactgtacctctttctgccatttggttctgtagaggatgacaagcagaataacagtctgcaggattgttccgatcagcatccccacccaaatcccctgcattggttagtacacaacggttaccacatctccctgcaagaaaatcatcactgaaaaataaaagtttagaccgccggctttgtctgtcttactgttgcattaaggctcagcctgaagccaaaaacggctgcaataggcagaccaacgagatagtagcagccaatgtttacgaaggcaaccgatgactgccaccctgccccaatcgccacccctgcaatttgtgccatttaccaatggcacaacatagttgcatcaacaagtgtcaaatcctgaagcaatttgagcatatatttcacttgattatagaatggttctgtacctgatagcaccggctggatgctgttgaggaatatggtggctgcaagaagatagcccagttttgcagtctccctgacgagcacgtcgtcgtccgtgaaaagcctcggcagctgcttcctcgccacgagagcgaccagagtgaaaactagcccgacggcggccgacgtgaccacggcgacgatgaccgagaatttggctgctttcgggtggttcgcgccgagttcgtttgccacgcgaacactgacagaaaaaatgtgacaggcaaagcatgtgtgtgagctcagaaaattaccagtgagttgagtggaagcaacgcataggataagtgcgttacctcactgcagcgttaaagccaactgcaaccatcagtgtccagagctgatagttcatgctgtttacgacagagtaagttgaatcgtttaaacttaatgttcaatcgttgccaggtataaaaatatcagaacattgctaattgatgtactaaccatattgaaatcgcaccaacttgaatctctgggttcttcaggcaacccaccagaatcagcactgctgtgtaataccacatctccaagctgcaggcaccaattcatccatgaaaaaaatattttgctaattttcaccgtgaaatggaacttgaactgcatgtacaatgctacgaaccacagcataacggcggatgagagggagagcttgacgaagccgccgaggctggtgaatgctttccgcgagaagccgctccaggcctccgggaacgacccgccgacgaggtacgcgaactgcgccgcgttgagcagccaccaggacacgtcgccgacgagcgccgcgccgacgacgccgtggccgagcctggcgacgacgagccagttgagcagcgcgtgcgcggcgagcgcggcggcggagatggccgtcacggcccacacccggctctgcgcctggtagaacttctgcatggggaagttgacggcgtacgcgaacagctgcggcgcgcaccaccgcgcgtaccggccggccaccgacgagatggccgccgactgccggagcaggcgcagggccggggacgcgaggaggtagagcgggagcagcgcgagcgacgtggcgaggcaaatgacccacgaccgctgcaggtagacgcccagcatccgcggctgcccggcccccaccggctgcccgcacagagtctccagcgcgctccccatgccaagctgatcaaaacgagcgcgacaggcgccatgaacaaaatgcctagcgatgatcgatcacatcaatactgaccgtcctggcgtgattttttaccaggaggccgaaggcgaggccctcgacgacgccgttgacgacggagacggcggcgagctcgaccttgccgatgtggccgacgaaggccgcggtgacgaacccgatgaggaactggaagatctccgtcagaatcaccggcccggcgatgcgccacaggttcccggactcgccccgccagttcttgcggtggccagcgccagccgcttccgtccccgccggcggcgccatttcgctcctcagccccgtgcgcgcgccaccctcagtacggttgtgtgtgtgtgtgtgtgcacacgacgacgcggtacacatatagagcagagacaagccacgcacagtgtaacgtagagcagacaagccaccggtcgtggtcgtacgacatctttgtagctgcgtgcgtgcactgtggatgcggttgcacggcggatcgatcagcatgctagctgaggtgtggggggggggagagcgtttagggtcgcgcaacgtggacgatggagtaggtggccgtggacttacagggcggatccagaaaatctgtttgttagtatcataacgtgtatatcgatatcatagtatgctaattatacttagaacataatgttatagtatatggataaccagttttattttaggttttaccgaaagtcgtcggtgtcgcctgacaccgatgtttatactgtagatccacccctgacttccagtggatagagctcctcctgagttccgacataagcccgtctaatccatttccccgtgcaacgctgttgcggccagccgatgtacaaccgtgccggtgtggcatactacgacactctgcagaggcgtatttagttagctcagtagctctagcttgcacacgtgctggtgacctggtgtgcctccgagaagtttatcaacccccagaaatcttctcctgaatgctgaatctgagttgactaggcagctaggccgcctgacgaacaacttatgggtctttaatatccacggtgtcctcgttgtcctgtcattttctagtttctctttatttgggatacggtgcttcacgtacagctctcaccgggtgttcgtctcgtttggcgctagacggctgaccagcgctactcagcgcgttaggcgtaccaggcattcttctatggccagcattcctttacttgtgctgatcttctctagcacgcaaagaatcctgccaaatgcaagttcttcctttgatttgcattccaacagtgctcctggacggctgatctcctccagaaacgtggcatcgatagtcactcggccttccccttttgcgcccaggatctcgagacggcgaaccacatcctcctcgaccacgtgttcgctcggcaaatctggctttgagtgttgtcgcctcctagctgggctgccctctctcccccgtggcagctggttccaggactggtggccgtcctccagggcctgcttacctgagcacctccgtgacagcttcgactccttggtgctcctggtctcttggcaactgtatgagcgaaactctagggttttcgactccgttctctcctcagtttttgtggttctggagtccatccattcggaatgccatatgtggtctttaactggcgtcgccgtttttgaggatttgttaggagtgtagcgtggcttggctccttcccgctgcttgaagtctgtttttagccaccgtagtttctctaagcttcagtttatttttcatttgctttttctcccttcccctaacataagccggtctggctgattgtgttgtgtaactaaaattctttttcttctaatatgacgtgatttttttgcgcgtatgtgaaaaaagagtaggcagctaggcctccgtggatatctggggcaatgcaaataaagtccgcttacactagcaaaggttctgaagatgatccaggtaatctggacactggagaagaaaggccgaattgtcgagggctgttcaaatccccaccggcgtaaaaacagatcccatttcgatatgcacagttgagaacaaaaaactgaagatattgggacgtggattttcatctctcaatgggacatcctctcatagtttgcatatcatctaaatagttataaaaaaattgaaaaaaatgacaacatagattaatacagaatatattactccacaagcatgcaagaccaaattcaacttctataaattgcaacaaaaataacaaattaaattgaaaatagttatttgtaactatatttgttatttttgttacaacttgtagaagttgaatttaaacttgcatatttatgaagtgatatatttcataaatttgcataaattttacaacaggcatcctattccttgggttaatttgatttggacctcttattactctgataaattaccacatgctattcgcccaagaggttccttttggtggaaggatgtgttgcaatttctagatattttcataagtctgtcaagttgtaaagtgggtgatgggaaaacttgtttgttctggagtgatttttggaatggtaaagtcaggtcagctgtttaccctagaattcactcttttgccctctctcacaaggactctgtaagcataacttctactaaaagcatagcacagctttttgctctgcctttatctgaacaagctttccaggaatatgaatccatgagtgaagcagaccccttaacttattatctggtgataaagatgtttgggcttatgtctgggggaatggactgttctcttcacagaaaatttatgcaataaatttcatgcatgttcaagcccctgggtacttaagttggatttggaaaagcaaatgttctatgaaagttaaggtgtttgcttggcttctcctaattgacagattaaacacttatgatatgctgcagagaaggcactaccctcctgaaaattctaatctagcatgtgtcctttgtccagctcaagcaagggaaacatctttccaccttttctttcaatgtcaattcagctcagattgttgggcgcaactgggaattgtctggaacctttctctcaattttgatgatatgctgctgcaggcaaagatctcatatagatccactcattttgttgaaaaaattctctatgctgcatggaacatttggaagcaacgaaatgctttcatttttcagaatgtaccaccttcggttgtttcctggaaagctctctttaagattgatctttcccttttagtctttagattaaaagtttttgagagacaagccttatctcagtggataaaccttttgtaaatattttgtattccttcttttaatttaatttattaactgtggaggcttcccctacagtgtttcccttaaaaaagggtgatatatttcatattaatctatgttgccaaaattttttatattttttatgactatttaggtggcatgctcgacacgaggaatatcccctgagcggtgaaatcactttcccgagatattgccactgaactaactcataagtccagtcccagtatttatattgccacagcccacaggtaagtcacagtaactttccggcccaaaagaaacggaccatatgaacaggtttttttttttttgagagagaccatgaactagacttgagttcagcttgctgagtggctgattcaacgccagatctcactgcaacaatcaagcttagtaagattactactagtccattaatccgaattagttggataatcccgagaaaaagaaacacggttggataaacatcaaactcagagctgagaggcctatggattatggagctccatgtacaaattattttggtgatggctacatggatctactattcagtatgccaacagccgaccaaaatatctgaaagcatccttaggagtctcgagatatttactccctctctccaataaaaaaaatcaaagtatttggtgatgtctggattcatatctagaatttattttttttatgaaacagaataagtatgttccaacatcatctatagtactcatgtttcaaacaaattttccatcaaatgaaactgagtgtataaatgcaaaattgatattactgttggacctttgatatgcccgagaaaatagccaacttttagggatgaatctgaactcatccctagaagttgctcttttttttttacagagcgagtacaggctagcaaaaaaaagtacaggtcaaattgctactgttttatggaactacaaatgtctaaattatactgcacagattctgcactcaatggatcaccagctaaaaaacaaggtaaaaaaaagataatcttagttgatttttttttgcattattgaatagtactgcaagttcgttttctgatcggggaagaatattacaagttacatacatcgccattaaggtacataaagttttattaccatcttggtttatctcagatcaccaaatgcaaagcaaggtagatattatggttatttggtgactcggattaaacaaactatgctgaaacagtaagaagtaagtattcagatattacttcaagaaattacttcaagttcatatagtacttgtatgggataaaataaggccatgtgcacataaagagaacagaaagtagaaaatgtccggtacaatattttaaattcagaaacaaattccaagtgctgatttcagatacaaccaatgatgtattgatgtatatgcacaatcaagaatccatatatgacacaaataatgcaagatattatccttgcgacagccacaggacaaggttggaatgcaaatgcattatgaaaagataacaaggattcaaacttcacttaaaaactacaaacaagacttgcaactgcacaagtaatatatcgagaagcacgacaacattatcagctaccactcattatcacagaatcctactagtaactactgaagcatcatctttgtactatctctccacactgatcaacccgtgggagctactacctaatattgacacaataaaaccgtttcatacaggctcatcaccgaggattggccatagctaactgcacacatctaaaacacaatcaagctggcaatcacaagaacaccaaccagaacaagcaataccttcaagaacacatcaacatgctggccctgcggtgcctggtgcgggaaaccatggccatgccagccatggaacgaatgtccatacccgtaaggaaacccagcggcaggtccatacgccgccgcctgcgggaacccatgaacctggaagctcagcaatgggaaaagccccccaatggccgccgagaaagtgtagttcccccagcgaccgccggccacaggggcgccggcgccgcccatgaaccacgggtcgtggtgcggcaaatggtcgtggtgatgatcaggctgggaagccgtcgccggccgctgcccggccggccggctggggatctggacgccggccaccgacctggagcggggatcggtggaggccttgccgcggccgtagagggggacgagcttctcctcctcgaggccggccttgcagacggggcactcgcgggagtgcgcgtggacgtggagccactcgtagaggcacggccagcagaagaggtggccgcagagggtgacgacggggtcctgggctagctccaggcagatgttgcactcgaagctgcccgagtccttggcgccgccgccgccatcgacggcggtcgccgacgactcaccgacgcggttctccatgagtccgaggtccgatctacaaaacgcgggaacgtaccaaccaactcatgagctcaagccatgaatccacgaaccgatcgacagaataggcgctcgatcgatcgtccactagtatccccaaatttaggaaatctcttttctacgcacgcagcaaaatctaccatgccagacgatttaattaattaattctcggttgcgtgaaacaacatcactctctttttgtctcttctacaagcaatcccgaacaggtaggatcgattcgttcagaaaacactcacccgtagattgaggaacagccacgcaccgtgtaaacgacgcggatctggaccggtcgatcaacagcaagcgacgaccgcgatcgagcacagcacaagtcaccctgtcgaaacgagccactattcacccaaatccacgcggagtactccggagatagcgtcgaccaagcgcccgcgcgcggtgcactcgccggccggcgcgcggcgagccggggagcagacgctggcagctaccggcggcgaatcggaggaggaagggttggggatcgtgggggaactcgagtggtggtggtggtggtggacgcctcggtcttcgagtggagcgagccttcgagtgaaacacacaaacgcgtggcgtggcgtggcgtggcgtggatgctgcgactgcgactgcgacggttgggaagcggacggctacgagcccgtctccgttcttcctactgcggggacgaaacagacggtcggacgggcgtggtcgtcccgtcccgcgtgggagcccctcggcccctcggggcaatggcaagtggcttgataagttgatagctgccgtccgatgtcccgaagcttcggccaaagagcattgatgagatacgtgccattgcagaaaagggaagacgactatggccgtgttagttccttttcaatttttttaattatacggttacatatttaaattattaaacgtggactaataacaaaacaaattataaattccacccgtaaactgcgagacgaatctattaagactaattaatccgttattagtaaatgtttactgtatcaccacattgtcaaatcatggtgtaattaagctcaaaagattcgtctcgcaatttacatgcaaactgtacaatttcatattcgtttccactacaagaagtggattaaattttggattttcgtggcacgtttttcaaacggctaaacggtgtgtttcgtgtaaaaactttttatatgaaagttgttctaaaatatcagattaatccatttttcaagtttataacaattaaaacttaattaatcacacgttattaccacctcgttttgcatgaaacacttaatcttcatcttcatcttcaggagattcaaacaccaccttaatgctccatgcatatgtgtagacatttgatgtgatggaatttttggaagtttgaatggaactaaacacaacctatttacgagaagagtttagaaagtatatgttcctttcgatttcataattctgaatagccaacactgtccctactcctaaatttctacttcgggctcagtttagttattgagatttcaaaaacaagttctccaaattaatcatttgggttaacatagtccttagacccacaaaatatgccttattagcatgccaagtcattctcgaatgcaactatataaatgaaatgaccattctacccttataaaccatatagaaagaaagaaaagaaaaaaatagaggaaaaaagaaaacaaccaaaatgaacaagcaacctgttagttcaagtcagtctccacacatgctcttacgtattaccaggaataccattacaataatctgtaagaatcatttttactttcaaaaagaacatgccaatcgaaataaaggaggatcaaagttgttgattccgtccgtcatcggtccctgcccgacttgagataaaattggatgacaaatcaaactcgtatttgaaggcctcattatttggcttatgcttattcttataagctaaatttaaactttagaacttaattttggattcgattttttggttttttattgtactttattttaccataatagtttttgagtcactaagaacatatatataaaatatttgcacacatatattattttatttagtaataaatgattcggataagcacatgaataaaacgaaacaatgggttgtgattatttatccaccgacacatatgtacaaattaaattggctttaccgttgcaacgcgcggatatcttttctagttatattagaaaatcaaggttaaatatatattttgtagactgtgtcattgtccaaaacatcaacaattatatatggaaccgggcggagtattgtaacgccccgattttcgttcgggtttaaaaattattaaataatgcattttctagaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcataaagttcattaaactaatttaaataaaaagaaaacaaaataaacttccccttcctccctttcgggctcggcccaaaatcctcttttcttcccctcccgcggcccggcttgcctccccttttggcgcaagtctgcttttcctccctcccgggcttccctctcactcaggccgacaggtgggacccgtgggccccacctgtcattcccaaccttcagcccgggccggcaactgccatgg

SEQ ID NO: 30738 - DNA, 11566 bp, Oryza sativa
cccacttctcccctccaaaaccggcgccaaactgcccccatcacccacgtcgcaggcgcccctttcccccttcaaatccgtcgccaaccggcctccccgtcgactctcgaggctataaaaacgatccccgggctcccctcctccgtttccccctctttcccaagcttccccatgccagaaaccactccgccaccaccaacctccctccgccgccgccggttgccatctccggccggccacctccgccgccgtagccgtccccgcgccacgccgcttgcgccaccggcctcgcgacgcattgtcgcacaccgtccgcaactccgtttccccaaaccacaatcaaaacaccgattccattgctcacccgagcaccgccgccgtttcgccgccttcggcagcctcttgccgccggtcccgtgcacctcaagccgcgccgccaccaccactagcttcgctgctccgccggcaagcccggtcaccacgccgctcctccattccacccccgagccgcccgctccacggtgaacccgagccacagccacttttgtgcctccagacgcacctctgccgtcgccctggccaccgccaagccgtgccgttttcttcaccggctcggccgcttcaagccacagatcggtcgccgctccaaaccaccgaaaacccaccggtgctccattccttttgatccccggtgagcccgccgccgcctaatccgtgccggcggccacctcctcggtttcgtgtcgccgccccattcgctcggagagaacagtcttcctctccactctctaggcgtctgtcgcgccgtcgccgtccgacggcggagtcgtcttcggaggtctatgctcggcggtcgccgacgcctgtgggcgagccgtgccggtcgtgccgctcggccgcccccggccgtgcgatcgggcccggacgatccggagcgtcgggtgcgcgcccacgtggccggctgacgccgtggactcggtccacggtgggctttgccgctgacgtgtggggcccgcccctttgtgacgcggtccgcgcctcaccccttgctgacgtcagcataacctttttcctttgaaaaattaaataataattgcgcaataaatcggtaataattgtagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagaatccgtcatttcggaagtccgcggtcgcgaggaaaagagttcggaagattgtttgaagaagcaaggcaagtcacacattccccttgagcatgttgatcccaatttataaatgttttaccgtttgcaaataaacatgcatgtcttgctaattacatgggatccgggtattacctatttgctttcttgtgccatgtttacttgctatctgtcctttgtcagcattgggtaataaatcgactagctcatgttacttatgtgacctagctagaactgtatgcttagccatgcttaattaccactagctcagttgatgggataattgcagtattagacctcctagtatcatgacatgacgagctgcgtgctcgagacatccgaccatgtgtcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcatgttcaacgtggtgtagcgttgatcagtgcagattcaatattactttaattactcaactgttttactgttttgctcaataaaatgttttacaaccgcctttatgcaaatagccacaaaccgtccttgtgttccccttgcacgtctgcatcgttggtgtggcttgttgagtacggtggttgtactcagccttgctattattcccccttttcagaagtgtagtgcttctgagctgaagacgaagttagaagaccaaggctcagaccccagttgagttttgtctgtggagtggagctgaagccccgctaggatcgccttttccgctgctgctgcttttgtttcggtgtgaagactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaagtatgattttgtaaatctacatgattaaggacccgttttaacatgccgaaagcaaattaagtgcgggtacataaaacaaaagttattagcatatagggagtgaatcttaaactttcgagggacgtccgtcattgattgcaatgtcacttaaatagttatgaaaaaaaataagaagatgtattaacgtgtgatatatcactctataaacatgcaacttaaaattcaacttgtacatgtcgcaaaaaaattgattgtgaatatacgttaactagctataatttaatttgtttttttgttgtgatatgtagaagttgaatgtttgtgaagtgatatatcacatataatacatcttctcaattttttttataaactatttgagtgtatgcaaacaacgaggggtcatcccctcgtatgaataattgagtcttagttatttcaaacttgaaaaatgaatttatatgatactttaaagccacttctatatataaagttttgttatgaaatacattctttagcagtttgcaaaaatcgtaatcatgtttaaacaggtgtaagtgttgtaatatggagtttagaggttgtccagatttattgtcttagattatctaattcttttttagattggtttattttgagtcgagacgagttgttgctagcttaactgtgaagaccgagatttaggccctgttgggagcttgtgccagcccaaaagctgcttctgctagaagctgccccaaacagtccacaacttctgagaatctatagttacatatactaaaaaatgaactaagaaaacagaagctggagaagctgggtttcagagctttttcagatcctatttcttagaatgtaaagctcaccgaacagacccttaatggaaatgttcggttgatcttccaagcgggaagtccagcactcatttttctgcttcgttcacgcgacggtacgacgccatttgacaattagaaggtgtagtacattgtctttgccttctctacatatgaccagacaaaatgaaaagaaacatactttctagattggcaaatattcatgtagtatatgtcacgtaattaatctcagactagtctagtacggtacaacgacagcaagacaaacggcggccaatggctcagaggcgcatgtcgccgacagtgacgccaattgattcattgcttcgggtgaggcatcagcgagcgtacatcgatcgatagtgaacttagtgatgactaaacgctacaaatcgctgcacatatatatcaatcatggacaaatgcagattaattgtcacggacaatgacgagcacttgaaaaaaacggctcatatattgtaccatgtcagctgaaaaatattcaaaataaccgtgggcggtacgcagcggcgagaaatgtctaccatgcgcgaagaaaaatggagcagataagatagctacgtgctgttcattttacggaagcaaaatagtttacctttggttgagtgattcatatcctgcatactatattcaaaattaaataaccgtttgtccgttttcaccatcaaaatcgtttgttccatatccgtcgcttccagaattatggttgcatagtgttagtgtatggctgtgtttggatacaaacttcagttcttttccatcacatcaacatgtcatacatacacaatttttcagtcatatcatctctaatttcaaccaaaatccaaactttacactgaactaaagatagcctattattagtagtcagtagagtacaaaacttcacgtcaattttttgcttttttttaaaaaaacaagtcatctccaagtcgtcacgtcatcaccgtaatgatcggctaaggtggtgtttggatctagggacttaactttagtccatatatttagatactaatttagagtattaaatatagactacttacaaaactaattatacaaatgaaagctaattcacgagacaatttttttaagcctaattaatccatgattagagaatgtttactgtagcatcacataggctaatcatggattaattagactcaatagattcgtctcacgaattagtctaagattatagatggtttttattaatagtctaagtttaatatttataattagtgtccaaacatccgatgtgatagatacttaaaattagtcccatctaaacagagtctaaagctagcatttcgcggaacgcgtcgtctaaggaaatctatgacagccaattgaattcctcgtagtacatgtccaagctcatcttatgctcatgcatcacagacaagtgataaattggcattttactattcgtactttgaccgataatgacatacagtagtaaaattgagcagcaaaggttagtgtccttgtaacactctgcacctggtttagtgatatgtcttccagataacaccaggaatatgagttaagataacaaaaactctgccctagtcaggaatatgatgatgtggatattgaccgtaaggcagggtccataccgaacatgcataattcttcaaaaattcacgggaatttcaatcggtttgttgcttacagtatcacatattgcagaatttgaattaagattactgaattgttagtacaagagcatgcatgacgccattcccctggactcctagttccattagtacaaggactgggcttacgagatacagtaagaaactacaaggacggcgctcacgacaagcacttgaattagtagaatccaagagcatgacaccgtttcccttgtaccgttaataccgctgcttcaacttgcttccttttttcttcccttctaaagtcagcgagtacttttccggttgcaatgaacatgaacttgtacatcacaattcacagcctccaagcagcttccagctaagcaagcagctacagtaaacttaagtcgaaggtgctagtgtctagtaggctacttgctggccgactgttatgcggataataaatcgtacgatgtatcagtataaaagggtgaaaagggatataatctattggttatggtgacctgagtaacatcctaatgttttgagtttaaatcttcatatgagtgaattttagattgatatatcccaaagtctttagttcaaatctccttagcagtaaatttcagactgagttgtttgcgggactaacgccgcatttgtttctctagcttgggaactcattccctccgaaaaaaaacggagcagtccattagcgcataattaattaaatatgagttttttttttcaaaaatgggtcaatatgatttttaagcaactttcatatataatttttttttgcaaaaaaacaccatttagcagtttgaaaagcgtatgcgcggaacacgagggaaatggttgggaacaaagagcaacgaacatagcctaagttaccaatttgaatgacctcgtatatctgattggatgcggatgccagacaaaaatccccttctctaaaataaataaataaatttgtataaaaagtatttatggatacattttatatacatatgttattagtgtcagtgtcagggttatgataccatatacctaatagtaattgactaaatctcggcaggacccaccacataccatgtcctatacggaaacaacctgcggatataggagaagttcttgataaggaaagacaacctgagttctacatgaaaacaacaaggattactcgaattgtatccatattggtttccttagttctacttggacaaagggacacctatgggtataaatacaaggccccataggaggagaggggacgatcaacacccgagacaatcaacacccaccacaatctacggaacaatagatcaagacagaagccacaacatacaagccaacacacgctaagacaagacgccagatatcgacttcagagataggcacggctagtcccctacggtgtttctaggtactgtcaggagagacgaaagcgctatctctgatctcgccgggcacgaacttaaggaggaaggctaccctgttgtcgactacgagtcagaccttcagactaccatgtcgacaacagttagatacgctaccccaaatattgtactagtgtgattatggtgaataagagtaatactggcttcaaccaacaggatgtaaggttattacctgacaattcaggggcccgaacctgtataaaaatcctcgtctccgtctcttttacctcagtctcacgtatatcctagtaccaacgatccccataccatgcaaataccgaaatcgtgacatcaaacgtcgacaattagtgattagaagataatgctgaaaactaataagagggcttagagaatgcacaaaatggatgaatcaaccagcaatggggtgtaccgtgtaccgtcagaaaccgtggttgccgccttgccggccgccatatcgccttgcatccgcttgccacttgccaattcgcatgggtgtgtggccgtctgtgtgtgaggcgtccaaacggttgtttcttggctccctgcctgagcatgtttaaatgatggtcatgatctgacctgacacgtgggctaatccacgtcatccacgtgcgtggaagatcaaactaaaaattgacactccctccctccctaaacaatattacaatcactttcaaactttgacatggtttctaatatgccattttcaccaaattatttccaataaaaagagtctcatattatattacatattataatagtttgtttaaagataagactattaacaccattttcacgatatcaatatttatgatcttttattgatcgttaaagttaaaaagtgtttatatttgtttaacggagagagtagaatattcagtatattggttaccagatggaacttcacttgttgccacggaaatataggttcatagaagagagaatttagaacatagattgatcatttaaaaaacctaaaaattagttgttgtggcatcatgggaaaagagaaatagtaaagataatgtagaacataaattaattctcggagtgctagaaacaattaatataatataacttaaggagagaagagagatgacaatgatttgtaaagaagaaatcactaaaccttacgcatagtgttaaaatgtcataaactaacgaaatgctttaacttaggaataataaaatgagtgaacaacactttaaaccaccatttattatccaaactctctttgcaagtacatcaatagtctcaagaagacggtacggtcggtaccctcatgcggatgttctcttttacttcatccccctaaaaaaaagccaatctagaagaagatgtgacccctcctaatacaatcctaattcgttgtggtaggaggggtcacatcctcttctagattagcttttttttttttacggaggaacccgtacatgaggaaaagttggatacttggattggatatactagccagacaaaagtgaaaaaaaaatgtataaaatgtgatctaaaataaactttgggtaataaaacgtggcaaaccatctcatgccgaaaactaaaaacagacactgttaaatctctcgagcatcatgctatcacaacggtgtataattttaagcattcgtcagtgatatatcacaggatagcgcatgtactgtgcttcaaagccgagttgcttcaagctaacttctagagagttttgacttcagttttatgagttccagtttacgctttgttcctttttttttccactgtacaaatacatatccatttacattcatcaccgttacatcaagatgaaaatagagagaaatttcagattctatggacgttcaaatgctgattatactccagccaaaaataataataaaaaaaagctgattatactctcgcaaaaaaaaaaactgattatacactggcagtagcagtacatgtattatacacttcgcttagcgcgcgaaggcctcggtccccaccttaatggcgccaaacccgccggcgcgcgccgctaggccgtctgccgaggcgccccgcctcaccggcggcgtggccttcagcgtggtgtccgcgacgaactcgcacggcgcgtcctcggcgatggtccccatcgccgcgcccttcttcctcggcgccgggacggcggccccgcctcctcgaagggccccttcttccccgccggcgcctcgcgataatacccaaccttcttggctgcccccaccgcacggttcggccgcgacgcgccgctgcctcgacgcggcgcggacgaggtcgtcgacgtcgggggagctcagcccccgcaggcgcatcgtcgccgtcgcggtcgccggcctgccgaacccggggcggaccgggacggcctcaatcgccgccggcacgcggcccgcgcacccggacatgccgcgcacgtagaggtcgcaggccgagtcgcacgcccgcgacagcgcccggaacggcgcccccaggcacccgccgccgccgctcccgcccttctttttcatctctctccgctccggccgctccgcgcgcgctgcgtcgaattggcttctcgcgctggcacgaggaagagtggctcgctgtcctactactactagtagtactagctttgattgctttggtcggcttcgggatttcgtctacggggctcgaggcttcccgttttatagagcaatgtcaacgggtggcggtgacgtcggcgaggagacgaaggcggcatctcgttccatcgcgtctccacctggttgcaaagtcttgaattggcaatctgctccgctcatcggtggggccgatcgaggcggttttcaggcgcgggtttaactcatggaaatggtcaggtttcgcgtgtatttttgctcgatttcgtccacggttttgggataggatcgattgatcgagatggcaaggttgagcagagctgtgtcgggagaatttaggatattcctcggtaaattcaataaattttagttgaatttgactgtttcaaacttaaattcctgagagagaaatcccctaatcttaaagtattgagaacaattcggaaattttacttggagtctactttcatcccataatggaaccttaaaattttatggttttcgattggttttcgtcgaaaacgtaaagatcggtgagcggtgaggtgcaccttgtctgagtcagttcaagttaacagtgtgtgtggaaatgtgattaagttattacgttcagctaagccgtcgcagttgcttgtttcagcgctgcaactgcaaagtggaaagggtaaaaaggagtcatcaaatctgttggaagaaatgcgatgttattagttctttatgatgctatatgctaatctttcttgcccgtgagagaagttaccgtaagctggctgttgatgttggaattgcgaagacctaaggcgaaaaatggcagaaaaacacaccgccgtcacatcatgttaaaagcgaagaaatgttgagcgcgttaaggaatggactaggagcaagtgatgaagtgaaacactgatgagaagctttgctttaccaggacattttcatttttgtgcgtttctgtaaagccatttcgtttcgatgacacagagaatttttcattttgagacttgaagaagagtacctgtcctcgagaatccagagcttgacatttcgcaccaagacaatcactcaaaatgcgcgtgttaaattttcccagagataagagactgttcagttctcagaaagaaataaaacgtctgaactcttgtccaaagccaaaccgtctgctcaatcttttttttccgggctggcgaaaagatgccaaccgatttttattaagcaaagcactccatcttaaaatataacaactgatagctttcataatttatttaaaatataacaacttcttcacaaatattcttttctcaaccaatcataatccttcaccattcaaaattttccatttaccttcccttctccgccaatcaacattctcattaactatatataaatctaaaacttcttatattctgatacagatgtaatacattaccagagatacaatgaggaagaccatatataatgcattaaaggggttcaatgagacaaatcctccactcagcctgcccaacgacacccactctagctgcaacgatgttcctatcatcgcgcccttccttttcgcggtgcgtcttaagacggtcaccttgcaataaataaccttcttggttgttcctatagtaagcttcggttcggtcttgatttagcacagcggacgaggctgttgtcatcgagaggaggtgagggaacaagtttcataatatagtcaaatgccagctttaaaaaattgacgcatcatttacatccactctaatagtctacccatataattattttattaaatatatatcgcacaattaatacttaacccacctctcatacaaacgtaatatatttgaattccgtactgctcgtttttgttctatcttcttttctcactccacatgtatttatttctcactcctccatatgtatttataggtgtacttggtcttaagagagagtacagaataagaagctagtgcgcaggccaaggaggaggtagacaaggctagtggatgattgattcgtgcgattagatcaaactcattccttcttagggtgtgtttaggtcatactaaaattgtaattaaatttgattaaaattgaaacgatgtgataaaaaagttggaagtttatgtgtgtaagaaagttttgttgtgatggaaaagttggaagtttgaagaattattttggaactaaacacggccataatcccgggagtcttcggcttttacatttttattctttggattcctacatgggttcatgatcatctcgtttttccttttcagcagaccaaaacagtcagtttacacgg

SEQ ID NO: 30739 - DNA, 2682 bp, Oryza sativa
taaaaaatcatattaatctatttttaaaatttaaaatagttaatactcaattaattatgagttaatggcttatctcgttttatatatcttttcaattttctcaatccccttcttctcaaacacaatcttagtggagcttatacggagaagttgcaactgaagctcccataaacatttcggcatgctatttctgctgcgctgctaaccccgttcggtggtgggccccttctgtcagtcaccttccaattccccttgggcacttccccagtggcagttaccctattcattttttttcctcttcccggtcacaactccaattttgaactccaccgccgccatcgaggtcgtccgcggtccgcaccgagctccgtggattcctccgccgtcgccgagcctatctgagcgcgcgatggccacggatccgagaggtcggcggccgcggcaccacgcggcggtgaacgaagtgctctcgacgctcgccgccgccaacagcaccctcgccgacgtgcagcgccgcctcgacgccgacttccgcgccgcctacccggatcacgtcagtaagctagcccctcctccttgctggattctcccccacccccccgcgcggcgaggctgatgcgtttcgcggtctccccgcgtgctgcgtttttttttttcaggcgaatccggtgaagctggtggcgcggctgaagcggatccaggaagaggtagcggcggtcaagggactctgccgcgatctgctcacccagaagcaggttacccaaaacttcgaatcgaccaccaaatgcgcgggctccgcccttcttttttttttttccgcgactgacgcctatagtgttcgttgcgtgcacaggagttgatcgacgcaatgcggacaagcctcgcggtgcagcgcagcgccgtgcagcggctgctcgcctcctccgggctgccccccatgtccgaagaggacgccgccaccgacgccaatctcaaccaggtgaattcacccccaccgtcccctcctccagtcattcgtcaagacaaatctaacataattttaccaacctgtgtgcgcgcttgcagatcatcgatgagtggacggcgcatgttgggccagacacaggtcatcttctaccttgctctgctgttcgttgcagcgattgttactgattcgtgattggaaactgaccgcaaccgttagttgcaaatgctttgttactgattcgtgactggaatttgactgtaacgggtcccttttacaggagatgacaaggatgaggataccaaccaaatcttcttcgccgctgtcgtttagagcgagtgagagcggccacaacctagagcagaattctatgcaaagtcaggaggtctcatgctctgctgctcatgtcattgttttgtgtgttttggcgagaagagctgcccgtgctgcagcatgcggtctcaatttgcagatccatttctacaatgaaggccagcgtactggagctggccgcgatggagattctacttcacacatctgttgctgttgtggagagaattgattagaaaatcgtagactttgattggattgcggtgtggttagcaggagagtataaaactgagagcctgttagctcctctctcgcttttctttttgtgtgtgttattttacttttctcatactcaacctttgtagaatatgctgttgaatagtacaaagtgagggaaaaattttgcttcgtataagcaggttgatgcagattgtgatatgcttttttccctcttttttgaggaacagttgatgatgagtttgtcaacaaggaattgtgttgttgagtgcacacgaaaactgaggatttcttggtttgggaaagttattctgtgcttgcaatctcctttcaattctggacaagaacacttgctctgagcaagagcccagcaaaaaaaatcgctgggaacttccctgaacaaaagatacatctcagatagtcatgtactggttttgaaaaattatactacaatttctctcttgccatcatatagagcacagatagacaataacctaagctactaatctgcgcactataaacaggtacctgaacacaaacatcaatatgaaaataaatacataacccgaaacatgtaatataaattaggggcaattacttatttgaccttgttttgaactgtaattgccgatttgaccctactttttgaactttgcttatttgacgctccttttcgagtacgaagcttccgtctgaccctctttcgctgactccgttaaggttcaattttaaaaaaaaaagaaaatgtttccagagttcctaatggcaaaaatacactccaaagccaaaccctattctgactctttctctctctctctcactcgcgcgtacctctctctcacttgtgcgtgcgtgcggcggcggtgagtacgcgtgcggcgggggctagctaagggggcggcgagctgagggggcggcggcggcgtcaagcacagccccgccggcgcccgctcgttgtggtggagggcggcggtagcggcgcgtccggtccgggtcggcgccgatctgtggggggagacggcggcgagctgaggcagcggcggcgacgtgatgtacagccacgccggcgcccgctcgtggaggtggaggccagcggcggcggcggtttgatggggcgcggagcggcgccgatctgagggggtgagggcggc

SEQ ID NO: 30740 - DNA, 6996 bp, Oryza sativa
cccgcctctccgccgccgcccacttgcctctccgcctcgttcgccaccgaccgcccccgctcaccgtcgaccgcaccgccgtgcgcaccgtccgccactgtcatgccgactgccgagagagtgaggtcgatggcgtcgatgctgtccaattttttttaacaaaatctatcataattgcttcgaatttgacaatttttagtaaaatctttcaaaatgaattaaatttctcaaatttatgccaaatctgtcataattggggcacattttatttaatttattttcacaaaattctgtcaaatttaagtcaaatttcacaaaatgattcgaatctgtcaaattaatgccaaatctgttacttgagcaaaaattattacaaatatttcaacattgttgaatatatacagtcaaacaagcaaacaaaagggatataacagggtcaaataagcaagggcaaaatggactatttacccctaaattaacaccgtcacctcacccaaacggaatagggtcagaccggagcttcgtactcgaaaaggagggtcaaataagcaaagttcaaaagtagggccaattcggcaattacagttcaaaacagggtcaaataagcaattgcccctataaattagcaaacgatagcacattcaaacattaagagaaattatgaatatgagtttcgttcaatctttgaatttgatatggacagaaaaacttgataattacccctcatctgttatctttgtgcaatggcacatgatatgtttgcgtcaaccttatgggatgtagaagagactaaatatcagactatctcctttcctgcatcatcagtgcctctctacaaaaggctgtcaacagagctctcaagctgaacaacacaaaattcagaggaaaatttcttacagaataagttcattaaaaattatctttgttaaaattaacccttgtaaaatcgactgagaatgtcccatcagaaagcaagacaaaagcccctttctcatacatcaagttacaacaaatctttctcgtttttgcttcatcataattcattcaaatagtacataaatgctatgagaactgagaaatatccatgcactcttttcatcaaaaatcgtaattcagttccctaatagggaaaataatgctttattagtacactaaaatcataatctactcccatttgttcaaagtttgttacattttgggacggagataatactttacttcattcaaataataacactagttcaattcccaagtataaatgggtaagacagataatactttgtgacacacacacacacacacacacacacacacacacacacacacacacacacacacacacacacacacacacacacacacacacacacacacacacacacacacacacacatatatatatatatatatatatatatatatatatatatatatatatatatatatatatatttgcacacaatttatatcaaaaatcaaatggccacaactgccctgcttctgacaaatacaataatactaggtttcttagcaattaaagaatactatttttctttagcgtttctataaaactaaaaaaaaatacaaacgtcgtgaagaaagtacaagtttcagaattgaattttcgtataatcagtattcagtaggctccagtacatcaatcagccccttgttaccaccaccatttacattagatatttagagacagtgtaagggagcgttgcagcatagaatgcagatcagtacaactgtagaaggcaaccactctgtctacgaatgagttgaaacgcatggagcagaaaaagggttggatcttggatgggaatgggatcaacaagaccaagctagtttacagctcgcagcatccagctgaggtacgatccttgtgtcctgataatacgactcctcgtgccatcccaggacctcctcgtcgtcgtcaatggcaagagggccggaacgacggggatgtacgcgactacgcggccgcagacgcgcccggtgtgcggccgtgcggcaagccggcaagtcggtggtgagagcaaggtgttgcatcggctgtgtggcggagagacagcggccggcgtcaagaagaggcaaatgcacctgtgaagcttctggcgcgggagagcagaggaggggcggcggcggtaggagagtaggagagactagagaggagactgcggcgaccggccggcccgtgctctgatggaccgttcgggctagatccaacggtagaaatcgctccagcctccagtcccaccacggatggtaacagttttgcataaagcccccttcttatctatgatcgcgctaccactggaacactggaagtggacctatttgttttcataaaaccccctattttgccctaagttgtgcataacccccccccccccacctgttttggaccgctacagtatttcgctaccaatgagtacagtacagaattgggctatttcaaaaagatccctggtagtgatattttatgcgatgtgtatccttcccgagcacgcacactcgccgccgcactccacttccccaacacgccgccgccgccgccgccgccgagctcgccgcgatgtcatggctcgcgcgctcaatcgcggctaccctctcttcttcccactctgatgaagatggcgataacctcgaggcgagcagcggcgacgaccatagggacgagcagccggacaccccgagcggcggcggcggcggagtcaagggcgacttgtcggagctgaccgactccctcacccgcggcctctggggcgtcgcttccttcctcgctccgccgcctgcgcccgccgccgaagccgcggagacggctacgggggcggtgggggagggggaggatggggctcggtcgccgcggatcgcccggatccggagcgacctggcggagatcgggggcagggtgaggagcggaatctcgttgctctcgaacgccaacgccgtggcggagatctccaagatcgcctcgtcgctcctgccgttcgggcccggagaggacgacgacgacgacgacgatgccgaggctgtgggcgtgaccgagaggtggtggagttcgtgaggcacatctcgacccatcccgagacgtggctcgacttccccttgtttgtcaccgaccggcacgcgtatggtaaaagccagtagtatgaaacttctcttcctggatctcttaagcgtttgtagtgctttggtttgcttgcatagaatgctggattggttattttggtctattatacattcatttaggagaccattggttccagttgcttcagtgcttaggcttcttgctctgttcgctctgatactaagattgtgggatcttctgtcataattttagcagcttggctccagtcatgtttatttactaaggtttaatgtgggaagggtagttacttacaattaagagtggcactcaattcttaagatcatgttattttgaaattgagttcatttgtttacatgtatgaaggtttgccaggaaattgtaattcatgttaatagaaacttttattacttcatgtggttgcatttgctgatgttagttagacagagtaggtacatgaactgaggtgggttaatcgtttgttttactctagtatcgctagggctgtagttcaaaatttcacatttggattgtattaattcaaagggataattagtaaatagaaagttcgtttgccaaaatgaaaaaaagagagtaggaatggcttgtaattaaggaaggtttaaaagtatcgaacacaaaccttaatgtcgcatttcagtaatcttgctttttgtaaaaatgtctaatgagacttagatcacttgacatgtaagaactgtatgaaaccatcatttctgctgatacatcagtattaactatgcatttatcagaggctgtatgctataatcgacttcaccggagacattgagaaacaataaattaaacgagggacaaactattacacaaacttgtaacacacatacaacactgcaatctgattaatcacctaaccaacaaggcaacatcagaataggggttttgtcacaaattaattcaactgtcgaatcatcactttaacctttagtgttactatttcggtcaaatagctccaagagttgaatgctccctacactttgtggaagtctagctatatccaaggattcaacgtcgctaatgatgtgattacatgtgcaaaatctaatgggatcaaagtatatttcatccaacaaatttattatacattagcttttttacatgggtttaatatatgaatttctaatgttctgttatttatagcatgatcactacttgcccctgtctctcagaaatgctgaccatggtttcctatttttatttgcttttataccttttggttctaacttgccatagtactaggtaacaactgtgttctggaaattggaatggctagaactcgttaacctgttacatatgcatatggccatcttcaatatgtagggaattactgttaaatggaggccatgcatgtatattgttccatcatgtcagtcatgccttacttgtcgtgcctgactggtttcctcaattcctttgcttactgcaatgcttcttgcgtacagattttgaactgtcagacacacaatatggacatgcattggctatagagcgtgttgttccaagcttgtcatatcttaggaccgagctttgctctaccaatatgagtgaagcatgcttttggaagatctattttgtgcttcttcactcaaaactcagcaagcaagatgctgaacttctttcaacgccacaggtatattccctgctcttcagcatattctgtctttatggcaaacattcttaagtaattacggattatcatgtcaacttgttacaatgcatgctttcctacacatagccccataaccttttttttttaacaaaccgtctatgcatatatattaccaaatggtatatcttgtttccaagttacaaactatgataagtcaggtgtgtaaggagaatgtaactatgtatgaacttaagaatgtaagttaccgaagcccaaaagttgcattagattgtggctgccagtgtgggagcataaacatagaggattacttttatgcttgtgtaagcgtacaatcaatatttgggctccacttctcattatagcatcaaaattgggcattcttcacttctcattgtagcatcaagaatttgttgcaagtttcaaccgacaaaacaaagctaaactacaggcatatatttagttaattatcatgttgaatatatccagtcttgtcaattcttttggtggaaacacttggcagtgctgaaaaatcatagccttccaaagggaaatatcagtgacgttgtagaactctaaaccagtatccagaacagcaggaggatatgcttgagaccttcgtatttgtgattttgaactgattttatattatatgttcggaattatgcatctaagcatgtagatctgcattcccaatttaattatgtatgctatcagcacatgtgaaggctgtgtaacgtttgattactaatcatatagtccatgtatgcatgcccctatagctcacgttgagaacatgtaacagatgtatagattgtcgatcatactgtatattttgttgttaagttactatcagtatatatgcagtagcaattttcttgtaattagtaccctatctcgcacccccccccccaaaaaaaaaaaaaatttcccaggatttgattttttttgtgggatacagggagtacattgtaacagaaaatccttattgcattgtttttactccactggaaggtccattgcgcatacacttttgctgcatttcaccttctttatcttttatttcattcagatcctaaaagcaagagaagtattattgcaaagttcaccgacaaagaaaaggctgggacctgatgatggttcatcacaaaactggaatgttgcatctaccaaaggtgacaacagtggaatgtctgaagcaccttcattggaagaagcaacttctgtaccgatgaatgtggttgaggctgacaagcatccgatttcagtcgctgaggtggaaataatagacaagtccgtggttgaagaagagctggtggtgaaaaatgagaccaagagtataccttctgactctgagaaggctaatctgcatatcacctcggacgatgatgataaagaggtggaggactggctgaaggatgtggctcctgtgtccagcaaaacaggcaacgtcaattcagcagggcaggaggaagacatatccttcagtgatctggaggatgaagaggatgattgagagacggctagcttaagcagcgcagccagtactagttccctcggttcaatgtcgcaaacacaagacaacggctagcttcatgaagaacatcaactgttactgaatgatcgaaactctgcagctacagcaaagggaaccgtgttgttgctgagtgacggattcatcctaattgcatgttgatgtaatgatgtatttatgttcgctctctttttgtacatagatatatacactatgtcacctgcgtgtgcactgtatatccacgatagcgtgcagcactcatacttactggattctgaatgcaagatatcctctcatttgctgtcaaatgtcttagaatatcttatgacgcatttaagctggcactacgcaaaactcgacacacttcccctcttactctagtgctatacgaaattcgaagctgatatacttatctacccggtattccctcgtctctaatgataacattcgtgatttatatgtcgtcgtcatcagcagtttccaatgtcgacatacatctgcatccccaaaacagtctctgtaccgctaactccagcagagcggaccataaaccgctcgacgcctcgacggagcggagcggaggcggactacaccacgccaacggttcacgtttttgcctctcgttgcctcgacatgcaatgcaaaggcgcgtcccgcgcgcctatcacccgccgaaacgcctaa

SEQ ID NO: 30741 - DNA, 18638 bp, Oryza sativa
cgacaagcgccatctctcctcgcctgattacaaaagcacacgcgctccgcgttcgcgttgcctctatcgcgcttccaccattcggccgcatcagtttctggtcaccacgctctcgctcgctagcttcgtcggagagaccgagagatcgatcatggaggcggaggcggagacgacggtggccgtgacgacgggcggcgagggggagatcgtgagggggaggaagctgctgagccacggcaaggtgttcgtgggaggggtgccgctggggacgagcgagtccgagctccgcgcccacttctcgcggttcggcacggtggccttcgtcggcgcgcccaagaacaagcagacgggcgccgcgcgcggcttcgcgttcgtgcagttcgtcaaccccgacgacgccgccgccgccatcgccggggggcccgaccgcaacgtcatccgcggcaccacggtatacacacgcacaccccaggccagatccggtcctgatcgatctcatgcatcaatcacacacgctatcttctcatctcttcgatctccgtcgggtgatctcactcgatctgtccttgatttacatgttctcgtcctcttgcatcatgcatgctttgcttccgcggcccgggtgcaagtgaaagagcgtgggatcatcgattttttgctttgctgcgacgaggttggcttcttgcgttgttgcatggtggacttagctcgtagcatcgtgttgctcggcggcgcggtgggttagtttctgttcagtactcgtcgtcgacctgtgaccagttgaccgcagtattagttaactcttaagtcttaactaagtgatggttagagcttgattagaaatggtatgcttttggtgatatgttaattctgtctatatgcgtccttggtatcataaatttacgtgtagctgcgaattacagctgacctgtgtttgaatcataatttagatgtaattattatagattagtggtaagagtatgattcgttctgctcatatacaattgattgtatttaaggcattgtaaagttatttttagctctgacgaaaactttagttcttactgttaatttctttctttgtgacttactttgctaatgtggttcgtcgtccacaggagtaaaaggtgtcccttattattagctaactgggattgtttgattttcacgtgttgtgcccaagtgttacgaatgaattacattatacttttatattaaactagcatagtggcccacagaaattgcgcagcgagcatccttatattttctcttatataatagcatatattttttcttattttattcttaaaatatattaaaataataacataattttaattttgtactaactttaccaaactaccaatgtataatatttatattgtattgtatatacatgatagttattaattatttagtatcggagtttggttatttctaaattatatttctatatggagtttagactcatcttccaatattctttattttttaattctaaatttctattacttataaaatttattcctatatttctcattttaaaatttagaatttcagttatttctaaattatactcatgtgtggactctaaactcctcttccaatattccttttttttaattaggaattttctttatttgtaaattgtatttttatatgaactctaggcttttatcccaatatttcttattttttaattatgaattttcattatttctaattgtatttctatgtggactctaaactcatatttcaatattctttatttttttatttctgattttcagcaacttctaaattatattcctatatggactttgtactcttcttccagtatatattttataatttcaaatcttagttatttataaattatatttctatatggactctaaactctaattttaattttattatttttatttcaaattttaattaattctaaattcctatatggactttatactcttcttccaatattccttactttcttattccgaatttcaattatttcttacttgtaatcctatatgaactctatactcttcgtctaatattctttattttttcattccgaatttcagttatttctaaattgtatttccatattgactctatactcttctttcaatattcgtttttattttgaatttcaattattactaaattttatttctatattgactctatacaccacaaatggacctttaatttgatatgtagctagcctgcttgcgtgtagttgtagtttacgatcgatttgccactcacatggattcacttcatgtaggaccaccaggcctcgcgcgcgcgtgtgtgtgtgggtgcgcgcgggtgtgtttgtgtgtgtgacacaatatatttttcatacttactaattatattcgaacacatgagctgttctctagtacatacaatgttgatcaactctactggttttttccccagatggatatcaagttagcccaactaaagccatcagccggcggcccacaactcagtccaggtgaccagaagaggaagattttcgttggcggcttgccggtgtccgccaccgaaaagaagctcaaagaatacttcaacaaattcggcgaggtcaatcgggcaatcgtggtcatcgaccttaacacgaagatgcccagggggttcggcttcatccagttcgcatcggaggagtccacagcgagggcgctcaagaaggacaaacacttcctctgtggccagtgggtggaggtgagccttgcaatgcccaagcagcagaatgcagcttctggcactagcaaattgtcagttcaggctcgcccgttttatccgacgacatcatcaaacttcacaaccgccgctaattatcctgacgtcgttaatattgtccctatggtgacacctatgaactgcgtcatcagcaatgcttttaaccctcatatcggctttgaggtacccgggatgatacttagtgatggtgtgagcaattctgtcagtgctaattactcctaccagaacccctacttgggaggtggtggtgttcagcctcaaggctcggcggtgtatcttcaagcagcacattattatagtggtgtgatgatgtgaagctcagaagctgttccaatctatgcctaattatcaagtcatagtgtcacacaatatatgtggtttatttacttcatttaattttcttcaatcttgcttgttcgtttaaagaactcatggtatttagtttcaactatttgctctggcgaagttcgatgtactcacttccctgaatttttcgatgtgtgtaatagtgagctaggtcgggaagaattatgatttcttaactaactatctaaatggctagatatatataatctctatacacagactttcaagttaagtttttaatagttttgggtgtcaagtgttttcccaaggtttatttacctttgtttcttaaacatcatgtccagctcatttttgtaagaacataattttgaaaacatgcatatgctttttatttatgtcattcttaagtactcattttcagatcttttacatatgcatatgtttagtattcggtacttaagagtgatttatggtccttgatagaggtacgaataactcctcttttaatctcaaggagggatgtaaatcacttcagcaaacataaaagtggacattttatgttgtctatggactatatgcatggcaattgattgtatttatacaaggtttctaaataagcaagaacaatgcatgcataccatagtgaaatgcagatcaacgtgtgtgctaaattaataagtccagatagattaacgtgttcaattaatattcagattagtacatatatatctccattaatattcctgctgttgctacataaaaaatataaattgactacatatggataaatatattgttctaaagcatttttcacaattttattttaactttttttatgtaatggaagtaattaacttctcgctacagcagattaaactatgtatatgtgcatggatcacattgccattcataagtttttaccaattaagatatatattatgcgctaccaatgcccatttatctactagtcaactgtgtgtcatcacattaaatttcagagattactgttattggtcaaaattgacaaatatatatagtcaaatgagacgctttcgtgcctttttaatttatgatcactcgttaacatttcgttatagttgattaacaaaaacaatgcgattgactatattcttttgttgagcagataacaaaactcctgatcgatattgtgggaatgtgggttcgctcttcaattctctctattattgattggctgtgaaggctgtttcccaagcgattgatatggtcatctggctagctgtttgaagactagctagctaagttgatcatactgttgaatgaagccaaaatattttcccttttttgttaattacatcatcatcatttatctagaattcctgattatgttggctactcgtacctgctgcatgcatggtctaggatcatatgaacttttttctttttctgaacgttgagaaaagaacctgctaatatgttaatctggtgttgtctggcgtgtatatgcagccggatatatatacatgtatatgaaggaactgccaacatgggttaatcagcggtaacatttgcatttctcatgacacattttgaagctttttcttcttgagctatcattatggttacccaggaggcagccagctagcaggtattgcttctgaagaaataatgatgatacatgatccatattgcatctaactagttataactaccattgctatctcctggtcctgacgtatctgcaggtaacgaacgaactgacaatgcaccatcaggcatcgatcagatcacaccacaagccaccgtggctcagaccttgggtcaacacggcccgacccacgtgcatccctaccgctgaccctctcctccctcccctcccctagctacctggccctgcagggtgtggtccccactccgcgtcttgctttcccggagaggcggagacgccggccccacctgtcagtcatcctcaggcggctttgggctttggctgcgtgcgtcgcgtgtgctgcgtgacgaccgcaccatgtctctcctcgcctgattacaaaaacacacgctccgcgcgcgttcgcgttgcctcgatcgcgcttccacaattcggccgcatcagtttctggtcatcacgctcgctggctctctcgctcgctagcttcgtcggagagatcccgagagatcatgaaggcggaggcgaagacgtcgacggtgaccgtgacgacgggcggcgagggggagaaagctgctgagccacggcaaggtgttcgtgggaggggtgccgctggggacaagcgagtccgagctccgcgcccacttctcgcagttcggcacggtggccttcgtcggcgcgcccaagaacaagcgcttcgtgcatgcagttcgtgaaccccgacgacgccgccgccgccatcgccgcgggacccaaccgcaacgtccgtccttcgcggcaccacggtatacacacacacataccccagatcatccggtcctcccatcgatcacacgctctcgtctcatctcttcttctccgtcgggtgatcgatctcactcgatgtgtccttgatttacatgttcttgtcctcttgcatcatgcatgctttgcttccgcgcccgggtgcaagtgaaagagcgtgggatcgtcgattttttgctttcctgcgacgaggttggcttcttgctttgttgcatggtgggcttagctcgtagcatcgtgttgctcgcggcgcggtgggttggtgattctgttcagtactgtcgtcgtcgtcgttgctatccgtgaccaggtgaccgcagtattagttaactctcttaactaagtgatggttagagcttgattagaaatggtatgcttttggtgctctgttaattctgtctatatacgagtccttggtatcataaatttacgtgtagctggcgagttgtagctgagctgtgtttaattgcatcataatttagatgtaatgattatagattagtggtaaaagtaagattcgttctgctcatacaattgattaatatttaaggcattgtaaggtttttttatattccgacgaaaactttagttcttgctgctaatttctctctttgtttttttaaagaaggcaaaagctttgccttgtatatattaataaagcaggagaaaattagtgagatatatacagggttagccgaaagagagcaagaacccgcaaaaaagaagacaaaaaaaaataggtattaagtgatatctcccaaaattacaaactcctgcaggattgaagccccctgctttgacccatgctcttccttcctccttgatctttgtcaaaattgaggacggcgccgatgcattgttgcggaatattcttgcgtttcgttcgcaccagattttccacgggattaaaatcaccaaggtcctgaggggcctgcgcggggtgcttggggactccgctacgagggtccaacattgatcgactgagtgacagttttcccaattgtccatctgaaggtcagtcctggtccatctctgaatttctgcccatatcctctttgtgagtctgcatttggccaggaggtgtaatgccgattcgtcaacagtgtagcaaagtgggcaaatcttttggttttgccatcctcttttctccagcctttctgtcatccatactctgttttgcgtgaccagccaagagaagaatttgcacttcggcagcgcctaggccttctagattgactgatagaagacggatttggcagccccaaagaattgaagtcgataggccgatttgccgagtgctgcccatttgctgtgaggttccatcgaatgctaccatggctctcgctaatttctctctttgtgacttattttgctaatgtggttcgtcgtcaacaagagtacatgtagctagctgggattgtttgatttcacgtgttgtgcccaagtgttacggatgaattgcattctgttttaattttatattaaattatggaagatcatgccatgatagggtttcggactaaggctgggtgcatatatagaacacctcctagtctccaacttcttgtgcttgctagggcctagggcactcaaggtcagacgtgtgaggatggcatttttgcatgtgtgcacccaaatcttcattttagcgtgggactgagcaaattcaatatacatgtagcttaggatatgtgttcatatgtagctagcccgcaaattcaatatatatctccaaaattaaataacacattttgcatgtgtacacccaaacccaaagttttaatttacaccacaaatggacctttaatttgatacgtagctagcctgcttgcgtgtagttgtagtttaggatcgatttgccactcacacaaattttacttcatgtaggaccatcaggtctcatgtgcatgtgtgtgtgtgtgtgacacatttgtgtgtctctctgtgtgtgtgacacaatatatttttcatacttacaaattatatttggacacatgagctatatagctgttctctagtacatacaatgttgatcaactctactaattttttccctagatggatgtcaagttagctcaaccaaagccatcagccggtggcccacaactcagtccaggtgaccagaagaggaagatttttgtcgacagcttgccggcgtccgtcaccaaatagcagctcaaagaatacttcagcaacttcggcgaggtcaaccgggcaatcgtggtcaccgaccttaacacgaagatgcccagggggttcggcctcatccagttcgcgtcggaggagtccacagcgagggcgctcaagaaggacagacacttcctctgtggccagtgggtggaggtgagccttgcaatgcccaagcagcagaatgcagcttctggcactagcaaattgtcagttcaggctcgcccattttatctggcgacatcatcaaactttaccgccgccccaaccacgtctcacgtttagcccatttagcctgatataactgtttgacaagctaaccactaaatgtcttacccactatttaaaatattgcactccacaccaccaccccaaccacagctcacgtttctcgctctcgcctctcgttgcatctatatgcaattcaaacacgcatgcgccacgtggctatcaaccgccgaaacggctaacgccagcgctgaccctcgcatcccctctcccctacctggctctgcaggttgtggtccccactagcgtcttgctttccccgagaggcaaagacgttgggcccaagcccccaactgtaagtcatcctcaggctgctttgcctgcgtgacgaccacaccatatctctcctcgccttgttacaaaaacacaagctctgcgttcgcgttgcctcgcacttacacaactggactgcatcagtttctgatcaccgcgttcgctcgatcatttgcttcgtccgagagatcatggagcgaaggcggatacgacggtgaccgtgacaatggaggagcagcagcgggaggcgacggacagcgagggggagaaagctggtgagccacaggaaggtgttcgtgggaggggtgccgctggggacaagcgagtctgagctccatgcccacttttcgcagtccggcgcagtggccttcgtcgacatgcccaagaacaagtagacgggcgccgcgcgtggcttcgcgttcgtgcagttcgtgaaccctgacgccgccatcgccgcggagtccgaccgcaacgtcctccgctggcaccacggtatacacacaccccagatctggtcctgtcatgcacacacatgctctcatcttctcttctcttcttcgtcgggtgatcgatctcactcgatgtgtgtgtgtgtgtgtgtgtgtttgtgtgcgcgacactttttcatacttactaattatatttggacacatgagctgttttctagtacatacaatgttgatcaactctactgttttttctcccatatggatgtcaagttagcccaaccaaatcctcccgttggcggcccacaactcagtctaggtgaccagaagaggaagaccttcctcggcagcttgccgacatccgtcaccgaatagcagctcaaagaatactttagcaaattcaacgaggtcgaccgtgcaatcttggtcaccgaccttaacacgaagatgcctaggtgggttcggcttcatccagttcgcgtcggaggagtccgcagcgagggcgctcaagaaggacaggcacttcctctatggccagtgggtggaggtgagccttgcaatgcccaagcagcagaatgcaacttctggcactagcaaattgccagttcaggctcacccgttttatccaacgacatcatcaaactttaccgccgccgctaattatcccaacgtcgttaatattgtccatgtggtgacacctatgaattgtgtcgtcggcagtacttttaaccctcatattggcttcgaggtacctgggatgaaactgagtgatggtgtgatcaatgttgtcactgctaattactcctaccagtacccctaccttggaggtggtgaggttccgcctcaaaactcagcgatgtatcttcaagcagcacattattatagtggtgcgatgatgtgaagctattccaatgcgtgcctaattatcaagtcacagtgtcacaaaaggggtgtgtgtgtgttggggggggtgtcattgagatatataagttggcaaatcctaggagcaaaatatatttttcatacttactaattatagtggtgcgatgatgtgaagccattccaatctatgcctaattatcaggtcacagttctgtcacacaatgtatgtggtttagttaatttccttcaattaattttcttcgatcttgcttgtttgtttaaaagaactcatggtatttagtttcaactatttgctctggcaaagttcgatgtactcacttccctgaatttttgggtgtgtgtaatagtgaggtagggaagaattatgatttcttaattaactatctaaatggctagatatatataatctctatagagagactttcaagttaagtttctaacggttttgggtgtcaggtgttttcccaaggtttatgcacctttgtttgttaaacttcatgcatgtcgatccagctcatttttgtaagaacataattttgaaaacatgcatatgctttttatttatgtcattcttaagtattcattttcagatctacatatgcatatgtttagtattcggtacttaagagtgattatatggtccttaagaggtacgaataactccttttttctcaataagggatgtaaatcacttcagcaaacataaaagtggacattttatgttgtctatggacatatgcatggcaattgattgtatttatgcaaggtttctaaataaacaagaacaatgcatgcatactatagtgaaatgcagatcaacgtgtgtgctaaattaataggtccagatagattaacgtgttcaattaatattcagattggtacatatatatctccattaatatttcttttgtttaaaatataaaggcaaaatttgactacatattgataaatatattgttcttaagcattgttcacaactttattttaactctttttatgtaatggaagtaatgaacttccactcgtcgctacagcaaattaaactatgtatatgcatggatcacattgccattcataagtttttaccagttaagatacatattatgcgctaccaatgcccatttatctactagtcaagtgtatcatcacattaaatttcagatattacagttattgctcaaaattgacaaatagtcaaatgagacactttcgtgttttttttatgatcacttgttaacatttcgttatacttgattaacaaaaacaatgcgattgactatattcttttgttgaacagataatgattgtgggaatgtggccgggttcgctcttcaattctctctattattgactggctgtgaagactgttcttccaagcgatcgatatgggcatctggctagctgtttgaagactagccaagttgatcatactgttgactgaagccaaaatatttcctctttttgttaattacatcatttatctagaattccttattatgttggctactcgtgctgcatggtctaggatcataaggaacttttttctttttctgaacattgagaaaagaacatgctaatatatatgttaatctggagttgtctggcgtgtatgcagctggatatataaatgtacatgcaagaactgtcaacatggattaattagcaataacatttgcatttctcatgacacattttgaagccttttcttcttgagctattgttatggttacctaggaggcagccagctagcaggtattgcttctaaagaaataatgatgatacatgatccatatttcatcttataactaattagctaccattgctatctcctggtcctgcaacgacccatctgcaggtataactaattgtcaatgcagcttgatgaacaccagtaagttcaatcatatcggtagctccttcaatttgatttaattcactgcagcatcttaattcgtggatatgatcgtatgattgatcgatcaagcctttcctttcatctgtgctagctagaattgtagctctgacatgcatgcttcatgtcattttccctctttattttgtgcttcacagacagttaacatgcattgttcgatctgtcatccggtggcgcgcatgtctcgatcggtgtttgctagatgccatgcacacgggagaacggggagatcgattgatcggtcgtgcatgtgctcggctaaaccatcgacgagcttatctgaatccatccgatccatgtgagctctggcaaaaaagctagtgtcgaatctcactttgcatatggcaaggctgcttcgatctctaggattgccgttgtttcatcagcagcagtacgttcgttccaggctatcgataggctgtcaagtgtcaacatgaatggttgctatgttctgtttggaacgcagcaatttcacaacaaaaagaaaaacaaattaattcgatgcagtacgaatgatcaaagcttcatcactcagtagtactccctatgtgtactgtctaatctggttatagattattacggaggatatcttaggacggagagagtgcttgtgtaaaaaatcataggaaggatgaaaccaaatagatgacgacgacggctgttactgtatagcacgattcttccagccacttttgatggttccatagtttatattcttcagtttatcagccatagcaaattaaaacgctatttttagcattgatcttgatcattgtatattactagaaaaaatatccgtgcgttgcatcctgaaataaaagttacaataaatattagaagtttgggtttaatttttatgatatatatcccttaaaaaatcatatttttacgtggacatggtaacttgttgaaaatagtatattccttgactaccaccttcaatatcaacacataatttctgtgatagatatccctcttcccaacttctactctcattttccgcacacacgcttctcaaactgctaaacttgtgcttttttaaaaaaaatctatatgaaagtttttaaaaaatcatattaatctattttttagctaatatataattaatcttgccttaatccatggctttgttttacgtgacagtgaagggttcacaaaccaacaaaacacagcctaagattttatggaaaaaaaaccttctcgtaaaataaaatggttctagtagtatatcatatactcctattgcctatatgttttcactcgctcctagttttaacgtgttagagttgttaaccacgaccattttctgttgaattaaatcgagaaaggaagaaaatgttgcaaagttaatgaaatagagaatgttgaataaggcagcaatgtggaaactggaaaaaaggaggtgcttgtttgacaacacaccaaactatagtcggggagagagagaggtaagtaaggataggattgaggaacatatataatcgaaagcagacccttacatggaatgcaaatatggtcatgtatgtttcaggttgcaatctagttctagaaatagatcctacgctaacatgaattgcgcattgtgcgatatcatccggaccctcaaatccaatccacttatatagaaaagaaaaccactacagctttaacctaatcacttcaacaatggcacctgtaggactggaccagaagcaagaacaaaatctgatttattcaacttaaaaaataaaaagcttaccatgtatttgtatgccggttttaaaatctgctcaacaattactacaaataaattatggaaggaaaatatgttggggtgcttgtatatgtgtatcttgtttccagtttccacatgtgatcagctttaacggaaagaaagtagcgttagaattggaaacgatatgttgcaacggaaaggaaacaatagggaaaggaagcggagttcgtctggctctcgcgtctacctgcgcattgagttataggaagatggaaaagaacgaaaataacggatgaagaaaacaatatgtgcggtgaaaaattgtaatgacggactaaaaaagatgtggcgaacaaagagatgcagactttttaaataggttagattagattttttttcagtgttaactttgtagaccacgtgtatataaatgttaattactccatccatttcaagttattaggcgttttgactttgttcaaagtcaaactactttaagtttgaccaagtttatagaaaaaagtagtaacatttttaaccaagacaaatttattatgaaaatatattcaattattgatttgatgaaactaatttagtattataaatactactatatttatctatataaacttagttaaatttaaaacagtttgactttaagtaaagtcaaaacatctcgtaacatataacataagacggagggagtactgcgaaacgatgacatccaagtacgagaacgagagcgatggtgcaaacaaaaaccaagacagacgtacgtacggcacgcaggcaggcagcagagcaaccaagcaagcagatgagacgtccttgtccagttgtactactactctatcgggacgatacgcagtggagtacgacgcaggccaaggccatgaatgaatccatgacgtgtgatttctcccggggaaacaaacagggtcccttgatttgtgacagatcaactaaagcgatacatgaggcatgagctcgatctctcgagctggatcacttggatcaacaagtgaactacgtttgtggttagtaccatatacttattccgtctcatgatagttgttactctaaattatttagcaaaaatgactatagtgccccctattaaatggtatagggttaggagtagaatgaaaaaaaattgaattggaggttattgatgtgtcaagagttactgtaaagtgataaactttttgggacaaaatttgaatcctaaaacgacaactattttagtacggagggagtatctcaaaggattttcagaaaaaaacaattttgaggaatttttaaggattaggggtgaaatatcagcaggcagataaatcccatttcggaattattgattaatagaggtataatagcgtactgcaagtggaagacatgtaaattatcattagtataataacatgctgcaagtggccacaaacatatctgcgtcaagatgcaggacaataatcgtacactaaataccctctctatttgcatccacatgggattgttgctaatgcaagagacaaatccccggtacttaagcctagctgtccttgccaagatagcgacacagcacaactcaaacagatctttctctgaaaatgtgaatgtatattacaaaggctagaactagaagtactgaagtagtataacccagccatacagctttcatgtacaattgtacatcatgatattcctctcatgcataattcatactacataattgcaatcttgcattcacaaaatacatgcatagagtgatccattgctgggtttctcattactatctttcatcaaaaggtgtactattgagtaccacagtatgcatccatagtgatcggccaaagtacatttaaaataacagtatctccatttgaaggtaaactgtcaagtaagtagaaacaacccattctaaccactgagaattcttacaaaagaattgagacatcaaagaccatcattgcaggccgactccaaaagccatatatctacacccccaacaattcagagtctccgatgaattgtaaccccccatcaatgggaccagagcttcttgtctttgcatcaatattgtatcgttttccctttaccagaacttctctttgattgcatatccccctccaaagaaaaaaagaaaccgattataccacatgtattctatcactcgacttgctcgccgatcaagtcgaggccgacaaccaagaatgagaccccttggaacagaaggaagtagaaatgtatgccttgcaccgagagcaggcttcgagctgctgctgttaatagaaggaaggagagtgccagctccttctggtatatcctattgtgttttttctttttcgaatcctttttcggatgggactccttcgctagggaatcaaggttgggtgcagacccaactctctgttgcttaggctgcttctcaacaagagaaacgagatcgccctcagaagaacggcccgatttcttggtcacaacccactcgtaggcgctcccgagctggaacaagccagaaatcatggcattgaattttgtcactgacatggtattctcaaacagaaggtagggaacaataaatgggaaggatttgggtgctgggagaatattcagcaaggacatggttgctggaatgtagcacaccacccatgcagggagctcagcttcagggacaaacattgtcatgggaaggatgatgcagaaaagtgtgaaggaatagaagggcaatatgagtttgcgaaggagaaagaaaaggaagatgaggttgaacttcttccatactccaatctgcagttgaggtaagtaaaaatagttctgatcagtttcaacgactaaatatgtataaaacattgacaaatgctgttagtgtaaaattttgaattccatcgtagctgtgttttgatagaagtgaagttatctacagcatcaacaatttgccggttagcaatttatttgcagagtaattctatttacacccagtctttttttccagatgaagctcaggttagcaatttatttgcagagtaattctatttacacccagtccttttttccagatgaagctgtttagtctgtgtttgacgtcatgaaacatttgactaaatgagctgcaggtccattttactagtgaagaaatcagtctatgaaacttatgctctgtaactaacttgaagcgaaacaaggttcatgtaactattagtctgatgttgctcttgtaatgtactggtagatagtaaaacaatcccttgcaactatgcatcctgcagatgtttattggcaaaacaactgattgtgctagattatcctactgaatgcagccaaaatcttctcaacagaaagaataagggatgaacctaaccatgtagtggcatgctttatatgatgttgtcaaaaatagcttttggagtatgcctacgagagaaggtccatacctttgatttgatgatgtcgacaaaacagagtcgaaacaactgcatgggaccagaatgccatcgatgttgctgctttctgtatgcttcatatgactctggcagctcacactggcactgaaaggataattgtgtgcaacaatttgaattgtcatcacaagtttgaatacaacacagaacgcacataaaacacaaggaaatgtatgcaggtacctcgacatcattaatgtacagaaacttccaccccttgagatgtgctcggacagcaatatccatatcctccactgttgtcctctccatccatcctccagagtcctcaagtgccttaattctccatactcctgcggttccattgaacccaaagaaattgaggaatactccattaacctgctgttccacctcaaagtggaagcacagattaatgttttgcagtctagtcagcaagttctcgtctttgtttacaaaagaccatcttgcttgaaccaatccaacatcttcattgccctggaggtccaacacacaactagtcagtaaatataattttcattgccttggacacatataagaatgtaacacaagtccacaacatcagaaatatttcagctataccttgaaatggggcacagttcgcttcaggaagtctgcttgtggttggaaatcagcatcaaagataacaacaaactcataatctttaacataactgcagttcatggctgacttgagatttccagccttgtagccatcacggatcacccggtgtcggtacaatatgcggacaccctctcgctgccatttctccacttcctccttaataagtgcagaggtggcagcatcatcagagtcatctagtacttgtactaagaagtttgaccttggccaatccaggttgcagacagcaccaatggattgctggtacacctgcaaagatagaaattaaaaggaataagctaaatttaattgtagttctaacatgggtgttctgttagccttttttgaatgtcatgaacatagaacacatcacaaaggaaacaaaagtaatgctactcccgactcccgagcttagatcagtataacatcttatatctataattgtttttctaaattattctttatacattttgttgacgagaattaaatgaattttgtaaagatacaaaactttgaaacataaaacagtgcctttaaagcccccatccccccccccccaaaaaaaaaaaaaaaaaaactgaacatgttcttaacttcttattcacatattcaaatccccaaattaaatctacaacccaccaaacgcttcatatcaggaatacccataggccagaatgtagattatgtagtgatcgtctactttgagtcgtggacaaaaatcgaaaccgtttcatcccagcatgtaaccatcactccaatcccaatattgaagtatgcaagtagcagccaaattttgcctcagtggcactacgaccaagataccccaatctaaatctgccgaattattcctatccacttgttgagttcccccccaattgcagttcaaagaccgaatctttcggtctctgcaaaccacagatgcggccatggcactcaacgcccaatcctaaaaatgcaaccttgcgcaaatgccgaagcaacaaacaattggaattagttatgtttgttctcgcagctcacctccttctcgttgcacattggaatctgcacgaggaccatggggaactcgtcggcgccggcctcgacgtcgtccgaccctttgccgccgcccgcggcggcgatagccttgggcacaggcttgattcccttgagcttgatccataagcagccgaggcagaagatgaggcggtcggcgctctggatcaagaagaggacgacgcaagcgttggcgaggaactggaaccccggcgcgaggtactccaggcggacg

SEQ ID NO: 30742 - DNA, 45512 bp, Oryza sativa
  unsure (1)..(45512): unsure at all n locations
ccccacgacctcacctcctcatcaaacacccccacacgcacgcggctgcggcggcggcggcggcgagcagaagaggaaacaaacagctcaccacgtcgtcgcgatccaatccaatcccaactctcctcagctccagacaagcccggtctttatacactcccctatgattaccaccacctcacccaaaaaaaaaaattaaaaaattaaaattccaacctttccttttcctcctctcctccagctggagagcaagtacaggacgacggcctttacgctgctgctcgaagcttaatcaactaatccgccggagcattccaattaaattaagccaagaacacagtccctccctcgctctcgggatcgggggccaattggcgactcgatatgcttcggcttcttggcgggtaactacgactacggctccatttaagcaagctgataaacgcggcttaatcaaagattcaaggagagcagggaagcaggcagcgagtgcaacgggacacgtgaggtgcgggctagcacgtcggggggaggctgattgattcgttgcgtggagccgagccggccgggcgctgtcggtggcgaccggattggttggggtccccgcgggggttggtctcgttactgctctgccaccacgttgccccgcccccttgctgctgctcaccaccattgctcatcctaccacaggctaccacttcatcatcaagattttagcacagctactgctactcatttgatttactagtttagtactgtagtttgttttcgttgatccaaatcaactctgtttctttcagcaatgcaaatcagtgttcagtgaatggattggatgatcaccgaattttacagcgcatcatcggtcataattgatgcaagcagagtgattctaacagatagagagcaaaattgcaggcaaattaaagccagtgaaccagtgacttctgagaatgttcttcaggttttttttttttctgttgcaaaccggacagtggttaatactgtagtatgttctcccctacataacgatactaacaaacgttaaaaaaaatgttggaaaaaagaaccaacttgggaaatctgacgtgcccaccacacacactgctccaaccgtttactagccagcacttataccgacaccaaaacacgtagtaggaggcacagtacaagtggattattactcgcatcatcagtggtgcgtgcagcaatgtgacgtttttagaatgtgatttcttccagctgccatctgtctgaatctatagggttgtactactcagtacataagcattttctctgttctaaaacgaaacgacctaatattataaatccgaatacaatatagcagtttagtattgtattagaaacaacgtagcactacgaatctggacataatatagcaacgtaccatattagacaccccataatactatgatatatgtccagattcaaagtactacgttgtgttctagtacaatgaatatagacacaatatagctagctagtactcgattagacataatatgtccaaattcgtagtaggctacatctaattcattattaagttgctatattttaaaacggatagagtatgtttcaaggccccagaaataattggcataataattaatgaggtagagatagaaggtaacaaaataaggaaaggaaatgccaaacttacataaaaatatcatgaaatgaaatgccaagcttttgacaggaaaggcaaaaaaataataataaatgtataaatatatgtaatgtagaataactcaggaaaggaaatgccaagcttttgataggaaaggcaaaacaattaataaatgtaaaaatatatgtaaggtaaaattttcagaaaaggaaatgcctaactttttacagaaaggcaaacaaaacaggacagaaagctgaagctggtaagacaacagaaaactccccaaattaacttttcataatatatatatagacagagatggaagtataaaaaaaattatgtgaggtctggtccgagcagaagaggaataacaatctgaagagatccagtcagaagaaaacaagatcaaacaaaggatccgccccgtacttgtttttcagcgaaattatttgagagagaagaagcactggaggggagattagatctagctatgctggccagtggccacttgggtttgcttggagattgcatgattatatatgatcaaaatggttaaggaatttatagaagatatatagtgggatcatgtttggtaggatatatgtgcaaaaaacatcgccttttttagtcaaacttagattgcacattgctggattcatgtggcacggttactgaatgtttgaggccttccatatattgtatactacagcttacagactgcgtgtagacttcatattccctatgcaaattaagcagataagtttttttttcacctttttcagaacaatccattgtctgctccttcagagctgttgctagacacctgcagttacgtagaagtcaaaagattaatactgtccaaaaaagaaatgttttcaatacagaaagctatgctcttctggttgccaaagtcatattcttatagtattatgtttgtagtattattttttaaaaaaaaaaactgaccctgcaaaactcaaaataactttcaagaaacacattctgctgtcttgctgagaagcagtggacacacattctattcttgctatcaaactcgtatggctgcatcattctctctctctctcttctgaagaaagcattgtcaggacggaacatctgaagaaaggaggaagcagagaccacccatgaaagacagaacacatgatcagaacccaaagccaatatagaaacaaaccaagatcagatctgaaactgctcaacttgcctcaggtagggacaagtttcgtttgcatgccccatttacgacatccatccatgataactgatgaaagagaaaaaaaataagaaaagaaaagggcaattggcaatgccaatcgaatctctacgcaggctacagaacctggcaagcttgcgctgttagttactccttcctaagctgcacttgctaattactgatactagtaagcaatttgcttctactgaagtggtgtgatggcccccctctcttttcagtatttctgtttgttgatgcatcaagttggccgttgtgacatgtactgcactgacatggctgaaatggaatacgatggcaagaggcaatttcctaccccgcgttgcatctgagtaactggggcgaatgtttgttgtgtttctcatatggagtgctattaataaagattcagtaaatccccatttactaccatcatgtcaccattgggtcagtaaatcctgagaaataatgctgatcgtaccatgctaccgcatcatcggttgtactagagtatatgcccacgcgattcacatgaagattaaaaataacctcattgattaacccttctcatttctcaagatatccaggtgtggtctcccctcttctttagctatttcttcagagttcagagttcaggttgtagggtagatcttttttccccactctatctatcacatggtgattaaagataaccttgattaacccttctcatttctcaagatattaacttctttgatggcttggtttgctcacttcactgacagatccagcgttgagcatctcagagatggcaagaacacacgcatcgcatcgaatcacacaggagggcagcgtcgtcagattcagatgtgctcacgttcaatgctgctgcctgctgtaccttagcttggatgcagcgatgcaggcagcgagggtccagccattattaactcctattgctacaatactactggtagtaccacgcacgagtaggagaatcataagctactacgatgctgcttgttatttaatttaatccgttcttgtgctgccattgccggggaggacgtaaggaatcattccaatctgcatctcgatcgatccatcacccatgccgccttgctctgattgattcctccttttcaatccgtgcaatgcaatagtagcattacttacacgctgcacaagcatgaaaaggctgtagtttttcgtgtggaaatttaccgggagtagttcagttcctacgaaaatactctaaaattcctccaaaagggagtcttaaatttcaggttatcagatctcgatggttttagatgtgccgtataagtaagtctgtcgctgccaacctgatgatatactacaggctgcctgacagccgacattgtcattcagtctgtcaaccagcaaaataattcgctgcacaaccgggcaacggaaacttcactgcaataggagtcctaaattagtatactagccacagtgtgttcatcccaagaatcggggagtgttgttgctgcgccacgaatgactaacagctgattgtttatgtgttaatcgtggcgatttgtaagttggtcgcagacttgcgtatcgtgatgagaggcgagcatgggaaaaaggatggaattaacaaatcgatcgcatcgttgtaacggcaaatccagcaggagctccagcatgatcagcgtacgtgcttttgagttcaggcgcacatctttatgtaaataatttgcattaggtcgctcatcaatgtcattcgtgctagtagtatttgtttgagtttgactaaacttcaggttttgttttagacgcagacgaccactaatgattttccgtcgtggggtgcactaatagaacgtctgaacgttttctgcgtgcttagacgagttcacattgaccatcaatttagtactaaaaaattagcagaatatttagcagggtttgtactacttaactacttattgaaatagagttttatttgctataaatctttcgtattgatctgtaaagacaaaataacatagttgtaacagcgtcctaataaatacttcctaatcaatttacccaaagtaggtgggaatgaaatgggaagcttggcaaagggtaatcaatttcatgaacaatcattttctgatataatgaaacagacatcctcattaatcttcagttgaaacagacatcctgaaacatggacccgacactgagaaatttggcacggccttacttataacataacggtatttaagccaataagacgaatcaaatgaatatcaaaccatctacgttaactttgcttccacttcgcacaacagcaagaggttaccagggcgcccccatcattttttacacaaccactttacaagtcgaagaagcaacagaggcaagaagatggaaaacacagtggaggattcagctcagcagcggcttccaaaactgccgctgctcacaataccacatgcacacacaactagacacaaaggcttcccctttcaatccgagaggggggcaatgccgaaagcaatacagctaaagtgattatctttataagagaggtaactgtcagcctacagttagctctgtattatctatcagaggtgaaactaatctccatcaagttatgaggaaacgccacagcttcttcgctgaagatgttttctcttcctcttcctcttcatcttcctcgtcagagtcattgttgtcctcaggtccatctacattagatgtttcagttgcagactgcaaatcgaaaacagaatatagtaagttcaatggaccaaggcacatactaaaagcatatgatgagaatagtgcagctgcagctgaaagaggaattaccactgtagcctccaccgaaggttcctcttggacagaatctgaattatccactattccgttcacgtaaggcacatcaacagatgaagctggttctcctggttttgtaaggttctctggccctttatcgccgtattcatgttccttgcaggtgttggataaaccaagtggggcttcatcatgttcattcttggagcatttctcttctagagctgacaggctgtcaatatcagattgttagtgaagggcatgaagaaacattaaattaaaatagtcacgctgctttcaaaagttcagatagtagtgtaaaaacaaatcataccagttggaagtgatttcccctccattaactttctgaatagtactccttctgtgctttcgttttggctctaaaacttcagtttggtcacaagaaaccaaatgattaagcctcttttgaccaacttttgcaaagtccaaattcacatcttcaacatccacagagtctccaactttctttggcacaccattctggacaaattgatcatggctagcgctcttctctggagaccgtttgaatatcacctgagcacattttcgaacccaagaaatcggtgttgagactggagaaaggtctagtttccttccaaaacgttgctttggtgaagaatgggagttatcatgatgattgtctttcacatttatatcacttccaagctttgacttatcatgttgtaacaaagacagttgcttattttcagaatcaattttcagttcttccaacacattaagttgttgaatttgcactgtaattgcttctcggtctgaatgtaatagttttctttgctcttgcagcttctcccgttgattattcaaggcttcaatagtgccttttatctcagacaactcttgctctctcctctcacgttccaaagtagcttcttttctctcatccttaagtttctgcaattcaactgcaacatgttctaattttgtgttgatcatctccttctgagaattgatgtgttcgagttccttggcctttttctgctcaaactcttcctccctttccctcaaataagaatctatttccatctgccttgccttagcagaatttagcaattccaccctctggatatcaatgtctctcttcagatcttgcctttcttgttgaatcttactcagccaacttgcatgttcttgctgcatcttactcatgaactctttgtgttcacgagagagtgtttctgaattacttttgaactgaacacggagattatccttctcctgtttgatgatatcagattcattcttcagatactcagttattgctcttcgttcttcagcaattctgatcgcttccttttgtagctcctctttcttttcatcaatcagctcccattcaatctcaaacctttccttttcggcttgcagcctatctgcatcagccatgagttcccttttttgggctctgaggctgtcaatttcttctttaagtttcatctgcagagtaagcaactcatctctatctgcttgtgttattgctagatcttgttgggcttgaattgcttcccgtttctcctcttcaaagaaagccttttccttctccaaatccgatttaatcctttgtatttcttccctttctttttgaagttcattgtgtatggcttctctgtgtaacaagagcttttcctcctcctctttcaactcatctgatctccctgccaacgccttttccttgcttgctaattcagctagctgaaggtcaagattctgggatctttgcacaaccacagattcctgctcactgagagcacattctctctgatgcagcgcatttcttgtcacctccattgctgcatcaaaagacatttgtttgtttgccatctcagattcaaaatcatgttttctcctctccaaggctatagcttgttcctgattcaacctttcaatctcggcctgcagcagaaattcaagatgatttacaagaggttaagtcacaacacacattgtcaatagtgaaattggagaatcttacccgttctttacttgcgattgtctcttgcaaaattaataattcactctcccttttgtcaagcagggattccttctgaatcagagcctgcaaaagagatcaattttgttagacagaactttcgcaatgatatataggtggtaataaaaggagaaaaatatacatacttcctctcttgaaactattgcctccattttcagctccaacttatatttttcctctaacaaaaccttccgttcagcttcaagaatattcttttcttcttccactcttttctctgagtgagtaacataagctaatctctcaaggatgttctcgtccctctgattgagtagagcttgttcctttagtaatacttcctccttttcatgcaaaattttcttcatatcgttcaacgatttcctctggaggctaatttccttctctttggcctcattcctgcattagcatgcctgatttagggaaaaggaataaaagatgcccactaaactatgcaagaatatcttacaaagtacacagttgactaaaaaaattaaaagcattttgacagtgatttactgaactgaattaagctatactatataagaaagacgatttaattgaaaaggtggaacatagaacactcactcgagctcacaagaaattcggtctcttctaagctgatcttcgcgatcatcgatgtcatgtaaacttctcagtgctgcattatgagtccgtatggactctgcctccaaagattttgctagaagaagcttctcttctgcctcatcaaatttcttgtgtgcagcctccatcaattgaagagcttcagccaatttcgattcatatgaaacctttgtttcagctgtttccccacgcatatcatgcaatgctttttcaagctaccagaaaaaattgaataagggccacattatcattatatatgaattggataaaaaaattaaatctcagaatgtctcatgtacagtgaatttttcttttgttctcatagacataaataataaattttgcttctgagctattatttgggataaaaacttacattagcaacacactccttttggatgcctaaactctttttcaggttttcttccttcttccttgcttcagctaaagcagactgctgggctgcacgttcacgcttgtgcataatctcagcagattccgaagcagctctaagttgctcatgcttggatgttaactccttccgctccatcaaaacaagaccaagattgtgttggtattgataaatctacaacaaaacaagcaaagaataagataaagcagatattttatttaccattcttctgcagagcaaaacgtgtaaatttgcctttagttacaacatgtgcaataggtcctaaatatgatagcttatgacaatgtaggtatttaacatttgggcatacatccgatggtgaataggaaagaagtaaataatagactaactggtttactgatgtgcagactttactattgatacaaattgcatacagatcaatgaatggtttcggcaaataccaatgtaataatagccatggcatcttccaacattaatcgtatgctaccgcaatgcataaagcaatctactatttcaatccagacaagctaacccagaatacatatgtatagttgcaacagtagaaaccccaaagcgaaagaaatagataaataagttgaatgtaaaaatgtaaaaaaaaaaataaaagaagcaaacttatacaattacagttcagccactaactaatccaagcaagctaaactaaatgacaaacattccaagataacgattctaaacaccaacgcaaaaaaaatagcttcttgaatcattaataaacccatccagcatgtcagctgtacctaagaaacaaagaactgagcaaccaccaaaatcccaaaatgatttttcttctttcccgataactcatagcgcaccaaactcgacattagtcacacaagaacccacgcagcgaatgattccaagaggaagacttcatcgacgttccgccgattcttctcggccatcaatctttctcctctcctaggaggaaaccctccaccaagaactagctactgagggagtcaaaccatcaaatcaagaaatccaagaaccttgccatccagcacgcacaaggaggggaggaggggggagagagagagtgaggtgggtacctcggactcgagccgcgagatgtacgcaatgagcgccgccttgtcgcggcgcttgagggactcctcgtcgaagccggcctcccggagcttactccagatcgcgtcgttccacgcggctgcgccaccacattctactgctgctccgacttcttctaccaccccacctgccgaccgcgggctcgccatggctcctgcccgccgggaaccctagatctcgacggcacgatgcggcggcggcggcggcgaccacccgtcgtcacgcgcccctcgcgcgcagcagtgctttcttcccgtgcgagtagtggaggtctccctcctcgcctcctctctctctctcctctctctctcccttctctcgcacacctctccttttcccctcgagctttttttctctctcttcctttgggcggctgctcgtgtgtgctgcgcgagacggaggttttttttattattattttttactcggcttgggattcggtggagggagaagggtttggtttgatgggtggacactggacgagggactgggtgaggtgtgggaccgtggagttcagggtggaccgggtttatggaggtggtgctctaccgtattagagactgatgattattggcaagattctttctttctttgctttcgctttccatttgtactctaatttttaatttggagatcgggtttgttttaggccgatttggctgagcttcaccttcagctctactctactttttattaagctgaaaccaaactaaacaaatttaaatgcatgtgaaaaaaaataaaagaatggactgaagtgctctcacagaataaatttaaaaggtatagcaaatgttcggtttgttctacaacttcactccaaacttaggttttggagttaaatttagacattggagtcccatcaaacgtgtcgtttatttgaaacagagactttagcttgccatacatattgcttaaaaaaaacatttgaatgacttttttcacaaacaaccttgaaatgtcaactatttggcctgctgaactatacagaccttttcctcttaaaactatatagataaaatagtatagtaaaaaaacatatatggagtactacttttgacaaaaaaaaattaagggtgtgtttagttcggaaaaagaaaattttttggtgtcacatcggacgtttgaccggatgtcggaaggggttttcggatacgaatgaaaaaactaatttcagaactcgccgggaaaccgcgagacgaatcttttgagcctaattaagccgtcattagcacatgtaggttactgtagcacttatggctaattacggactaattatgctcaaaagattcgtctcgctatttcccctataactgtgcaattagtttttctttttatttatatttaatacttcatacatgtgtccaaagattcgatgtgatgtttttgggaaaaactttttgataactaaacgggccctaagcaagatgacagtatgctttccgttggcataagcccggggcacactgtaggcttggtccacggaagcatccgaggattcggagatcttttcggcagtaaataaaaaacaattaaccaacgtcaccaggtgtaacgcatactaagcatgacacgtaggtccaaatccctcgtggcccacacgtcagtctccccagctactaatcgacaccggcggccggctgccttttgcggctgccgctgaaaagccgtagcgacgcgacgagcacccccgcacacggagaccatcgcccatgacaggtggggacaggggattcggggggcccacatggaagcggcacgggaaaggggagcgatcgtgactcgtgaggatcggggttcagttgggtgggtttccggcgtggcgcccagctcgtttgagctggtgatcgcgatggcggaaaaagtggatacgtttggatgagggggatgaggtcaggtctctcagttcgggagtggcgccagtgagaacgcatccgaggtgggtggtggggtggtctggttttttatgtgggccccaccaaacttgtgcccttgactttgacggccacagtgatagccacagctgtggaaactgggaaacggaggggtttacagtcacacttaccactaatgaattttttagcttcccagtctgttggcagcaacagtccatgaacaactggtgaaagcttctgctcctaccttaccaacggtgtactagtactactactactgcgacatcatggccagcttggagaactccagccgtccagcgagcgaggcaccagcactgggtacattattggttagacacgggaaatgcagctgcgaaaatcagcgtctggttgggagttgcagcgcacggccgatcatcgtcacgaatggtgcagaagagtccatgggatgggagcggcgcgctggaggagcgcccctcttcttgcaccgtagtagtccgagagccagcccgatatgatgcccagttctgattctctcagcctaacaagccaatccgggtcgtccttgctcgcggggcgcagatcgatgtgatgagctcctgcaaaggcaaatcacaaagcggatttacgattcaataactcaagatgatgcaaaccagagactcaatgtgcttgcttacaaactgcaccacatcaacgtgatttagtcaagtacttcttccgtttcgcaatgtaagtcattctagcatttcccacattcatattgatgttaatgacttacattgtgaaacggagggagtagtatactcaagtatattattgattccattatatcccagtatcccacacacttgagtctagtacagattaacaccaccattgatgaatggaagtgtaggaaaacagcatacctaatggagcgatgatggccacaacactctcagatatattcttcaggacactgtaatgttcattgttcagataacggcaagatcataacacgaaaatggctcgtgtaggtgagatcgtcatcagaggaaataaagctcaaaaggcaagtgaagtttgtttaccctccgccactccaaggatccagaagcccattgaagaatatgatattactaccaaatctctccagaactagactaatattctgaacaagaaaaaaaaaacaagaagtcattaaactctctcacatgtatattttggctgaaaaaaatatgaagaatcagttgtattgcaagcagaatagtttatggagtagaacagaatttgagcattccataacatatctaataataatacatttttttcttagttaagaaagtttcctatcgatgacaaatcatctagcagagcaagttgttaaaaacaaatgtatatgctttatgaaaaccttgagattttgatactataactcacatgcccaccaaactctgtagtaatccattgaggccttggttcaacaccaaagctgttgatgcaatccttctcatatgaagtgtagttgaatttatctgctggaaacatactatcttcactgtatgacattggcataaccatctcggtacaagcctgttttaagcaataatggcagatatgtcatatcagataactcaagtaccttaacatatactccctctgtcccaaaatataaatgtttttttgcccatttagagggagtatcaaatatatccaatggatagaaacagcataaagttttagttgcaagacctgccagtcccatccatccattccatgcggatcatcatttagatcaaagcagtcaacagtaccagtgtagttgtagtatacatttactcctgcatatatgcgctccagaatactggttccatcaggttgattgtcaatttttgtacacaactgaaagagaaaccagataacctagtaagtagggagtagtgatgacatgcagaaaatagaacatggtaagcaggtaaggcttcagaatgttgcagcacactaaattatcattctgatatagtgatactctagattatcttctttgttgggtcttgagaacacaaactaaataatggttgatgaatgttagcaaattaaattttatcacaaaaaggaactaacttcctttattggattgccaggcaaaggcatcataaaatctgctggcattgggtaatccaccatggccaggtaactgtacgctgagctcaaccaatctgaaagttccccagtgttttttatagtcctgcaaaacattttttatacatatatgattaccgattaataaagctcaatgtaaaaaagatgtagtgaatagaaaaattactcacttgcatagatggaaagttttgcttagtttcagcagaccatcttgcccatttccttgagcatccagtgctttccaagagtcctttattgtttgaaagcagcttaaactttccctctaaaacacagtgaataagtgtcatctgtcatgtcactcacgtatattgagaataataaggaaacaggaaatgttgcaaaataaacaccttgaaatcatttgacacgagatcgtagaatatggtagaagggacaacgtcttcaaattgaaggattggagctgatgacgcgagagccccaacagcaatatgtgggtatttaagtctcatccaagcagcgagcactgcagcaatcatacattcaatggtgtcagtacagaaatacagattgaagctggagcccaacagaccaccaagccacattcaagaagaccctacggaatacagattttgcacaggcaaggctatccagttaaagagaagccttacttccaccgtatgagcccccgaagagcacgacagggctgccttctgatgacaagttcttcttgaggtcagtgagcagtacagcataatcagcaagcgcttgctcggctgtgagatacgccaaggacttggaattgttgtaagctttatccttgctgccgaatggcatcgactccccgtagtaccgatgctgcagagaacaagtaaacgggatcggatctcgcacgatcagcgcacacccaaggaagaacacactgactggtgcaaggtgagaggataaatttgcctcggcgaagacgacgagagcggcgaagcgcgtggcggcctcccacacgaggcccgagttggcggcgaaccaggcgatgtccccctcgttgccgcagtagaagaagatgggcccgccggcgccggcccacccgccgccgcggccgaccaggtaccgctgctggaagaacccatccccctcctccccctcctcctccaggaagctgaagtggtccagccgctgccggaagtagcgcgtctcgtagtcgtaccctctcaccgcttcctcggcccccaccaccccacgccgcggccgcgcgtgcggcaccgggaagcggggcggcgccctcgccagggccgacgcggcggcggcgaggattaggaggaggagagggagcggacgcatggccgctttgccgccggcgtggtggggaggagcagtggacagcggtgagctcgttctcgtcgaaggtggcggcgtgcgtgccggcgcggacggaaggggagctttatgacgtgatcgtgacgtgggggcggctcacgcagtccacttgtccactcactagatggcgcgggtgacacgtgatctttcaaggtgggccccgttgattttgtgtatgggctcgttgaggccggcccatcaagaacttgttcctggaccgtgtccgtcctggcctcctgtgctccgtgtacatatatgccaacaatacgggaaacgaccgggtttttcctgcagagatagatagatcgatcgatcgatcatggccagagagggaggacgagacgacggtgatgacaccggcgccgcctctacctcgcccaacagcgtcgcaaatcagtcgtcgtcgtcgtcgtcgtcgtcggagccggagccggtgcctttcccggttcaccgcttggcgcgctactccaagtcgatcgacaaggcgatcagggagtcggtcctcatcaacctgctgtcctggagcctcgagcagcggatgctgtcgcccgaggcggcggcgcatgccaccgccgacgggctcgtgggcgtggtccggtgccacgccgtggactccggcgtcaccttctacgggatggaggggatcggcaggagcttcgaggaggagctcctcaagtccttcgacaggcagctcatcgccttccgcggcggcctccccagcaggggggagaaggtgcccgtctccgcgggcgaggcggcgcggatccgcgcgctccacgccgcgttcgtggaacgggacgcggagctgtggaccctggcccacgtcaccctggccgaggacctcgcggcgtcgcgcggcggggacgcgtcggccgcctccatcccgcgcatggtggagcgcctccgccaggtgcggcgcctcttcgaggcggtgctcatcccgttgagatcgctcaagtctattttcgatgacctcctcagtagtagcagatcaccaccagcagatgctgacgtgctgggcggcgccacctgtgacacgcctgtttctaacgcaggttcttgtgtgcccaatgtctgatgcgtctgttcatatgccaaagttaaccatatgaggctttcagttgaacctgagcatgtaagtttgctatttaaagctaaactttagttatagtttttgtctttgaggtgaattggacctcaagtttagttctaattttcaattctaggaaattttagttctaattttcagttaagccaagagctttcgannnnnnnnnnnnnnnnnnnnncgtttagtaagcgggaggtcttgagttcgactctcaacgaaagcaatttgagtttgttttatgagtaaatttcataaaactacatgttttgtggtctaagttgcaaaaaaatcacatacattttgacacttagcatttaattatatatattttggtcgtgtagtttcacaaaaccaaactatcgatgaatggattcactcgtgagatgatatagttgtttcacataggacgaggacatggtatcttattaccagccatcacacaaaattaacaggatgccacgtccccatcctagatggaacaaccacgtcatctcacggatgaatccattcatcgatagtgtggttttgtgaaattaaactaccaaaatatatgtacttaagtgtcaagtgtcaaactgtgtgtggttttctgcaacttgaaccataaactcatgtagtttcgtgaaatttactcttgttttattttatctgtgtgcttaggtagaatctcaagaaataactaatttaaaggatgaaagtcacggtgtgtcacaaatggtcccatggtctagcggttaggacattggactctgaatccagcaacccgagttcaaatctcggtgggaccttttttttctcgtaaatttttgcttgctgctgtagtctttgcgtgtgccaccgaattaaagaagtacgaattccaaaaatatcaaaacatgttacgatataaaacggatggagcagtaattgtgttcttttatgtttggaattccaaacttactgcataaccatgaggccatttcatagaagcgttgtactactaactgggctgcgttcggcagaccaggttccaactcttcctcctcgttttccacgcgcacgtttttcaaattaataaacgttactttttaaaaaaaaatttctatacaaaagttgcttaaaaaatcaaattaatccatttttataaaaaaaattaataattaattaattaaatcacacgctaatcgctgctccgttttgcgtgccggggagtgagggctcccaaacctcactcccgaacgcagtctaaactgtgaaaggtgaagcactgagtatttgatgtcaaatctcaatcatatagaaatataattctaattattttaaaaaggaaaaaaaatccattttaagtcactgaactttcataaaatctgctcctactcttcatatcagacgatgttcatactacaatatttcaaatcatttaccttacacccctcatccataactagaactagattgtttaaagcttacagggtgcttatctagcattatagtaaaaaaaaagtgtgaagtgcacgggcggtacttaaatttgaacggatgtgtcatctatgtccctaaactctcgaaatgtaattttagatcctcgatcttgtcatgtgtatcacataggtccaaacatactccaacccgctccttaagatgacatggcatgccacggtgactcctacgtatcaatagaacccatacgtcagtcgcgtatagaaaaattaagaacatatattttctcctctctttttcattttactttttaaattaaaaacatcattttctcctctctctctctctctctctcactctcatcccttttaaatttttcttttttctgtgtgagtgacatgtggatcccaccgccacgtaggagtaaccgtggcatgccacgtcagcacacggagcaggttggaacccgtttagatatatatgacacctgagacaagttaagggatccaaaatgcattttgagaattcaggaatttaggtaacacacccgcacaagtttagagacttttcgtgcactttactaaaaaaggaagtaagatccacattgattctctccttccttacctttcgtcctcatcattctctgcttggcaaatgtttcatatagcttgatgccccctccctgtatgatctcaataagggcactcacagtgcaagcacctattgtgaggtaccacaaggtgacacctagggtggagagcttcaaagacactctctccacaatgcaagcaccgctagtgggacacacatatactactttaccaaatccccaactccctcaatcattacgcccgcctcctcctctctcactcaccacgtcggctctcccttgctccctccagcagcgccggctcccctcctcctccgccggcgcggctctcctctcctccggtccgagccgagctctcccctcctccctccccttccccacgcgggggccgtccctgcttcgagcggtggagggcgacgacgacaccacagatccaactcgccgggggtcctcatctcccgaccgatggatgtgtatcttgagcgacgagatcgatgccaccctcgacagggctgtcagatttggcctggcgctaggaggagagggcggaggtggatctcggcggccgagcgacgacggtgtcgtcggggcccagcggcgacgatgccctcggggcgagcggcgaagccaacgccgctcttgaggtgccccgactcctggtgggcctgcggcggcggcaaggccttccccgcttgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacaaggatggtttgtggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgtgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaaccatgcacccacagcccaccattcagtcgcattttagttggataattacgaccatgaaacatggccaggtgtttcgagcacgcagctcaacaagatactagaaaggtctaaaactgtaattatcccatcgactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattagatatgaattttagaagttttgagccatttaaatgaatttctataattattatcgaattattgcgcaattattaattattttctcaaaggaaaagcttaagcgctgacgtcatcaaagaggccggcgccgacaggcgggccccacacgtcagcgggtcaagggtatcggtccaccgtggaccgagaccaccgaggcggcccaccattcagtccacgggaaccgacggcccggatcggcccaaagccgatcggacggccacgaggcggcgcggctggggcacgggcgcggcatgaaaccggctcggccgagcgatagcgcgcggcggcgtacggccagacgaccgccggcgacagcggcgcatcgcggcagcgggcacggggagcggcggaggaggaaaaaaaaggagaagggacggtggggattctcaccgaggacggcgacggcgagacgaccacagggaggcggctggcggcggaaagagatggtggcggccgacacgggaggcgacgggaacggcggtccgacgacgcccgaccatggcggagccgcggccgagggccggcaagacctagggaaaatattggagcggttagggagagaaataggcgaccggagcggcgagaataccacgccagagaggagaggaatggtggggctcaccggcgaccgagagataccccgttccggtgggtttccggcgaagaggggcggcggccaaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaatggggaaacggacaaggggagcacggggattgattttatagctcaaagggccgagaaaagggccgggaancgncggatttcaagggnaagtgggccggcgtcgtggggaaagagagagacgcgggaggcggcgacgtggccggattttgcgggaagagtgggggaaaacggcccgaacgtggcgggcgaggtcccacggacaaacgcgcgcgcccggggtgaagnaggtggcggnaaccggcggcnacgtggcgggttttcggcggccatgccggcaacggcagctgccggcctgaggttggggatgaccccgacaggtggggcccacctgtcggcggctcggggagaggagggagtatgaggaaggcgaagcggacttgcgcgaggagggggcaagccgggccgacggcccaaagagaagggaggaggggaaaaggagggcggccgggcccgagagggagagaaaggaggggttgggccgaaaggggcccaaagagaggagagaggattttaatttcttttctttttattttaattgattcgatgaactttgtgccattaaaactatttctcgagctccgaaaattcacggaaaattccggagagtacattagggcacaaagaatattacaaaatattcccggccattgatttttaagggaaaattttaattctcccaataattcacttgattaaattgcttaactttttatttaatttctaggaaatgcattattaaatgatttttaatcccgaacgaaaatcggggcgttacacggctcccctctcacctcacctctcccgacgagcggcggcaaaggcggagaaagaggaggcgaggtcacgccgaatcgaagcaatgacctccgcagtgcaagattccttcccccacacgccctcatttcggcgagaaaacgtgtctcccacctagggtctcagtgctacgtacgctagaatccaagctggcgcggtaggaaactcctccacgtacgaacactgtgaagggcctaagctgtctctatgtggcttgccttgcgcgagcctagtcatccaagcgctttattctgccattgccttaacctcattttttatggtctcgcatggagatcacctgttgcacctctgttcaacggtctaacctcttgaagcacgagctcagacatcgcacgggccttgccttctattgctccatgcaatgggcgaccctcacgtgtgagagcttgcttggttgtcatcgctcaactagttccacccaaagacgtacttcctcctccgtttcacaatgtaagtcattctatcattttccgtattcatattctagatttattaacatcaatatgaatacggaaaatgctagaatgacttacattgtgaaacgaagggagtatctctctattgaagtaaccatacttcatgaaatcttgacaaggcaattatttacgtgagtttcactgtgagatgtaattgcttgtatgtggaacaggtgcggagacaagcctagaacagcttaggcttgagttctaggattgcctcaatattcatgtttaaatcccttttaaatcaccatttaagaaaaccaaatatcttatcagctaagtcctacttgagccataggcttagaaattttctaacttcgtcatagtgtggaacgacacatcatgaagattagagatacaatgtttgattcaattactttttgttacctacgcgtatggctgaataaaaagaataatatgagaaaacgcaagcaagttgattttgcaacacgattatgttgtcttcttttccctatttttacattttcatgtagtgacttattaatgtgtatcaagttatgttgttggcttggcacgactatccttgtcgtgaccacaccttcgtgagctcgttgttggcttggcacgactatccttatcgtggccacaccttcgtgagctctgcctttattagtttcgatatctcgattgatggtttgatgtttgtttaattctgtaaagttatctaaattattggaaagtttggttcgaaaagtttagtgacgagttttaaacttttatgatttcttttggacgtaaaaaaagaattttctgaattctaagaaatccttcaagcggccggcttatcgctttatcgggtcgtttttttggcggttaaattatctgggtctgttcgcaaaccgacggagaagccgctgctgcaaccgcccgggccccgcgtccacgcaatcgtttgctcgcccttgattggttcgatacacgttttcccctcgtttactcgaaacgaacccacgtggccgcgctctagagagttccacgtagctctaggtggggcccacggacacgggggcccacgggtcatcctctcaagaaaaactttatttggaccaataaaatgaatttccctctttttcaatctctccgcttccgccgcggtgttcttcctcctctcgcaggagaaaatttcgctggttgaatcggagggaggcagcaatggccgctcgagctcggtggcgaatcctcgcgctgccgctcgctcttctcctagcggtcgggtcgtcgcctggcctcgtgaggcaggcgtcgtcgtcggcggcggccaagcctcccgtccccaaggccatctcggtgagttacacgaagaaatttctcctcttccaacgcccgattggccgattcgtccttgtcgcggaacgattctgatatgttaatgtaacgatgcgcgcgtgtggcggatcgatcggtgcaggacctgagggaggcgatcgtgaaggggctggggttccagtcggaggagctcaaggtgtccgggttcgacgtgcgcgacgcgctcgtggggcaggcggtggcgtacgagttcgacatcgaggtcgggaggaaggtggtgccggtgcgcctgctcgaggacgtcaaccgatgggacttcgtcgacctgcccatcttccggtcccaggccgacgccgacgacacggcgctcgccgagatccggcgtggcaagagcgggaagcgagccttcgacccgaccctgccaccgttccagctcgccgggcccatggagctctggatccaggacggcgacgacgttaggctcgccttgccggtaagagaatttttttttcttctcgtgcttatggttaaaaggatattttcatcggaatgattttgttgttattaagttgcatgcaccaaccagttcaacccaaaaactaatattagggaagatgggcaattcagtttatatttcaaagtactgtttgtgtttaaaaacgatgaattttccttcagcaatttttttaaaaaaacatacaaagtagaattaggtatcaaagctaacaatacatcgttctacacctcaaatgtgaaatgtgtcaacagttgggaaaatagagattgtagagcataacttcaggtttctgatgtcatcttgataacaaggcaaagtttcagttgctgctataattaagccacctgacgtctcatctgattgcaattcaatttagttctatgaaattatggaagtgaatttttggattacgttgataattcgtcatcgtcatttcgtctggcgtaataggctctgaagtctgaactatttgtgtgcttgcagactttgaataacgaacaccaactttgttcacgtatacaaaagaatgatttgaattgagcttatgtgttcatgtattgtaagatttcattcagcaatgaatatgatgatttttgtcctggtgagttcaagagtcagtgttctgcaaatctgcgttagtattcttcattgtggattctacaccagaatggtttttcattacaacattagtagcttcttcattgcgcgttctgctctgaagtaatgttgagcaaatctgtatggaatatcctactcctttcacagcaatggaatgtctcacatctggaggttctgtgattcctagttagctgtaaatactgttttgtgctaggcttaaactctgaatatttacaatatgtgtttttttttagactggtcaacggggggggggggggagcttttccacctgaattttgatttaaagagagatcgagtacattaagtcagggtacatttgaacggatgggagaagatagaatttgtttccaggattctactactatcctgtcggcacagttcaatctttccgcccagagagtagcatcctctatgcactttgttgctaaacgatttagaggaggagattctcctctgaaaactacatcaccgcgatgattccagagcccccagagacagagcaggaagaagaccttgaagtgtgtacaatatgtgttgttttataattcctatctctttagaaacttgacattattttgcaaggcatagttatttctaatagttgcctcataagttggtggtatagacttttacgcatttgccataatgctaacaccatctgcggcctggggttcatttaagattggtcatttggttgccattgctgtatttaaccatgggaaggttcatctaaccattatgttacacacatgcctaacattgctttactgggtgaattactttatctactatgtattttaaatacaaaatgctaatactgttctcttactatgtattttaaatacaatatgctaatactgttttctttacagcatgatgtggaagcagggacgctgaagaaagtagtgctatcagatggtgccgtggtaacagtgaagggtgccaaggctgtgagcctccggttgccacttgaattaccggtccctctcaaccgcaccacttacaagggccggttgtcaagcttgatatccattgcgcaaacgctacggggcgccgcccggtcgaaccagaagccgctgctctccctccgcatcgaaggtccgacgtcgttgtcctcgactccttccatgtctcccaatgacaggctcaagctcaaagggttggccccaggccaagtggagctctcctcgcgtgcaatccctgctgttacagacgatgatggtgatggatcacacgcagctggattgtggccccttctgtcactgaatgggtcagatggcagcctgcaggggtttgaggagttgctggcctcggttcttggaaagaaggcaggtgagaaggggacgttcaagctgttgaaggcgcgagcttctgcccaaacgtacgtcaagatggggtttgcggtggagaagaggattgctgacggagaggtgaactggtccaacttcccggagtggaagacgaagcccaagaagttgagggcgcactacgaggttcttgctcgtgtggagggtggccaggcgatccctgaaaggatcgcgcaggtgcagccttttgaggccgacgaggccatgtccgagagcgtgctcaccgggaatgtgtcgatgtcgaagacggaggtggttcatccgccgccggtttacttcactctttgagagcagttgaagctccggttttaagtgagctgatcacggtaaatgacaagcggcgaaagtttcttggcggcgagtattattaactgcattagcatgaaaaattgttgtacggggtatgttatactggccagctttgtaaattaccaaactgaataatgaatgaacgaaccattacaggaaaaggattcatccataggcaattgtatatctttttgaaaccaagagtgccaacttttcagttactgcatcttttgtttcatttcagttaaaccgacgacgtccttgtcgccgcttttgaagttcgccgccggtggcatatgtagcgtatgcggtgcgaatattctcccaggctcctggaggatttgattggataagccgctcgtaaggacaccgtgcctccaattgttttaggctgctatttgttgggcggtgcaccgtgcacgcgagtacggcgtcgcatggtcgcggccctagtcgcgcgctcgcacgtgggcacgtggctaggcttggcttcgcttctactacggcctcccctcctcaccgacaggcatggcccacacgtcaggcgtggccgcccgtctgaacctggttttcatgggccgcccgctcgcacgcagcgcgcagccaccgccatctgggcctaggttttccgggagagcgcagcggcggcgcggaagcaacgaagcgaccgcttgcgggaagggccggagccgagccggccgcgccgcctcgcccgacgtcgtagcaaccaagccacccccgctccacgacgaggaggaggaggagggagaaggatggtgaggagagggcggaagggcaaggacgcggcggctggcgccggcggcaccggtggcagaggcggcggtgccggcagaggaggcggcagaggaggaagcggcggcgggggcgggggagggggtgttcgggaggcgacgctggtgcgcgtctcgaaagtgctcgaggacttccaagcctccgacgcccagggttcgctctcattcgtttgcccaatttctccattccattcaatggtgtctggtgtgatctgtcatcgcggtgttcgagcgagttggggatagtggcacgaatacgatactttgggagcttggttttggtgaatttgaggcgatggtttgggccatgcgcgcggccatgcccattttgtgttctctcttctctgttgcattttttattagtcctcctaatgtatgattgactaactttactggccttctagtgtactgatcactaacgtcaccaatgtttgtagcttcacagttgattctgagtttggtaacaagggaagaggaataccgtctactttatgtttgaccattgtatctcacaatatgtgacatggtattttcatgattgtcagtttgtcgctagataagttggtctgttgactgactagaaagtatttcttaggttttactacaatggcatctaacctgacaattgcacttgaattgatttgcaacagtaatcctaggtggccactagactgttgtgtaaatatgcatgagaatcaactctttgggctgatattagtgggtgcaattaagctcctgcataaaccccaacgaggagtctcaagcaaaacactattaggattctgttagttcaaagtagcacccttttattagttctcttctcataacaaccctcctccctcctcccaacaacaatgaaaagaccacccgcacacatgcttgcacactctgatggtggcaatgttttcttgtatatcttcttttcacattttttgtgcatcccttgcagagccattgcttgctactccttccatcccaaaatatatctacctttctaattcaaatttaaactagaaaggtagctatattctgggacggagggagtaggtcatagcatgtgctgtgctgtggtgttttttcttcccttgcgttgtttgcctcgactgagttttagcacattactgccccattatggtcctgcatggtagatggcatgtttaggtttcttttggtatgtggggaacttttcctgttattcttgtgaaattcctggattccaaacaggctcctatatcaattcctccactacttgtctctttctttactttttaatgaaacacacatgttttctctgttatgctgtcagctgaaaaagtcacgtatctacaaaattttactttgcagtgtacaaatttgaacctggcatatcgaaacaagagcgagcggcgatacatgagatgtgtagaaaaatgggcatgatatccaaaagttctgggtgagtgatagtctaattgacctctggaatgatgcattccgtacactggttctagtaaagagtaataagcatcttttaaacttcattcatcatagcgactgttatcttagtaggattaaactatgtgtatctgatgttttctgaaatctattaattaactataggaatggggaacgacgatgcctatctgtttacaaaagaaaacagaaccagggccttgaaacagaagaaggacctagccatcttggattttctgtggaagcgagaaatgttttgcaagatctatttatgcattatcccccagatgatgcggagctaaatgggcatactgtcaggaattctagtgataaggctgtaaagattcagtggaagccagatggtgcattttgtaggccagcattgcgcaaaccggatatattgaagaaggtggagatgcttgcatcgaaagtaaataaatccgaacagttgaggaaggttgtatattctggcaatctggcttgatatggtgtcctttttgccattcagtttagccaattcctacttttatatatgttatattggatagttttatctaattgaacttagtgttgtacatttatacagattgtccaagatagatctaaacttccaatttcctcatacaaggatgcaatttcttcgactttagagaatcaccaggtattgttctttgtgtttttatggaaataaagttgcttcactcgagcttcatcctgatgcatacatcaaaggtggtgctggttgtcttttctgttggtggcggggctaatagcaagacattctatatattaccttgtaatacttcaagacaaatcaagaaattactattattttcttgtttagtagtttcaattcttggtaggcttgactgctttccaataatgggtggatgcctcttcaggaaaatgcttatcactttcctgaacctagctatttattttgatccatgcttatctttgacatttgccaacttccagaatgaacatttcctttaacatgacctgataacaatttgaccttcatccctgtcaggtggttcttatttctggagaaacaggatgtggtaaaacaacacaggtgccagttcttttgacttttgttttgctctgttttgaccatgaaacaactattgtatgtaattaacttcactgtgacatttcctgcaataaattcagatgtatcttctcattctgttactctgtgttgattaattgatccaatctatgcctattttctgctattttgatattttactttgtgtttgttgttatcgtgttatatgtattaaaacatcctgatttgtgagaaatttcacaaaatcgatagtcaaatgtacttcttgttttagtgcccatggaatgatgtggacacctttctttttcttaaattatgatttccttggaatgatattctgcttatctggctcactcatcgtaccattctttttttaggttcctcaatatatcttggatcatatgtggggtaagggtgaatcatgtaagattgtatgcactcaaccaaggcgaatatcagctatctcaggtaattctgtcaaatgacttctctttcattgctattgtttttgtttaagcagctgagagtcaaatgactcatgtacacagttgctgagagaatctctgcggaaagaggagagtctgtgggtgacacagttgggtataaggtatgccaaattttagaattttctattatgcatttctggactgaaattgtacttattattcatctgtttgaaaatgacacccaaaaaatgttatcttttttttttttgaaaaagaatgtttttttacgaaactttgcccgtaaatttattgtgtagtttatccgtacagtgacatgtctatgataacactaaaatacttgtagatatgaatttgccttggttattttgtgcaaacaaactttgcattgtttgagaatttcttggtagaaattgacaaagtttactcaagaaacagtatcagtatcttgtattttgaaacgagtaaacaccagttttgttatttcgcttgacaaagttgagaaagtttgtaatttggactatgttcttaacttcaattttcgtccttaatgttcatatatttgtcatctatgacatgtttgcacttgtgcacataatgtggatatgtacctctgtcttattccgctgtttatttcaattgcagatacgcttggagtcaaaaggagggaagaactcatcaatcatgttctgcacaaatggtgttcttttgaggctattgataggcagggtaactaatatttcaaaagaacaaaatcagaaacgctcatttgatgatgcagttactgggataacacatattattgtggtaatgtttaatcttagaactttcaaatagcttgattgcaaattattgtattctgaactgcacatactttacactccttattttgcaccaacactgcatccatgctattagtaccaacaagtagttaaatatgatgctttttgtacaaggggggaaggagatatttaatcaaccactgggtttgtatgacactagacttgttgcagaaacttaactctaatgctctaagtagatctatgacaaccagaaattattttcccgtctagtgtgaaattatttctttaatattataactgtacttgcatttcttttgtagtttgatacagcgtattgcagaaaacatttaccaactgttcctttgtaattctgagagggcagagcatttggtgagcattaattgcaaaatggttatgtcagtgcttacctattcaaatcttgttatttgtttagtactatcttagcaccccttagcattgtccattgaatattgttgtcattgttgaactggggcaagtcatgcatcaattagatgtaagaggtattgtgcaacttagtttataactctattgcaaaaataactggaatggaaatttatgattatttgttattgagcttctaatagcatactgtcttttggtgaaatacaatgttttttttaatcttggaaagcttcatatattattgtgcttcagaactggagccttatacaaggcacttccttactgaattgattttcaatggcatatactgccagtatatattttattggtaatatgagttggcactctccttttctctttaggatgaaatccatgaaagggacaggttttcagatttcatgttggctattctaaggtattatgctaaaagctgtttcgtccacatgttgcttagattgtgtttttagtgctttaacgatcttttgccaaacaattatgtagagatttgctgccgttgtatcctcatctgcgtttggtaagaagatttttccttctagtttaaggctctatagtaataactacacacaatcatgcatcctctatcatgtatccaaaagattagggtacggctttacaaaatcctctaccagataactgtgcaaaagacaaaagttagtccacatcttttgttagtttgtctctgttgttatttttgcacagtacacatatgatcatgattttgcacaaattttgcaattgcactcgtggcatggtgctttacatctacgaacattttgttcctttttcaagttcacaagacaaaataggttcatataccccaaggaacacagaatccatatttccattccatatttgaagcacagaatttcttctgagtgtatccgctttccgttacatgagtattaactagtttaatgagcaggtactcatgagtgcaacgattgatgctgagcggttctcaaattatttcagtggatgcccatttattcaagtcccagggtttacccatcctgttagtaacacactaatttacattttgttaagaaagatattgaagtaattgatggcaacattggctcttttttctcaggtcaaaactttctatttggaggatgtgctttctattttgcaatctgtaggcgataatcatcttgatcctacaacagatgatctgaaacagagcagtttgttaacagatgattacaaaagctcaatggatgaagccattaacctagctttggataatgatgaatttgatcctcttcttgagcttatttctgctgagcagaaccaagaaattttcaattaccagcactcagaaactggtgtgacacctttgatggttcttgctggaaaaggtcaggttggggacatttgcatgcttctatcatttggggtggattgttctacacgggatcatgatggaaaatctgcattaggttgggcagaacaagggaatcagcaagaggtttgcgaagttattaagaaacatatggaatgtggttcagcaaagttaactgaagagaatgagctgctcaataaatacttggcaaccatcaatcctgagcacatcgatactgtgctaatagaacggttgctcagaaaaatttgtgttgattccaatgaaggagctatcttggtgtttcttcctgggtgggaagatataaatcaaacacgggaaaggttgcttgcttctcccttctttcaggattcgtcaaagtttcttgtgttgtcactccattccatgatcccatcttcggagcagaaaaaagttttcaagcgtccaccagcaggatctcgtaaaataattctctcaaccaacatagcagagactgctgtgacaattgatgacgtcgtatttgtcatagatagtgggagaatgaaagagaaaagttatgatccatataataatgtctcaacacttcattcttcctgggtttcaaaagctaatgccagacaacgtcaagggcgtgcgggtcgttgtcagccaggaacgtgctaccatctctactctagatttcgagcagcctcattactggaataccaaatccctgaaataaagaggatgcctattgaggaactatgtttacaggtatattcctagctaacctttgtagatttgtttcctccaataactcttgaaatcaatacttctgcaatattatggttcgctgcaataagaatgacatttatttactgatagctgttaaatgtttcaatctgtattatgcaggtcaaactgcttgatccgaactgcagaattgcagactttttaaggaaaactttggaccctccaattccagaaactgtaagaaatgctatcaccgtacttcaggatcttggtgctttgactcaagatgaacaactgacagagttaggggaaaagttgggctcccttccggtccatccatctacaagcaagatgctcttgtttggtatattaatgaattgcctagatccggcgttgacattggcatgtgcagcagattatagagatcctttcctccttccaatggctccagatgagaggaaaagggctgctgcagccaaagttgagcttgcttcattgtatggtggatacagtgatcagcttgcagttgtagcagcaatggactgttggagacgtgccaaagataggggccaagaagctcaattttgttctaagtattttgtgtcttctaacaccatgaatatgctttcaaacatgaggaaacagcttcagaatgaactagcccaaagaggatttgttcctgtagatgcatctgcatgcagcttaaatgctagagatccaggtacttttctagaaaaaattgagttctgaaacatattctttgttcatgtgatttcttttgtttgtttccactttgctttgcttaactatagtatatgcatggttgagggatacatggtattatgtaagcagcaagtaagttgattagttaagtccctagtatataatatactcagtgagaagggtgttccttttcaggatagctaactagagttttccatggttagttacaaagaaaaaccttgtgtttctatgaattagtcttgcaatatgttcacgcctatattactagttcccatttggatatattgtaggggatagtccatcccctgattagttgtattgtagattagcagttccttaagcctatgcacagcagggtttattagttgtattgtggattagcagttccttaagcctatacacagcagggtttacaacatacaaggtcatagtgcacagagtgtatatgaataagagaaccaatctaaagttagtacaagtagctactaagttacatatatcactctaaagttagtagctactaagttacatatatcattcactgtattgtagagttttccatcctttccccgttcaatctttttaattttcttcttacttctaattcacgagcaaatcgtccttgccttttctttgtagtaaaattatttttagagtatttgctggattctatttttattcttagtaaaattatgtagtaaaatcagttgtcacccgaacttcatcaatcttccttagttcctaacaaattatgctttattgcatcaaagttttaattgttctattgtacttaactgacttctaaattctgtaggtatcattcgtgctgtccttatggccggtgcttatccaatggtagggagattgcttccccctcgcaaaaatactagaagagcagtcattgaaacagcaagtggtgccaaagttcgactgcatccacattcttgcaactttaacttgtctttccgtaagacttctgggaacccattagtgatatatgatgagatcactcgaggcgatggtggaatgtacataaaaaactcttcggttgttgggtcctatcctttaattattcttgctacggaaatggttgttgctccacctgaggacgatgatagtgatgaagaggatggggattctagtgaggatgaaactgagaaagtcactttgggacaacataaagagataatgtcttctcctgataactctgtttcagttgttattgatcgatggcttcggtttgatgctacagctcttgatgttgctcaaatatactgccttagggagcgcctagcatcagctattcttttcaaagtaagatttttatatcttgcatcatctaatttaagcttgattaatgcaatacaacttgttccttttgtattctctctttcatccaatgttttctaagatgccatgcatggttgccagcatattagcaaacttttgttttacatttcagtctgcacactcccactgtcccactctgacccccgagttttcctttaaatatattgtgttgatttttctccagtgcagaaatctggataataagcatacatgaaaaatctataaggcatgtagatagactgcattgccttccgttgttcattctgagttgtctcaatcagataatggatctggatcaatagatcatcatactgctttctgcatcattcttagtacctttatagtccaattatttctgaaaaaaaatggaattatttttctcaggtcaaacatccacaggatgtcctcccacctgatcttggagcaactatgtatgctattgcgtgcatcctatcatacgatggcttgcctgctatgattacatctgatgatgttgctacaagtcagggttcaaaccaaagttcagctgaatcaagcagattctctcagggtcgtagagtcggttatattccacctggcggtttcctcatgtctttgttatcggataaacctcttaatgcgcctcattttcagaagtcctttaatcatccagatggagcttcagggcatattcggtcatcgaggacctccgtcggtagatttgatcagtctcgccatcctcaacgtaataattctggacctgggagttcagcagcacggactttcaaaagacagcgcaacggtgcacagtgactctggactagcggccgcgttttgcagatccttcggctatgctggaatattggatgaaaggcttttgtggcagaaataaaggattgctgtcttggccgggagttaaataggacttgcagccttcctttgttgaagggccatacgatggcaacgtgatgccttgagctgaaatcataatccagaaacgctgttttgctggtgacttgcagccttcctttgttcggtgcacgttgctattctgttcagctctgcttcccaacttgagcgtgccttgtaatctgatggcaaggcgacgccatgccatgccacagtccactggtgtctaaccaccaaattgtactcgttggaagagtgacccatacaggctcaacgggagtctgaattctgatgtccctcatacagccatacaggagtagtaggttggtagtctgaaacttttgttttgctctgatgatgtacgtgaagaagtggtgtgtttcccttcttcgacctatggttcttttatagtactggagtagtacagtagtactagtagtacatgcgcctaaattctccatgccatgtgtaaccacagtgatgttatgccgtgcgcctaaattttcccgttctggtttgagatagcagtcgcacccagagacgctgcgggcctgttgggaagctggataagcagctgagctcctgataatctggaaaagttgggtttcacaacttctggtttttaggttattttcaggattttacaaatatagcttctcagaatcattgaaagctagactatttagggagcttctgattataagaggaactgcagcaattccgagagaaactgcagctagaagctcctccaggaccggcctctcttctcttcgtgaagaagagaaattgagtgaaatataattgctcttgtaccaatggggcactactagcacccaaaaaataataacactgtagcaaccttgtagtactccgtaatgcacgtgtctctcaggaccacctgacctgagattgaatgtctagcaggtgccaacatccgcccgtttggaacacggatttgccacgcccatcacgttacatagctggcggatgtcgacgtgttttaatggcccaatggcaggtttaatactcgtacgtgaaaaaaggctttgctcttgtacgggcatcgaccagtgggcagtggcgccatcatgttttcgccgtactacctcgttctcgacgactcgtgccatactgtcatgcgaaactattttgtgatatgatcatcgcagtatacagcatctgaccagtactactactgattagaccaataattgcctcctattgtcagcagattattgttttatggaggatatatttgtagaatataattggaatggttcacaacttcacatctcctgcctctccaatgacatagtacaaagccagaatacgatatagagtggattgagatcggtgcagtcgtaattgcgactgcaccttaggactgcatccattttcagctatttatttttgtgatcaacagtacagatcaactgctaccgtactcgtgctatagtaccctgaacaatattttatgtcgtggtacttttgctacagcaaccggcctaatccttaccgttggatttagatccaacgtagcagctacagctgcttaagttacagtccatactactactgcatttgatccggatccaaatagagtcatccgaagtgaaataaaggactattgctacaatagcaaaacgcatagaccctttagcaattatactccctccgtctcaaaaaaaagacaaactctaggcttccgtgtccaacatttaaccgtccgtcttatttaaaaaaattatgaaaaaaaattaaaaagacaagtcacgcataaagtattaatcatgttttatcatctaacaacaatgaaaatactaattataaaaaaaatttcatataagacggacagtcaaacgttggacacggaaacccagagtttatcttttttttagacggagggagaattttgtagataagaagtgaaaaataaaggactattgctacctttcgtttaatgttatcaatcattttagcaaatttcacattaaacatgtagatgtctctaataacaaggttaccctcattaactatatcccaaatgtttcctaaagtagcagtagttgcctgcattgacaaacagagtagagatggaatgccacctctaaaactcatttgaaatgtgagagtgaagcattttgtatcgaaatgtgagagtgaagcatttcgatacaaaatatgaatattagaatgacaagtaatctacaataagagtagtactgattttaacagagtagtacaattgtgtataatatcttaggactcttaaattcgttgtaatatagaactaatgcaacaaaattaaattttatggcaaccattgcgataaacatcgtggtactaataggctattgcaataaattagtagtccttacgttaattaggagcaaccaaggagcccttaggtttattagggacaatgaagggaacaagcccgggtgctcaagtgaaaacgtcatagaccaatagattacttccttacattgtgattcaggtttcgatatagctcattgctgacatcggccgtgataaatttatgagcatgctgagctgggatcatggcgttagcaaagttatattcacaccacgtatagccgagtcaacaatcaatcaatcaaataaaatagtacagtacagtacatcgtgtttccgttactacgttctaaaatagctgctgctttttttaatcgcaaagaagttctctctcttttgaggacgcaaagaaaggttgatgctttcgccattcgcaagcgtaagcatattttgctaaaaatgctccggtgggggagagctgtcgatcccatctcaggagtgttttatattagtccccaagtcttaacgactttaaaggtcggggagtcctggtcaactttgccatgaccgcattagtttattaacaccccacgactaaactacgtattcctgcaattttcacaagatctaaccatcacccgtagttactacttcttccgtcttataatataagagattttaaatttttatttacactgtttaaccactcatcttattaaaaaaatttaaaattattatttactttttcttgacttactttattatctaaagtattttaatcacaatttttttgttttttatatttacacaaattttttaaataagataagtggttaaataatataaataaaaaattaaaatctcttattttatgaaacgggggagtagtaggccgtagcgtctccaaactctcgtcaggtatggacgcgatcgcgcgcaacggcggcgcacggcgcccgcaccccccgtgccttttaattaactctccttttgaccgtgccaggttaacctcacctcgcgaagcgaactggtctaccacaccaacacgaccacacgacacgatcgaggctcgcatggattttcgcattttcggtggacagagtagggtaggggcgtggagaggggaggtgagcggtggtgagccacacgagcagggcagcgcagaggatcgcggggtgcatgattgagcggaggggggaaggggtgtggtggggtcagtagtacgggagggggtgagcggtcggtgacgcggggtgagtccgcgtcagcgatgcctacctccgcgcgcctcacgtcacccgcgcgacctcacccgttcacgcgggccccaccaccaccaccgcctccctcgccgacgccctcgtttcgtacgactagaaagaatactccataatagaagagattttaagtttttttacattatttgatcactcgtcttatttaaattttttttgaaattattatttatttttttgacttactttattatccaaagcactttaagcacaattttttgttttttatatttacacaaattttttttgaataagacgagtggtcaaacaatacaaacaacaactcaaaatcccttatattattatattatgggatggagggagtacaatacagtactcctacgtactaaaaaaaccgggccgatgccatctttccgctaaaaaaacagtcgcgcgcagcgcagcagcagctgctgcggccggccaggcaacaagatgcaccgagttgccgagcaaaagaaaaaaaccttggggagatcgcggcgcatcgcggttgcgtctccgcgtcccgcgaccacggattttcctttttgcctgcgccgtttgcgttgcacgcggtgtgtgtgttacggcaacttctgtatcgtgtacctacgggacatatcggctcggcatgcgcaaagacggggaagccgaccgagcgagctggagcctgggaggaggagaggaggaggtggtgatttcgacggcctatccacagtacacacacgcgcctgcggcctctgccctgcgctgccccgccacctgtgctttggagacctccgtcccatattactcgtctttttaagtttttatttgtcaatgtttgatcattcgtcttatttaaaaaattttagaattattatttattttgtttatcatttgctttattatcaaaagtattttacatatgacttatctttttttatatttgcactaattttttaaataaaatgaatggtcaaacgttataaataaaaaatcaaaaatgtcatctattacgagacggaaggagtagtaggagaggataacgctgggggtttgcctctcttggccagggcacgacgtgatggcgtgagcctctcaccgtacatgtcacgtcgcgataaccatctgtccggccgctttctatgaggataaccacaaggaacagtaaaactaatcctgacaatccatgctattacaccgattctaaaatatatagtaattttaactacaaatatgaaggagcataattattttattttttaagctgctatattttaaaatttttacttttgttcaaattgatggttacaaattattatattttagaatagatggagtactgttattttcttcgagcacaagatcaacatgacaacattaacgtttggattgaactactttcttattcaacctaaacacgctaccaaattgttgaacggttattttttcaaaaaaactatttatacaaaaaattattttaaaatgataacattattatttaaatttgtaatagttaatagataagtagtcgttcaataatgatttatcttacggataagtataagctaacccctcatttaaacgcaaccttgttaccgctcttctggcaggatagactcaaatctagaccaataaatttctcacttgtttggtctaataggaattagggaagtcccaactctctatttaggatagtacttatagcattaactacattgccatgtaggacttttaacttatgtggtaccatattaattaagagagagagtgaagagatgaagaaactgggtctcatgcaaaacacagcttcaacacgagaacctatgcactagacactatcaagttttgcattgggagagaatattgtcttcataatagatgaagaataaatatgattggtagagaagagagatggtgtatttattaatggcccactttaacaaatcatgggttgtgaagtgtagtttctattgtgatgtcttattgacatggcaccatagacactgcttatggacactatgagttgggactgcccttatgctatcatacttatcacgaagaaaatgattttactggtctaaaagtatgaccaaaagttactataccttttattttagagtaaagtgtattagcggttcttaatcttatagggttgtgtcatataggtccctaaactctgaaaatggtctcagaacttgtcaaaatgtatcatctaagtcccaaattgacacatcccctttagatcctacatggcgctgatgtggtgtgccacatggacgtgacgtgtccttttattttttttccttcttttatttttctttttcttttccgttttcttctcattcttctttttttactttcttctgctcgggtcacagagaaaggagaataaaggggaaaaagagaagaaaaaaagaaaaagaaaaaaaaaataaatgtgtcccatttgtcagtcaaaataacaccacgtcatatttgtgtggcatgccacatcaacgtcacgtaggatcttgaagagggtgtggcgatttgagatctagatgacacactaggacaatttctggaacttgaatatatatcttgagagcttaagaatctggatgacacaccttacaagaaccgtccgtacactgtactttttttttattataacggatgtgttactagtaatttgttagggtcacctcatgttcgtgatctttcaacaacaagatcgtgtttaattcgacgaaaatgaccggtaatgccgagacaaggtggtgcaggctagtagcggtgaatgccttagatctctagtcagttttgtggtgttcgatcaatggatcagcccaacatcattagctcccagaggtatggtggaacgccacaggaaaggcgtgtgaagagaggcgatgccacggcatagcggcgagacgagagagagatagagagagagagagagagatgtggacggccgcagtgcacggcaaggaagggtacagactcccggtggggtgaccggggggtgaggtgatgtgtatggcaaaaagaaatgaaggagatgtgttggatgctgactgatctgaacagtagtgctactggaaaaatttaagctattttcgctcaataaaatatctaatactaggtgcataggaatatctgaacttgcacattttgagggctttttacagcacgtttaaattacttgatgctgtgagtgtacagcacatgaatggaatttttgtagactctctattgtaccacatactcatagaaaagagtctaatactggttgacaaataaccctactattggatctagattgactaaaatcacaaacactaaatagaaatagacttgccgtttgtgtagcgatgtatgtactctctccgcacctaaaagatttgtttcacagagactattttctaagtagatgtccattagatctttaatagtattttttttcgttttaaccttcaaacccagttgtactcccttctcttcctcatctttgattatcttaaacaatatcaataatattcttttatgaatagtgtgagtttaaaataaagtataccttttcctttaaaaattactagtttttaagttttttacttacagtatatattttttattaagatacatattttacctatgtttttttaacatgtttttaaaacagcttaacgatgtgtttcttaaaaacattttatgtataaaaattgctttaaaatataaaataaaaatactttcaagtttataataatataaactcatatgttaatagtttttgtattttacgtgtgtgctgacatcatcttcgtagcctcaaacacactctaatttatatttcacatgtattttactcatactatttcccaaaggcacgagagaggacggcaacaacaaaaagatcctcgcctccccacacctgaccctacccatcaaaatcctcctagacaactcactaaattatataccaccagtatgaaaaagaaactaaaaaaccatttttaaaaggtcccagatgaagaattcttttccaactcgatcccaacagaagaaaaggaaaaagaaatgaatagcaccgaggagaggacagacagaacaaatccatcggtctcctcctccctccgatttccccccttcgtcctcgtcgtcttcctcccatttttttttcctcctcctcctcctctcatccctcgccgcgagccaaagcccctggtttcctcgcaactgcctccccgcgattccgtttgacccccactgttcttctcccctaccaccaccaggtcgcagtcgcttccaatttccaaataattccctccactccggccgctcgcgaggaaagaaaaggatttctttttctctctctctctctctccccctctctccgagatccgtttcccaaacaggcggggggtcgaaagtgtttggtactttggtttggggagcttgtttgccgacgcggatctgcgtggagacgagcagaggggggagcgccggaattgggtggtttggcccgggaggcgccggaaagtgggggagcctttggattccccgaacccgccatggtgatccggcacgagtagtagtggtggtggtggtattagtagcagtg

SEQ ID NO: 30743 - DNA, 2274 bp, Oryza sativa
  unsure (1)..(2274): unsure at all n locations
ctctcgaacgggtctagcccgtgctcggtctctcttgcgccgccgggggcaggggcggtgccggtgcaagcggtgccggttgcccgcggggagggcggcggcggcggaggaagacgaggaagaggagggagtagtagcgtggaggtggtgagcctagatcggcttagcgctaacctcgagcggctcctcctcgattccgacctcgactgcagcgacgccgacgtcgacgtggccgacggtggcccgcccgtgccagtccaccgttgcatcctcgccgcccgcagcaccttcttctacaacctcttcgcggcgcgcggccgcgccgccgatgggcctgccgncgncgacggcgccggcggtggtggggagggaaaaggactgggggaaggccgcggtacaagatggaggagctcgtgccgggagcccgcgtggggcgcgatgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccaggtgagatacaaaaggatgctcttcttgtgcttgttaggataccaaaaacggtagctgcagaactagaaactgttctgtcaccgattatatttttatgcaatctgtatttgatggtgtaaacatattttcaaccaatttttgcatgcgaataacttcaagctgcacgatgtcttgagtctggattctggaagtcgttcaagcacataggctgtgttacataagcttgatagcttgtaaacattgctctcaagtccccacttcagatcttctaactagattgtgttataccttttttaagttgaaagaaacttgctaaatctatattgggttcgattagaggagctaggatgcagtcctggtcctggtgatgtgtatcagtgtgctccagattggttagtggactaattagcttggttgtctcagcttatatagttcaacggtttatgaatccactacatgtccaataacccaaagtcttttagcttatatttttatgacctgttgtttaatctgggttaatacggtcttcttctaccacagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacaccgtcatttcagaccctgtacatgagaaaagggtcagaagaatccacagggcactggattctgatgatgttgagcttgtgaagttgcttcttaacgaatctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctgtatcacaattgactgctgatggccagagtgcaatgagtatctgccggaggttaacaaggatgaaagactacaatacaaagatggagcaaggccaagagtcaaacaaagacagattatgtattgatatattagatagggagatgataaggaaacctatggcagtggaagattctgtcacctcgcctttgttggctgacgatcttcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30744 - DNA, 263 bp, Oryza sativa
cgtgcgccgcgacgtcgacggcgaggaggagcacggacaggaggaggaaggcgcggaggaagccgtggaacctcgcgcgcagcgcggggctctcccccggcggcgccgcggcggcgtcgtcggagtcggtccgccccgccgccacccgcctccgcgcggccggcgcacggacagcgccgcggacgccgcgcccgtcagcttccccgccgcccggtgcgccttgagcagcagcacccacgtgatctgccgcgcgttcttccccc

SEQ ID NO: 30745 - DNA, 256 bp, Oryza sativa
cgctagggttaggagtggggcgcggagcatgagcgcggctcgcagtggacgcggcgcgcggcgggcccacgcgcagcctctcggttcttcgtgggccgcgcgcacgcgagtggggatggagggaacggctgaccggggtcggcttgacccggtccggccgagctggcgccaacgtggtgcctatgtggctgccacgcgggccggctggaggaggaagaaggcaccggccgcgaatagacggcgggcggcggcggtt

SEQ ID NO: 30746 - DNA, 416 bp, Oryza sativa
ggattcgtcttgggcggcggcggcaatggcaccggcggggacgacctgtcggcgctgctggctttcaaggcgcagctctccgatccgctcggcgtccttgccacaagctggacgaggaacgcgtccttgtgccgctgggtcggcgtgtcgtgcagccggggcggccgcgggtggtcgtcggattgcgcctccggagcgttcccctccaaggagagctcacccctcacctcggtaacctctctttcctccgtgtcctcgacctcgccgccgcaaacctcactggccccatccccgctaatcttgggaggctgcgtcgtgtcaagattcttgatcttgcccataacaccttatcagatgctattccctctgcactcggcaaccttacaaagcttgagtattctatagtgtcacctaaa

SEQ ID NO: 30747 - DNA, 64812 bp, Oryza sativa
  unsure (1)..(64812): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtaagatattaacttgcacttaccgatcgagagtctcctcccctcgcctctgttcgcgtgcgctgcacacttcacagcagcacggctcctctgacctggtgttgtgcagtgcctgtactcttcgtgaattgataccgtagagtagattagcttcctcctaatccttgacctacgggcgcgtgatggccaatcactgccgccgaattgattaattcggcaaccgacgctaaaacagtatattgatttcggtcatacagaggaccgaaattctctccccagcgaagtcgccacgctttttttttttttgtcaacataagattacctaacaatttacggtgtaatcaactgaagttgtcaaaatcgataaatcaaaaccggctagcggaaccgattttaaaattaattcactttcacggaatcaagcgactaatttacaagcaaattagtaaaaaggataaatatcgtacttacgtgacgacgaacgactagtttccgagcaaactagtaaaggataatctcctcgctttcgtggagaagcacgaccgtttttcagcgcaaaacggtaaagattaaccaaattccaaagctgctagaactcagatacgaaaatgaaatagaaaataactaaaacaaaagaagatgaatagtgattgataattgttcggattctcccgttctactgttaccgatatatatgtcggcaaaataataatggccccccacagaataaacaagaaaataaactaacaaaaatccattattatctttagcgccggacgcgctaattcaccggttcccatctcctgccaaccgacgccaaaactctataacgcacgcacgcgggacacagctgcacccaaatttgtctcggtcagcaacacgaactcctcaaggatctccaaatttgcatgcatctgactcctgctctgcttctgcttttcagactgacatcaagcaactttaactccctcacatgatcaaatgataaagccaccctccaatttacatggaaccatctattggatcacaaattcctacacatgtaaactgaattgattccaaccaaatcataagataattgcaccatctattccaaaataatttggcatgcacaaatgaactaaggctgtttttgttcccttcaaactttcaacttttccgtcacatcaaatatttggacatatgcatggagcattaaatgtggaaaaaaaccaattgcacagtttgcatgtaaattgcgattcgaatcttttgaacctaattacgccatgttttgataatgtggtgctacagtaaacatttgctaatgatgaattaattaggcttaatagattcgtctcgcagtttacaggcggaatctgtaatctgttttgttattagtctacgtttaatactttaaatgtgtgtatatatacttaaaaatactaaaatggaactaaacacggcctaactataagccaaattataaacagcaggaataggtagccttgcattgttccccagaaaaaaaatataatatactctaagcaaaagtttcaaaaagaaaattgtatgttgccggattttcgcgtgggctgggtgcgaggggtacagcggcgctttaaggtataattgatcccagtatatttattctgatttttttacatgtaagcacatgcatcagtttaattctaaatataaacacgccaaacccatatttcaatatgtagacaagatgctcgagtgcaggtgttatttcataacataatgtccaagcattgttgcatacttgcatatataataacataatgtccaacaaaataataggccattgaattgagttatgttactttgtattaatgtttgacatatttattaagtatggttcaaaatatgctattttgcatttacaagtcgttattacatattttttaagtataatctgaatatagtaatagactaaaaaaattgatactccctccgtattttaatgtatgacgccgttgactttttgacaaacgtttgacctttcgtcttattcaaaaaatttatgtaattataatttattttattgtgacttgatttatcattaaatgttctttaagcatgacataagtatttttatatttgcataaaattttttaataagacgagtggtcaaacgttggttaaaaagtcaacggcgtcatacatagggagtactagtttacaaataaataagtttacattactgggctgctaactttgtgaacgttgttgctaggaacaagattgcaaaaaggtccatttattttgttaggcattagatcgagggattgacgtggtcttgtgcatgtatatgttagaaatggaattacgaatatggtgtgctcaaatacgtaataaaagggctgcatgtgtttagattaaaaaaatcggacagaccgtttatttaatttcgtagtactaattaataatcaatagctgtactactagaattcgcatcgagattctcttctctagctaccacccattttcagtgctacaaattaaatagccatatgcatgccctaattaagtaattaattaaatcgatactccctccatactcgtaaaagaagtcgtttaggacatcgacacggtctctaaaacataattttgacttcttatttctataaaaatacttattgaaaaatgatatatgtacatttttatgaaagtgtttttcaacacaaatctatacatataatttttacattttcaaactcaacaacttgagagttattcatgatttatattcctaaggtttgacttaaacattgtcctaaacgactttctttatgagtatggagggagtatgatcgtgcctgttgggccgggtcaatgaattgaagtcgtcgtttgtctcgtttattaattttactccaacgacgtgccgcgtgctatatatagacatacatatgcatgtactcctatatgctaagaagtactaagtctcagtgatatgctagcttagtggccatggcaacaaataagcgagtagtggagctggagcgctgcatgttgattggcgtctgtctgcttctgctatgcctcctgcacaccgctgaggcgcagttgatgcagcatccgccggcggattgcccagaaacgtgcggcaatatagctatcccctacccatttggcattggcaacaattgttccttgctagggccggcaggcgacgacttcaccgtcgtatgcaatgatagctacaacccaccaaggcccttcaggggtgactatgagatcaccggtatcgtgctggaggaaggcgtgttgaacgccagctacacagccgtgccgtatatctgctatagctcgcccaacacctcccaacaattcaccatgtcattcgacctcgccggctcgcctttcctcatctcgacgacaggcaacaagttcacggccatcggctgcaacaccctggcgatgattataggcaaggaagatatgacctactttaccggctgcatctcctactgcggtggggatgtacaaaaggccgcacccgatggctcgccgtgcagtggcctcggctgctgccagactgaactcacgccggagctcagcttcttgaacgtcacctggggagtcgatggccacaacgacactacaaatagtgcgtgggattacagcccctgcagctacgccttcatagccgataaaaactggtatacatgatgctcattcattaattaattaattaatgttgtcatcatccacctatatatatatatatatatatatatatatctatatatgtatgtatgtatatatacgtatgtatgtatatgtatatatgtatatatatgtatatatgtatatatatgtatatatatgtatatgtatgtatgtatatatatgtatatgtatgtatgtatatatatgtatatatatgtatatgtatgtatgtatatatatatatatatatgtatgtatatatgtatatctatgtatacatatatgtatatatgtatgtatatgtatatgtatatatatatatatgtatatatgtatatatgtatatatatgtatatatatatatatgtatgtatgtatatatatgtatatgtatgtatgtatatatatgtatatgtatgtatatatatatatatatatatgtatatatatatgtatacatatatgtatatgtatatatatatatgtatacatatatgtatatatatatatatatgtatatgtatatatatatatatacatatatatacatatatgtatacatatatatacatatatggagcaccaaacaaatttactatatataactatatatatatatatatccctgattcatatatcatctatctatcaattatattattaagacaaccttaaaagaagatattacgtttaatgtggaggttagaaattctcacattaatagaagaaaaagaaaatgatctaaacttaaagaaatataatctaatagttgtatatgaaatccagaccttatataaaaaatctaagagttgtgatataatatatacatacacacacacatacacacacacacacacacacacacacacacacatatatatatatatatatatatatatatatatatatatatatatatatatatatatatatatatataatgatacctatagaaataaaaattcagagttgtatgtaaaatccaactagttccatgcaaaacttcacatggcaattccctagttctattattaagacagccttgaaagtagatatcgcgtttgttgtgaaggctagaaagtcccacattaaacaggaaaaaattaaaaaaatagagttcaagtaaaaatataatttaaaattaactaaaatttagaatataaataaaaaatattgaaagaacaaactatctagaacacaacacgatattaattaaaagtatgaataaaataaattttgaatttacttagaaaagaaaaatgagagttcaaatatgaatacaatttagaaataattaaaactcggaataatatataaggaatattgaaataacacactatacatcatgagattgattaaaattcagaataaaaacataatatatactccatctgtttcaggttataagacgttttgactttggtcaaagtcaaactgctttaaatttgactaagtttgtaaaataaataataatattttcaatccaagacaaatttattatgaaaatatattcaattattaatttaatgaaactaatttgatattataaatattactatatttgtttataaacttagttaaacttgaagtagtttgactttaaccaaaatcaaaacgtcttataatctgaaacgaatggagtattttctaaaattagagaaagaaaatttagagttcaaagtaggaatacagtttcgaaataactaaaattaaaaaaacaaggataaaattgagaataaataaaaaaatgagagtatggtaggaataatatttggaaataatggaaatttagaataacaaaataaggagtatcaaaagataataccatctataacacaacaggagattcattaaaattcaaaataaaaaaataaattgtactatattatactaagagggaaagccaaggggtggaaactaagtaggggaatggtgattagcaatacttctaaaaactagtataaaaataagacccgataactattaggtttgatttttaaaatcctagtgatagtaaaatggaggggtaacaggctggccagaaaggaagaatagggtggcagtagttgatagaacatctaaaagttataaaacagaatgccaatgaaaattataggtttgatttttaaaatctcaataacaataaggagtagaggtgacgataggatgtaaaagagtagggtgacgacgattgatgggacataaaaaagaaactccaatgatgattaggtctgatgtttgaaatcccaatcataataaacaagagggacagcgggcaaagccgtgtaaacgagtatatatatgatagtggtgtctaatagaacttcgaaaacaataaaaaataaaaacatgacaagccaataaaccctaaaatctacgaggtttaatttttaaactttccaagattatgaatagaagcggacggacaaagaagtaaagagcggcaaagtatggtaagaggtggtgattgatgtgacttttaaaaactgtgaaattagatatctggtgatgatcagggttggaagttttggaccgaaatttcggtcccctccgatacgatattacttcggccaaaatttttcatttttttcatgaattttggtaatatttgttcaaattcaactaaattttgttcaaaatttcggaccgaaatttccggaattttggtgacctctgatcaaattgggtaaaccgaaaatgtgaaccctagtgatgataatgttcaaaattttaaaatcctatgatacgtacagttgtgactatttaataatttttccaaaaaataaataaatggaagttcttatgattatgttgtacttatgttacatgcatatatatgctgcaggtactccttcaagcgggaggacctcgttggcaatgccaactactttgacaaaaaaggcattcctttggtgctggactgggctatcaggagtaacgggtcttcatgcccgcacgagtctggcaagatggcaaacccggttgtgccttacggtgcttgcgtgagcagccacagctactgcgtcaacgtcaccaacaacggacacgggtacctctgtaattgctccgatggatatcatggcaatccttatctccccgaaggatgcataggtacgttcatatcttagtcttaactatttaaaaagagcaattttacggtcctttagaaggtaccatgaagtaccattttttctattgtaaatttggtacctcatgaggtaccaaaatttatacctcctgaagaaccgtagaattgctcatttaaaaatgaacaattttccaatcgtcgcatacgatttttgcccgccatccgtttccgaaatcattgttaatttgcatgcacgcctcgccggtcccggcctcggccaaagtccgcgtgcctgctcctttgtcccgatcggtgtgaattataggaaacaagatcctttttattttgtatttgtatcatatatagcagaaaataatatatcttttaaattgcttatgtttaatgtccacacattttcaactatacagatattaatgagtgtgatccatccacttataaagagaatccttgccctggtgggacatgccataacctagaaggtggctacaaatgtaaatgcaactttgggcgaagaaaagatagaaaaaacaacaattcctgtcaaccagtactatccaaatcagctacagcgctgatcggtaagacacatcctaactactctcccccctcccaaatcaaataaacctattactcctatgatatgtgacacattctaatattatggatctcaatagactttaattactagatttatttgttctgagacaaaggacgtacatagtataatgtataaaaggttacatgttacatatagtttttttactctattaattgttagtaacatcttaattaattagaaacaccatttgttttcagcaacaatatgtgccatcgcaatttcgtccatcgtactcattttcttgcgcatggaatatgagaagaggaagcttagagatcatttcaacaaaaatggtggtcaacttctcaaaaacataggtattaagatattcacaaaggaggaggtaggcaaaatcacaaacaattatagtatcattcttggaaagggtggcttcggtgaggtgtacaagggaactactaatgacaaccagcaagttgcggtgaagcgctccattgcagttgatgatgaggcacgcaaaaaggattttgctaatgaggttacaattcaatctcaaatcaatcataagaacgtggttagacttgtgggttgttgtttggagacaaatgtcccaatgctggtctccgcgtacataccaaaaggaagcctgcacgatgtgcttcatggtaatggcaatcacgttgcaaaatataatctcacattacaagtacgtctagaaattgctattgaatctgcagaagctctagcttacatgcattcatctgctagtcagaagatacttcatggagatgtcaagtccagcaacattctcctagatgatgacttcaagccaaaagtctcagactttggaatatctagactcatatctatagagaagaaccacactaacttcgtcgtaggggatataaactacatagatcctgtgtatatgaaaacagggatacttacagagaagagtgacgtgtatagctttggggttgtgctcttagaactaatcacaagaaaaaaggcaaggtatgatggaaacaatagcctcccaataaactttgttaaatcttacatgacggatagccaggcaagagagatgctcgatgatgatatcacgtcacctgaagtcatggactgtcttcacatgattggtaggatcgcagttcaatctttgaaggaagacgtggatgagaggcctaccatgaagcatgttttggagcaccttcatttggtgagaaaggaatggatgcaaattcaagggcatatgagttgttatcaaagttgatgattattgcatcaccacaacaacgcttacgacaacatagttgcctttcagtgtgaagctatatattgcactactttgcgctgatggtatactttgcattataagatgaaataattctgtttgtaagatttatatattgtgttgtttttagatgtttaactaaagatttgtatgttgctatcacagctaataatacgttgaactttgtaagttcttttaactaaggttttgtacgttggtatcatagctagtaatatgttgaactttgtaagttcttttaaccaaggttttgtacattgatatcgtagctaaatagctaggtggcccacgtaattgtacggctagcacctatacaaaattttctatctttttgacatgattgtcttaaaaatttgttaaatagccctctcattgtcttatgattttaaaatatcaaaactaatcattatcagtttttcaatttgcagaatgtttgatttataacattgtagtcattatttaggccaggtcgatgataccaaaatctacgagtgggcaacagtccggaagaatactgatagctagtggaatcaatcaagcaataggtagatagataagtgaagtacccataccaactacataactacttaactactaggatgtgaagtaggagatggttcaaatcagaatacattttcaaggagttcgcagagatcatttaccttgtaatccttcttcagagagtgaagcaacttagcagcttcgattgctggtcgttgatgcacgcagccactcgggccctcccgtccgaggaatccactactgatttgaaggtttattcttgtgttgctgctgtatctgtataaatctgtgggtgtgagtgcatgttgttatcctgaaaatgcgatcgatgttgcttatattccctgcttcattttctggttgcagtcaggttcctcacaagctgctaaaagtaaaaaatatccttctctgatgataattttttttaggtgatgatgatatctgaatgcagtaaagttatataccctacctagtagtgcatatcttgattgcttctctctcgtggaattttactatgatttgacttatataacttccaaatgaccaccagtttcaaggtttctatatatcttttctataatattttaagaactgaaaaactaactcctttgagctattaaaacctccgagtattgagcatcagtgaagtacttctagtcttatcagttattttcaattgtgagctgcaaactttgttactatcatgaaaggctggaaggctctaatttcttgctattattaatagtaactagcatggtggcccgcgcggattacgcggctagcatcattatattttatctcatataatagcatatatgttttctcaatttattattaaaatatattaaaatgacaacacaattttaaattttgtactaactttaatgtgtaatattcatattttattttatatcgtgttagttattaattatttttaatatcaaattttagttatttctaaattatattgctatatggactctagactcttatttcaatattttttattttttaattccgaattttcgttatgtgtaaattgtatttttatatagactctaagctcttattccaatattatttatttttgattctgaatttttattatttctaattgtatttctatgtggactctaaactcatcttttaatattctttaatttttaatttcgaattttagttacatctaaattgtatttctatattgactttagaatctaactctacttttaatttcgaattttagttgtttgtaaattgtatttttatatggactctaactctacttttaattttattatttttattctgaattttagttagttttaaaatcctatatggactttatattctacttctaatattccttatttttaattctgaatttctattatttcttaattgtatttctatatggactctatactcttcttctaatattctttattttttaatttcgaatttcagttatttctaaattgtatttctatatggactctggtctcctcttctagtattcctactctctctgtttcataatgtaagtcattatgacttacgttatgaaatggaagaagtaattttttagctccgaatttcaacaatttctaaatgtatttctatatggactctgtttttctttttctccgattaatataagaatttctaggccgtgagagcgaacgttgagactcctttttctattcctttagtaagttaactagctgggcggcccgcacaattgcgcggctagcacctatataaaattatatattttttaatataattttacttaaattttattaaatagttgtctcgttgtttttaagactttgaaagaaaaaacctcatcatcctagtgtttctaattttatagtttttaacagtcactagttgctaccccatatatttctgttatatccttatttatttgcttgcacgttctaccactgtttctatttattctcctcggaacctttaaaaattgcataatttgtcatcccgataatttttattcataaattatattcctacttgaactcttataattttttatattattgaaatttattttatttgttatttcgaactttaattaatctcgtcatgtgttctagattatctcttatttcaatagtctttatttttttattaaaaattttagttatttataaattgtattctagttgagctcttatttttctttttttatttttgaatttattttattttctatttcgaatttattctatctagactatttttttaatatttctaaattttttagagtaaatttcacaaaactacatatactttgaccaaattatcgtaaaactacatatttaaggtcgtatatcatagaattacagatttagcaacaaatttattacaaaactacaggtttaaaactaactatcacaaaactacatattttagaataaaattatcataaaactacagattttaggatttaaatcctttgcactaatgtaatgtttgagttataaatatccaagttttatgattaaattgacattaaacctatatgtttgtggtaactttgttctaaatttgtagttttgcgatattttaccttaaattgtagttttgtgataaaattagtgttaaatctgtagttttgtgatatatcatgttaaatccgtagttttgcgataatttggtcaaagtatctgtagttttgtgaaatttaatcaattttttatttctaatttcaattgtttcaaaattgtatttctacttgaactctcttttttattatttgtaattttttattttatttaattttttattttaaattttaattaatatcgtattggtttcttacttggtatctttttttcaatattgcttatttttaatctcgaattttagttatttttaaattatattcctacgtgaactcttattttattttatttttctaatttcggattttattttatctttattccgaattttaattaatctcgtattgggttcttgtatggactcttctttcaatattccttatttttaattccgagtttcagttatttttaaattgtattcctattggagactttttttttctaattttagattttattttatttttaatccaaattttgattaatctcgtattgggttcctataaagactcttctttcaatattacttatttttaattccgaatttcagctatcttttgattgtatttatatttggactcttcttttctttttcttcgattattgtaggaatttctagccaccacagtgaatgtggtgctttttttcaaggttattttaataatataatagatagatagatagatagatagatagatagatagatagatagatagatagatagatggatagatggagtagagtgaagaattcatttacaggatttcactgtcaaaaccacacaatcttaaatttatagcttttctttcctgtggagctttctcgttgaacagatttccgtgggtacaaattttgtgttttcctgtagagtgactcacaatagttaatttgagcagcagtgctggtgggattacacctgaacagcagtctatggctctttgcctgtaatttcctagtgaatttctttatttattatctgatcaatatgctaatctctattgcctcactttctgtgtttttgtaatttgtcatctctgctctgctcattctctctgttccctatttgcaaagcgttcaatgttttgcctatgaagtttgcagtcataaaagtgaaatgaactagtaaaaataagagaatgcaagttataagaaagcaagaaaggtcaaggttacctgcctgccagtagccacaactttaatcgccatggacagcttcaatctcaggcaacacaagtcagtcgtccggtgctgcaagtgatctcgagtgaagagaacaatttgactggctgttccaattccattcagagccagtaccagcattttctaaaatcaaagaaagcccaaaacaaggatcatacagaaacagaagaaaagaaaagataatctaggaagagtgtaaacaatgagctagtcaaaggaaaggagctaagcaacttgctaataaaacatgcatgcatggttaggcaagctagcacatctaatattcacttttcttgggtggaaattacattgttgacccaatagtgaaggtcttggatgtagacagaagaaccaggtgccttcatgcacaatggaacggagagctaaatatataaattaacctcaagcagatgattcctgtcttaccaatgcataagagctcagacatggcgcttaaattgccagtgtggatatctgttgtgcttattgttttgttcagtgtgacttctgcttcttctccagttccgagcaagaacaatggcagcaacaccgaccttgctgcagtgctggctttcaaaacatcaaatcttataaaataaacagctaataaattcctcagcataaatgcaagggatatgagtaagataatgtttgcattaatatatgtcatttatggtgggttattgtacccctatatgaacaccggcaacagtgaaggtcatagaagtagcttatcaaatcatcaggagaacaaaacactatagcctgatcttgtgatggcaatcatttccaagaaaaataacacaatggccctcggctgcttggtggcttttgtgatcttggctgtcgctctctcatcctgcaaagcggacggttagatttaatttcctctctacaatgtctcctacaaatttaaacattgctccaaatcttagatccatgtcaaatttaaagtttgtatatatgtttgacggagctcgtggctcctcaccggcagaccgcacaggcccccctttgccggttcggccgggggcttagggtgaaatctcaagctctctcggtatgtggaaagatcgcgagccccaaaagaaacgcaagacacgagcgatgtatacaggttcgggccgctgggaagcgtaataccctactcctgtgttttggtggatctgtatatgaacaagtaacaaggtgtcgacccgccccccaatcgctctgggatcggatctagaaaaaggtctccagtcgccctttctaagtgggcaaggtcctccttttatatctcaaggggataccacatgcccctctctctttccaaactggactgttcttttcttcataaatggacggagatcggtacggttcctgtccgattgcccttctgacgggacagcccatacctacccccactttcgtcggaaacagggacgacgtgggattatggctgtccgttgatgacgcgaccagtgtcagaccggtcattcttgtccactacgcgtcagcttagcaacgtgcatgtctgcccttcttcatgtaacatcttgcctgtaatggttaggatgaagcctggtataaatctaaccagggctaacgtgccatctctaagagataacacgctagctccggcttgagacgagggcctagaggctttcgtcttgacgggatggggcaaggcgtgcgtcagaccgccagtcgccacctaacccgtgatctgaccggtctgtgacaggtcacagaccggataaaggaacgcgctgcactgcgctgcatgcagcgtgacacgcttgaccagactacaataaatgcggttaggtgagcaccgccgtgttcacctatcccatatatgtggtgcaaacttcctcaaggggtcagggtgcttcggccctcggggccggggcaggagtaacctgaccccccccctcggggaaatcaggaggagggcggacacgtcaccctcgggcccgacgtccccgaaggtgccaggccacgtgggcgattgtgtctgcctcaagcctctggtcacgatactcccggtcccatatcaccgacaatgttaaactacaattgtttaaaatattttatttcctctaaaatataaataaaatgatttatttaaatattaccaacgtaatcacagaatttctacatttagaaatacctagcttaaaaaaaataaattagagttgtgccgaacaaggccaatatacagagttgtgccaaacagattgaagattttataagcgaagatttttgaaattgtggtagttactacaaatttgtttatctttagtacctactgtaagcatggcatcattcgtccaatatgtatgtgtacccaatagtatatacatcatcgtatgacagaaacttggatttgaatgcatgcagaaaacagaccttcaaatcacagttgctcatttttttttaaaaaaaaataatgaaccttttaatctatccccgctataggacagaatatagatgcaataaagctaaggcagaatatatctacctaaaaacctcatctactcatttttattagctggttgaattgacatgcatacaaaacaatttgtataccgtgaaaagagcagccggcttccttaatggattggatttcaaatctgattagtcattaacccgttaataaggactccacattagcaccaaactgcacagatcttggaacaaaccgcatggtggatgagacgggagtaactactcccggtagtagtatataattttcatatatatatatatatatatatatatatatatatatatatatatatatatatatatatatatatgtatatatatgtgagctattagtacaaaactgcagggagagctatatggccgtactaaaacacacatgcccataatccggttgattttcttagtcataaatatagttgattgattgatttagagaataatctatattcgcttaattggtaatcatacgataattttatgtttaaaaggatagcggttggatatattggattttcttactttataattactgtaaaactataatggtagaaacagctgtgcccaaacaatgtttactgtaaggacatgaatttattccccagttaaataattgttttcccgataatgattaagagattactgcaaaacaattatatatatttagtttactccacagttaattacatatatttttatacaaaataatatttcttgaactatatttgtaaacacgatcttgatgttagacggttcacaaaaccgatggaatctcagtttgtgataaccggtcgatattagccgatcttggttgtgaaaattttcgtatggtattcactgaaaggcgccggttttcgatcggatttattgctgtttttttactggttttcgatcggattttggtaaacttgtgaggagcggtttttacttcgaaatcgaaaaattgaaacctattttagcaaacaatctaccatttgcagtagtttattgccataaacaacaaaaagatactaccaagtttttcagcacaaaaatgctgttgtttgaactcttctgtcgtgaccatcgtctacttgttgctgagcatgatgacaatattcagatcctgtaaaatgcatgtgcagtaccatggcttaaacttgaaccaaaaccatgggctaaacttgaatcaggaacacatctcaatgtgagatgaaatacagcgcgattgcattgcaacaatatcacaataaagaagagaacaaatcaggaaacgctactctcacttttattgcatcgcagtagtagtttcagtacatcaataacctatccagatctcgtccaagtataacatgtatcaagaaacaaatcagccatctgcagagaactactgcaactacaccacactctcatccatgtcgcacccatcacgcattcagcatcttgcctgcagatcccagaacttgcatcttcatttatgctgcggccataacgcattcaattgcttgcttgcagattccagtcatcgtcgcttctggcccatacacctgcagtgatgggttgttcaaacagaaatcagctcatccgtgttgtgtgagggatggtcaggatagtgattcagaaccaccaacaacaaactgataggtttgcccatttgcatttatgaacttcagacataacaggtcttgcatagcaaagagagaggtgcagtaggagacactagatccgtacctcaatcgggacgccgagttctgcgccaagcttgcgcattttagccagcccagtttggtaatttggaccaccacgtcggacatagatgtgcatccttgcagccttcaacttggattcctgaaagcaagtttcagattcagttgacagtcaaccaatcagatgaacatgtggaactggtgataagttttagagaacattggccacaattcgagatttaggggtcagcatagctaccttctctcttaaggcccgaatgatgccgctaaatgtggccccgacgtcggtgaagttagctataccccctccaatgagaagagctctcttgcggccatcaggatcagcagtcgcacactgcattgaatgttatcattaacaaattgacataacaagggagtggagagaaatgtggttatggttatatcttgagtgcttacatcaagtactactctagcatactgcagaacctcctcctcgttgggagcaccgctatactctgcatagttttctaattctgaagcatatcccaaatctccgacatggtaaataagaaaaaaaaacttaatttcatgagagtagcatgaaatccttgaacagctaagttaaaacaagggaggaactcaaagcttactgtatcagcatatatgacactggcaccacctccagcaaccattgtccagatgcgcccctttgggttcaaaacggtgaacttcagagatgcacttgtctgaaagaataaggtcattatatcacatttagcaaataattcaaaaaaacatatagtgctgagccagactgccagcactcctatctgaattcatgtgcaaacctactgatgatattatacaggcaactcatacttaaaaaagattggggaggaggcttgaaatgtgaaacgtgtaatttgagatgtggataccttctcatccaagtcatggataaagccttctgtagaactgagaactctaccgaatggtagtgggaattcgatatttccccacctgaacagtgacaagaaatgcttaataaaacattcgcacagaggcatgtatgctagagaagcaatgagacttacttcttgaagttttgaaagctgctgtgtcatctaattctcctctcatgtccagaggatacggctctccattcacgatggtaaatgggttcatctcgagaaatgagaaatccaagtctgtaaagggagcatattattatggatacatgatataccaatacgcttattattacattttacaattaaaacattacaacaaatgacaagtgaattctatatgcatctttaataccttggaagacagcaaagactcctttaatgaaatcaccaatttttccacgtgcctaatgacgaaatgtacagttcaattattataagcatgtgacagatagaagtactcctcaaatgaaatcaactgaatgaggtacaaaggcaaataattttaacaggacaaatacctccaatggaagggtagcaatcaagggagcacatgcatcaggtgtcattggcttctcagtggaaagaaaaattgtcttaaccttgtcccagttctcctcaatttctattcctccacactctgagaagctaatggtgctgcccagcctctccgagacaatagaaaggtagtattcttgatcatggggtacaaatggctccacaatgaaggtggtgattggagccttgcagccacccatctcgacctgaatagccacaataggacagaacaacttaatttatcaagcgaacagagaataagtcagattttaaaggcgatagcaaaattgaactacctcaactcccagcctctccttcacaaactccttgacttgagcaatatctaggttgagggccacaagtccgctcttgccacgcttcccgaacagcatgtcgggcttcacgaccaacttcatggttgacagccatggctgctggtttaccagctctgtgaagtccgtcgattgtgtaacctttttacaaatcccagaatcagccaaaccgatatttttaacttcaaacaaaaatatgctatgtcaaacgagaaccgtaattaagattaatttcgcgcatagtgcaatttgtataattcaaaatcagtcagtttaaactccctagtgaccccaaatgtgtgaatgtaacaaaaggaactatctgcttgtatgtagtatttcagaggaaatcactctgcatcaggacaacattcaagtgtcaacatcatgaccagttcaccaccatacggacaccagtaatgaattaattaacaatttagacatacaaaaaaaaaacaaaaacaatactgcaagacaaaactccagtctccagatctaacaaagaaaccgattcttttgcactactgccagtaccaaactgcaagcaataagccgtactagttccaatcaaaatcgcacctttgcaagttacccttcacatacagaaccaagaacatttccattctaaaatcaaaatcctgtcagtgagcccatccacaatgcctaccagcacaaaaattgcatcgtcctacgacttgtacccagatcccccatttcatactatcaccattgtattttatcctaaacagagaactatcttctcacgaattaacaaatgccaatgcctcattgagtaatcaatatcgaacccaaaaaagaaagacaaaccagatctttacagtttacacgcaaccaggccaaatcacgcgggcccaaatcaggccaaaaaaaaaaatgaaaaagcgccaaccaaccagggatcaccggaaacaacagctaaaactttgagatcaagaagaagaagaagaagagagaatcgaacctgggcggagaggatctggaggtcgataccggcgaggcgcttgaggtgctccttgaggaggcgcttggagtcgtactcccggatcttcttgcgcgccatggctcggttagctgccgccgcgagaggagaggcgtgggttcttgaggagggttcagcaaaccaactgcagaggtaggtaggtaggcggagtgaacgaagccaaccaagatgaaggtggtggtcttggtggtgtgtgcacgttgcgtctttgggaggaatggaatgaatataaagaagatgactcgctgtgttctagattggatctactaagtaaaagcaaacctgcagcatcagtgtagaagagaagcattaattaattgactaaactactgctaattgtgatatgcatcctcctgaattaattgtctactgaagatattgtgatatgcacaccctgtatgagaatgagaccatgtttatgaccaatcggaccagattacattgtgctgtgcgagaataatggtttctgcctttggtttccttttccatcttttggtgtttcttggtttgacagtggatggattaattacgttattaaggagaacaattcagcagacagactagtgactagtgattagactgttgaacaggtgttggtttgtttgattttggttcaggaaaggttgttttgcaagagaagcgagagggagagtttggtgtttggtgagtagatggcagttgcacaatctgcctgcttgctggtagccttgttgtgctccagttaggtagcaggtagatgtgatgacttcttttctcttgtgttgctgttggtcctctgatctactgcagtgttcagttttgtttttctggccacacatcctaccaaaaaccggcgaaatagcgatgatatgggcccaaaaaaatgtggcactctgggcctgtgattgttcagacagtaggtatgggcttaaatatttgggctgctcccggttagtatttgggcctgatttatatacgaacagaagctgcaaacacgttgtatattttaatctgaatttttatagtatatttcatatagctacaactattttttgtaaaaaaaaaaaaaactatcattctgttacaacgttagctcaaaattttccaagagaactacagcaatatcgtatgatttataaaataaactacaactctatttgaatgataaatttgcactcacctgtcatatatactatacatgttactcattctggtatgagttggctcacatgtcataaaacttataggaagataaaatcatagttttttaataaaatctttgctatgttgcagttttggggaaataccagttaaagttatagtgatagttttgaaaagaaaatttacattgtagttttgtatgattgttagtgtgttccagcatgtaaatagtgtatttgtatactgttggctattagtgcatagtggggattgattgctgaaccactgttggctggatccttgttccatggcatctggcgccaatgtttcccgccaaattcctttcctttccattccctccaactcaaccccattctctctggagtcttgctggtcaaaaaatatcctcaaaaaaggaaaagaaaaaagaactagggtttacgctccatggaggtcgaagcccagacctcggccgccgcggcggcggccggcgacgagctccggtcgctcctctccgccaccctgagccccgacaaggcggcggtggacgccgccacggaagggctctccaggatcgccgcctcctccgacccccgcttccccatctccctcctcgccgtcgccgcaggtaccctcccctttctcgttgtagctgtgctggtggcgtttccatgccaagtgctaccgtgttcgatttctgcggaagcttgtggatatttttgcttctgctggggaatttgagcagtggtagcctggattgtaatttactaatttgtggaactccatgcaaaaatgaaagctattttggacaaatcacttatgcatgtttgatgtttgtctgtctattttaaattgccacacgcagcacccaaaatccaactcatgattcgataaactgcagttagcaagtgcgggagactatttatgtgcatgtaaaaacataattttgggaaatggttggtgctctgtccatggagacgaatatattgatgttcttgtttcattttgagatattgtacagaaaaatggaaatgttataccagtatttaggcctggtttagttcccaactttttcttcaaacttccaacttttccatcacatcaaaactttcatacacacacaaacttccaacttttccgtcacatcgttccaatttcaatcaaacttccaattttagcgtgaacaaaacacaccaattttagttgtgagtatatgtgttctttttgagcaatcaatgctcaggcaggcagcccacctgacctttataattgaattgtgcttatagctgatggggaccaaggaacaaaagttgctgcagcaacatacttgaagaattacacacgccgaaatattgactgggggttgtcatcacctgagctttataaagagttccgtgatcggctcgcccaggcgttgcttcaagtggaacctttccttcttcgagtattgattgaagttgtatgtctcatttctacttaatttctctgcaactaaattcctcactaccaagccttttttgggtgttatcttacatccttatggtttgcatcaaacagttccgccaagtcatagaaaaagattttgtcaaggaaaatttgtggcctgaacttgtcccccagttgaagcaagtgatccagagcagcaatataataagtccaggccagcatcctgaatggaatactatcaacgcactcacagtacttcaatctgttgttaggcccttccaggtatatctcatggactaatatttcatatgctgtatgcctttgtcgcatgtttttgaaaatcaaatccttcactctcagattttagtttttgtaagcgtgaacattttattttaacttcattttattcctttttttttgttaaaggactcctgtctctagcttgtccatacaagacataactctgttgatatttgtgcaattgtctgttctaattgcataatacttattgtacacatttcagcttacaaagggagtaaatagtatgccttaaagcttaaacttactttactcattatagagttttagcattcctgtatcaacaactactgcacataaatattttagtagagcggatttcttatttatttctagctgtgttatcttacagtacttcttgaaccccaaagtagcaaaagagcctgttccaccacaattggagcaaatcgcatctgagattcttgtaccactacaagtgacattccatcacattgctgacaaggttttgtgttgcactctgctttgctctaaatgctgtacacatgctgatctttcctgaactttttatggtgtgtggttctgtggtcaataggttctgttgtcacatgatgagactaatctggaatacgagcaactcctactcatcacgagcaagtgcatgtatttcactgtaagacatggttccttccttctgtattaaaaataccattatgaccataacatactatcatcatacggtaaaatgtagaaactgctattaataaaccatgtgctgtttgcataattatattgaagagtgccaattagcaacatctgggaaggttaagagaacgaaaggttgggctgagactgaggagtataatgtgtttgaatagaacttaaagcattactgttcatgtttatgtaaacaatttaggaatacaatactgagtttgttcttttggttctccaaatgctgtacttgaattactggtatatttacattgttttaattccatagctaacgttttggcatgcatgattattaacttgctatgagggatgcctaattgtcatactcatgcaggttaggtcatacatgccatctagggtaaagcagattttgccttccttttgcaaagacatgttccgcatactagaatcactggatttcaacagtcaatatgaagatagagccacaacaaggctcaagactgcaaagagatgcctcatcatactttgcacacttgttactcgtcaccggaaacatgctgacgagtacgtactttaatgtttatcgtcattcttatccttttagaatactaaccctccagttttctcagccagatggcacatatagtcaacagcgcaaccagaatatcaagtcaaagcattcatttacatgtaagttcagtcagtggtttgtataatccttttatttgtacaatgtgatgaagcccaaacatcatgaacccgaactaaagcatgctagattctgaaggttgcgatggtcatcagtcatcatgatcatttcctaatttatttgacgagattctgagagtgcttaatgattacagaaactcggccctctctctgatcggatcatttcattgtcatttgatgtaatttctcgtgttctggagacaggccctgtaagtatttacattatgcagttaaactgaaccaaaatcatgattcacatttttttatgtttgaatttgatgggtctgtgctccttggttgcagggatggcgacttgtttcaccacatttttcttcacttctggattcagcaatttttccagctttagcattaaatgaaaaggtcagctccctgcctttttcgataggaaacacataagtactgtttcaatatgtaatttgtttggtttaaactttatctgtgtgcaggatataacagagtgggaagacgatactgatgagtacatgcggaaaaatctaccttgtgaacttgtatgtacatgaatccatcacgctaattttctctctggcttttgtgttcactgatatatttgctggcaggacgacatttcaggatgggctgaggatttattcacagcaagaaaaagtggtatcaatttacttggtgttatagccctatcgaaggttgtgcctttttccatagtggaatggaacataataacaagtttagatccaccagtatcttttaacattgaattgctatattaataaaccctttgataaactgttccttcataattcataaatcattataaggtattacagcttttgactagcactggtagaaggataacaatattctttttgtattgaattccatttgcatctatcacaacctgcaagcatacatacttaaaatgctattaacaactgtatgttcaatctacctagttcacacattttctatctatcacctgaaccttttcacttattgaattgaaataaaacgtttaaagatgttctactcatgtattagcattttctggcatcagggcccaccagttgtatctgcagcttctaagcgtaagaaaggtgataaaagtaaaggaaaaggagaaaggagctccattggggagttattggttataccattcctgtcaaaatttcctatacctccccagggggaagatgtgtcatcaaaggcagtgcagaagtaagaacataataattacttgttttaaccaagaaaaaatggtagcaaaaagtctagatatttgtatctctcatgcttacaagtgaactacagcatattcgttttgttattttcccatatttctatatagttggaagttcacttcatttcactgtcactcattccagttatttcggtgttctaatggcatttgggggcctccaagatgtaagattcagaagatgtgtgttttgtgtttttttgttagaatgaataccaatgaatttcagtaacccattttgcagtttctgactgagaaaaaagatttgacaaatacaatcattaggaatcgtattcttccactgtattccctggatccatgcagtccatatttgatttctgcagcaaactggattattggacagcttgcgttgtgcctaccagaggttacattttttccttcataattttatcatccagccttatgaaataataggtgaaaacaaaaggcttcattaatatgtacgttccaatgttccatatattatatatttgattttctgactgctgtttgcttggatgtaggccatgagcacaaatatttatcattcattaatgaaggcattgacgatggaggattttgatgagttgagctgttatcctgttcgtgcttctgcttctggtgccattgcagaactcattgaggtaagggtttatgtgatgttgtcaatggatttcacctgccacttggaagttggaactatgctagtatgccactgagatatttctttgtgcctcatgcagaatggttatgctcctcctgattggcttgtccttttacaagtggtgatgaaaaggataagcgttgaagatgaaaatgagtctactcttttgtttcagcttctgggcacaataatcgagtctggccaagaaaaagttttgcctcacattcctgaaattgtatctaacatagccaataccataatgaagctattgccccctgtgccagatccctggcctcaggtaattgcacatctgtatcctctatttgtcaatacgttagtgttttctgtaaaagggaaaataaacattgccatatatttaactgtaccatcaagtgtcatttccattattaatatttttgttgtttgtattagggattagaattttactatattattgctttgagtggtagatgtcttgaaaggtaggaactgttcccaaatttagcagatttggtaataggtatacttattgagagtgaagctcaataagtagattatgagcatttccgggcttctttcgttataattattaattaattacgacttaaaccatcatgtgcaatcactagtgaacattgagcacacatctttcaacatgctctctgttcaggagtgatgttttgggcacaaacagtatccaacatgcacctttgacctttattttttgtataaatatcaaaaaatgcttgtgaagaatcagtattttctcatgaaaaatctaatggtttcattttgacatgacaaatataaaaactatttgacacatcagtgctcaaagttaccaaagttaataaagttgactatgacaatttctaaaatgttgcatattttcaagcggagggagtacatgcgttttataacccatctgcattatatttcaagattcctatgtgttcaattcatataggaaaaattcccatcaaaccagcagatttacatgtatatgcttttaggctgttgaacggggttttgctgcactggtatcgatggctcaagcttgggaaagctctgcaccagatgaaaacaaggacattgaaatgagggtctggcagtcaggccagtttgctatcgcccaaacattttcgcatgtgttacaaaaggcttggttgcttccagttgagcaaatggtatgctacatttgctgtttattttttagcaaagctaaatgctgtttattgaggcattcatgtgatgaaatctgcttgattgctgttaacattcattccaggggttatctgtttgctcttcattgccacctctgtcatgtgtaaatgatgcttctattttacttgagttcattatgaggtctatcacctctatggaagaaactgcaagtatgaaggtgtttgagctagtagctatatgggctgacataattgcttgttgggattcttgggaggaaatggaggatcagggaattttcaatacaatcaaagaagctgttaacttccatcaaaactttgattctactggtttcttcctgaaaatactcccttcccgatctgaaaatagttcacaaagttcagtcattagttgggtttctagttttataaccagggccattgaagcttacccatctgcaacatggagggcatgttcatgcatgcatacactgctgcacactcctaatttctctcttggagcagaagatactagaatgactcttgctgtatcctttgcgcaagcagcattctcccgtttcaagtctgtatctgacagcccttctgggatatggaaaccactaatactagtcatttcgtcatgctacatatgctaccctgatgctattgagcaactcttacgcaaatatgacagtaacggttatgcgatatgggcatctgcattagcacaaatctcaagtagctctttcaatcctggcttgtcatctgaatccgagatcaaactagctggtaagtaactacttactgatcattggaatgtttaatcttgttcatgtttggtctgtcatcctgtgaaggtacatcctgaatttgttttctgttattgtgcagtgttaacgttagcaactgtaattgagcgtcttttggccctttctacgggtggcaccaaactgttgcatgattgctgtgtatcattgatggagtcttgcatccatctgaaggaagttcaagaggatggggatgatggtgatggtgcagaagatcttgatgatgatgatgaagaggaggaagacaccgatgaagatgatgaggtaactgagcagaatcatgatttgtatcttctatattcatgcccaaccaaattgattgaatatcacaaacaacatataatcaggattcggatgatgatgatgatgtacgcgaagagacagaagaggaatttcttcaaagatatgcagcggctgccgctggtgaatcaattgaaattgttgaggacggtgacattgatgatgaaacccaagacattgaattgggtaaacccgaattattttctccatcttaatcttgcctcaatagttcttttttatacatatgtaactttactttcatctcttggagcaaatgcaggttccctggatgaaatggacgtacaacaagtggttctttcgatgatgaagattcgtcctgatctcattcgcgctcaaacatttccggatggcctaatggagagaatggcagaaacgtttcctgaatatgaacagttggtccatgttcatcggcaagccttggcgatactacaatagactagtgtgcagccttgttatttattgtttctagtttctttttttttaacttgtaatatatttatctgtgtgtttatatatttgtatggaatggttggccgattattttttatggttaaggcgattattaactatattttgtgatttggatcggagtaatctggcgggcatgatcttttagggagttcaagggtagtaccatgagcaacacatgggtttgcttcttggttcctacaactgtacttcactgagtagtatgtaagctccttgggagatgtcatgcttgcagtactaaagaaagatttagcacaactttattgaacttatagcattattattttgtctattttaatcaactacagctggattgatccgtacattaattagttcatttcattttctcatgcatgtttccgttttgtggcagcagcaagtcccttcctgaatgcaataggcgtattttccgtttaagcttatcttatctcggcaggctccaccgttcatgcaaagataggattgaagcaataatctgtattaaaggcaagaagttaagcaacaagaggcaaaaataagatgcatcaaaatgtgttgccaaatgcaaagtgctaggctgctagctagccaacatccatcgagttccacattgcaaaaaagtgttaacgagaggatcgagggattaccgtctgctgagataagagcaagtttaatagtatagcacactactaactccaaatcatatataaccaatataagaggaggtagagaaccgggcgttgctcggttcgatccctgggatcgcaactcgcgtgtctcaccaggggtttttccccgtttccccgggactgacttcggttggtcccggctaggtaatagggtacacacacgtgtgcgcgttcagtgggactgtacgtttcccgtgcactgaggcctagtgcctccaatgttattcctagcgtgtgttagtgacgcgcacacgtgtgtgtgcgtgtgtagtggtgtgagtgcggtgtgtgtaagtgtgcgtcctgggttgtacccttctcaaaaaaaaatataagaggaggtacaatagcaggctataagccagctataaacatattataaagagataaaggaagagagagaagagcagcgggctacagatctgtagctagctgcagcacgggctccaaaacgtaatgtgtgtgtgacagggggaccagatattaatagtaccgtaaacaactattgtatgaattggctattacattggctatagatgatttgaagttagtagtgggctatactattaaacttgctctaatagccaattcatacaatagtttgacgcacaaatcctttgtgcatgtaaattcaggattgaagcaatagcctgtattcacagcaagaaaacaacaataaaatatgcactagtttaggcattttcatcagtaggatacatgtacatatttgagacacatcaaatctcaatatgcatactgccaaactaatattgataaccaataggaaaagctatgttgaaccatctgcattgncaggatgagagagcaatagccatgatcataatatatagacaccatgagagggcctcacgaccacgggcggtgaggggacccggcggggggagtaaagagtgttggcccagggacgaacccggcgatccatagtcccagccgaggaggaagacgacggcggcctgcagggccatttacagtcgcgagctagatgccggaagccccggcaacggcggcagcacatcgggagatggcacgaggccacttggtgcgaggtggagagacaattcaagcatcagtcgaggaggttcggcgggatgccgcaggcaccttgctcagccggcggtgacgacgacgggcacagacgtcagcgtgaacgacggtggcgtcgaccactgtaacgccccgctttccgcgtgacgttaaaagctaatttacgaaaaccctacttgcgaaaattttgttctttgagtgctgagtctaaagtcgtgccgtagatctcagtctaaaactctcctttgtctcaattcccgattgtcaaatcatctactcaaaatctccatccaaaatcaatacttgaacctattgtattcatatctcccttctaaaacctctaccgagatatttcccttcaaataatttccgtttcgttgtttcccctaaggtttgagtccgcactcaaatcctcttcatttactccttcgaaggttccacgttttcaaatcttagaaccggtaaaccctaaaacctaatctacctctcacctttcgttttgaagacagtttcgaagtccgaattcgtatattcggatttcgttccaaaaacactaaccacaaatatcgtcgcatccatgaatccaatctagtccaagcatttacctcgtaaatcctaaacctttcccttgatctccctcccatgatttttccatattcccctaaacctaattcccccaaagtgatcgcccaccgagaatcctcaaaccctaaccctaattctctctaatttcaatcccgtagcagaagtctagttcacctcctctccatccttgggccaacttctctgcgaagtctgttttgcctccctagcttggcccaacactccccagcccatcttcctctctcctttccctctcccacgcgtcctctgccgagcccaccgagctaatttgtttcgcgcgctcgcgcgtggtcgtggccgaccgccaaggatgatgctgccatcaccccttaccgtcactctaccgccttgtcctcgctccgctccacgcccactgcaagagtagaagtgaaagagaggagagagagaggatgacttgtggatcccacattgtacttttcttaataagccgtgatgactagagcatgacatatgtgcaacatcggaccaaaaccatccaaaaacaatgctaggggatatcgtccggcttcaaaaatccataggtatagaatgtctttacgaggataatcaaactaatgcaataattcagggtaaatctcagactttatatatgatggttaagactataattttttaacttgaaataatcgatatactagatctgtagtcaatcagaggtttatctttagttaacttcaatctgtagttaacttggtggatacatgtgactggggtatatctttttatattattgaatcaatcagtaagagatcctcgcaaactatttgattactcgagcggatacctcttgtttgcttaaaaactattcaaatagttatgaaataaaaatttaacaacactcatacaacatatttatacaacttcacaaaatcttaggtccaagctcaacttacatgttgagatataaaaagataaattcaacatatggatatagtagcatactgttcatatctaaatttgtctttttttttcaacgtataaatcgagtttgaacttaattttttattgaccgatagatattaatatagagatatactctatattattatattttttttaaatttgtttataactatttatattgaatttaaaagaaaaagatacgaggaacgtctcctcgataattacaatccacttatgagatctttgcaagcttctcccgtgacggtcaagtcacgtctcgtttgtttacaagctagtcctggtcatgtcaaggtctcctgactcctgtagagtccttttaaaaagttatttttttttaatggaagtccattcaaagtttcattgaaatcaggctggcaaaactggaggagtcgacaagatattccattccaaggcgccacttaaagctggcctagtagctggaggcaatccgcaagacggagacccacttcaaagggtgtgacctaacaaattagcatttcacgaagcgacaacgcagcacggagcagtggcggatctataaaatcgatttgctggtgtcataataacgtatgtatcggcatcattgtatgctaactatgtttagatcatactggtataatatatggataaacaattttgctataggacttatcgaaagttgtcggtgtcgcggcgacacttatattgtagatccgcccctggcgcggaggctgacgagtccttttttgcttttatttttgtcccgatgatttactactacttctatgacattactgttagcagtgttttttataaggataagataacttttattttggttatttcttcatccgacaaagtgatagtaacattgtttacaaaattcacatatctctttttttttataaactataacatagatatataaattttgtgaacaatattactaacattttattggatgaagatatgataaaaataaaagttatagatcttgatgagttatataactttgttgttgatgacttttttagttgaaatcatttagtatttgaaaatattgtttgaagttgtcatattttcaaattcaaattcaaactattcaaaaaaatatataagaaatgaccaaaataaaagttatagttcttgatgagttatacaactttgttgttgatgacttttttagttgaaatcatttagtatttgaaaatgttgttttgaagttgtcatattttcaaattcaaattcaaacggttcaaaaaaagttgtatagaaaaatgatcaaaataaaagttgtaaatcttgataagttatacaactttgtcgttgataatttttttatttgaaataatttattacacgaaaaattattttgactaataaaacgaattattatactgcagttaattattttgctacaggtcaactcacaaatataaacatttcgtatgaaaaatggaaaaaaagtcatcgatgacgggcgttagttaaagcccgatagaggttaagtcatctcaatcgggcattagtatagagcccgtcacggatgagttatatgcgacgggcctagttgttatctcaatcgggccccaagttggtgcctgtcacggatgatggtcatctatgacgggcgccaacttgaagcccaattgagacatggaatgttatctcaattggatctaaattacggcccgtcactgataggtgtcatccgtgacgggcctgtgttttatatccatctaacatgtatgttcgagcatatctcaatcgggcttttttcagctcgatagagatgactttcttgagacgactcgctaatttcagacatgttagagttccaagcatgttagaggccgtcacagatagaagattctgtactcgtggtagtttttcttttttttttccactcaccctcaaataaataatctttactgcatgaaacactacgcgcacgatatgtaatatttatatgcaaattgaacgttgaaaagtggtcaattcataacccttcgtcacgccgcagaaggaaaattagtggcatacaggcatgcatttacgtacttgaaatatttttttgtcgattgggtggtgagtggcaatgcctgtctaccactaccctaccgttacgcacacatacctcatgttcattaatttatgccgtttccatttaacatctctacttcctaaggaaacagactgactgacaaataggacatgcgattttgttttaatcttcagcatatgactttgacaataaatttagcctccaatggaaaaaaaattcaactctgaactctgaagcaaagcaggacgacccggccggtcgaccacaactctgcagtatattggcgccaaccttttctacgcgaatcttttcacctccccaacttgatcaatgctggatcaacttagaacatgagatcatatggtagtaaattcacaagagtgatcatcacttgctgttttaaaatattggtagctcgatcagctcgatgcatgtgttctgattggaacaaactctctgacttatattattgttcctctgaaactctgactacattattgttcttgtgaaaggacagcatgcgaagcttctctgacagtagctttactacgagatgggctagaagaagatgatcagataacaaaacaaaagttgctggcgatggtggctggggaatcttctcctgttaactttctgaatcgtcagagcagcagtgttgccatctttggatgcttgtgttgttgtagccactaatcgctgcaggagcgcatgcgattgagtgccaaataatgtaatgacactttggattcttgtggcctgacatagcacgctcatctcatcagctcaatcattcatgaacatgtatgtaagtttatgcatttttgtgtatctgcatatctgtatttatgtgtgtatatctctctgtagactgtacttgagtgattcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgtacttgagtgattcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgttttttaatgatgcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgttttttaatagatgacgccgttgactttttctcacatgtttgaccattcgtcttattcaaaaattttatgcaaatgtataagatataaatcatacttaaagtactatgagtgataaaacaactcataacaaaataaattataattacgtaaattttttgaataagacaaatggtcaaacatgtgagaaaaagtcaacggcgtcatctattaaaaaatggagggagtaattgttagtttgtcactgtgaagattgggatatgatgaatgacagtgagaaactggactggcaaatcctcgtgtgcctctgtttggcgccaaaccatcgaactgcccggggttcctttgtttgagctgccttaaaacattatgtaaattgtaaagtgcgatatgaagatctttatagtgtaaaatttgatgtctctcggtatattaagctaaaaattattgtcttttggtacctctggaaaactgtaaaatttctatgtaaaattagcataataaactcaatggaattgaattctaatccctcgagcaaatatttgctatatgcttcccattcataaatggaatacaagtagttaagagtgcgtatttattaaaaaaattatatattttcactgaaaaaaaatccatctctgatagtcaactgcccagtagtggtagtgctacctatccaagagtgcaaaggcatatgaacagatccaacctaattgggcctagttaataatcaatagctgtactactagaattcgcatcgagattctcttctctagctaccacccattttcagtgctacaaattaaatagccatatgcatgccctaattaagtaattaattaaatcgatactccctccatacttgtaaaagaagtcgtttaggacatcgacacgatctctaaaacacaactttgacttcttatttctataaaaatacttattgaaaaatgatatacgtatatttttatgaaagtgtttttcacgacaaatctatacatataatttttacattttcaaactcaacaacttgagagttattcatgttttatattcctaaggtttgacttaaatattgtcctaaacgactttctatatccgataagtatatgagagtatccgatacgtatctatatccaatatgctagtttttagaagtattcaggtgacatacgtagtaggtagctagtcgtgagccatggacaaatatatttccacatgcatgcacggcagtggtcagaaaaattccaacaaattagaagaggagctaaactaattgccatatttcaactttctcttgtcttacaaggtggacttggcacatgtgcgcacgtcccgccataatgccacctaaatccggccaacaatttttgacagtcttattgtcttaggcccaagtgttcaaccttaagatcatccactatcacaagtggaggattaatttgtatgtgtccaggtccataattcttcctcatgccatccaagtttcgttccttttcggagaaggaattatatatattaatttcaccctaagacaacacgatcactatcaaattgcaagttgtgaaactgtgtgaaacttcgcagagcccctgttaattggacatgcaggctgctaatatgaccagatgtaatacagtgtggttgataccgatcgatctcggccgttgagaaacagtgaaactttgcagtaacccagggattcggatcctctgcattaccgcagagaggcactgtagccacagtgatatgtgaggggaacagtgtgtcaatgcacagaacactaccgctacagtgatgatttactgtatctacagggataaaattgataaaagttcgccgcgcgagttacggagtgatttttttttgtcacgaacgcacccaatgcacttcaatatgtccaaaaaatcatgttttggtgttttttaaactttttcattctggtaaaaaacatcgcacccacgtgtgccaatatatatcaatattgactttaattgacaaaggttagccgcgcgggtcacggagtttttttttttttttgccacgaaagcacccaatatactccaatatatccaaaaatcatgtttttgtgatttttgaacttttttatttcaatgaaaaacatcatatccacgtatgccaaatataaattaaacaccataacaagatcttagctaaggtagctaacacggactctttttatatatatcttggacagtacgtactgtcagttaattaatccaattgaatgatgaattaatgaatacacaagatgaataaaaggtttgaaaatggaagtggtgacgcgcgcggcagctccttgctgacggaccaagattacgcaataaaaagcgaggaacgacacaggcctagactggttggaattaattaaggtttgtaacagcaataatgcaatagttaagtaagtttttccttgatgcatgttaaccatttcgacggaagtcggtcaatgatgaagttgaggtgttgggttatgaagggacatttttttttttgcgggaaaggagattatattactgagaaactagctagctcctcgttaacgaggagagagttaaaaaattacagctattatcagaccaaaagcccttattggctaaagtatggctacaaccattttgacttgggtgaatcttcttgatgaagggacaaattaattgatgtacgtagaaagaggcacgttggctaaatatataaccagctagctgcaacggaaaaggttgactaacttgcgattcgttaattaaatggtgcatgaatctggatcgccaacagctagcgtaacatgcatgtagattccatccatcgtgtgccccggccgcatatatatagacatgcatgcatgctagctgatcagtatgtgcagatctgctataagcttaagctcagcttaattagccacggtacgtagtttgtacagaaatggcggtgaagaaacacaacgtcgccatgcaattacaagtggtagtactgtggcttgtaggagtagcattattttctgtgatggcgtcgtccgctccggcggccgtagcggcagcaccgccgcccgcggagtgcccgagcaagtgcggcgacgtcgacatccccttccccttcggcgtcggcgacgactgcgcatggccgggtccagatgacttcaacgtcacatgcaaccatagcttcagcccacccagaccctactacggcaacatagagatcagggacatctcggtggcggcgggggagatgcgtgtgtacactcccgtggtctaccagtgctacaacacatccgaccacgtcgactcttcaaccagcttcctgcagctcaacatcaccgactcgccgttcctggtcgctccggggagaaacgagttcacggccatcggctgcgacacgttggcgtggctgcagggcagggatgactggagcttcttgaccggctgcatcacgacgtgcgtgagcttagacgaggctgcccacgacggcgagcagtgctccgggctgggttgctgccaggtgccttccattccgcccaaccttgccctcgtagagctgaattgggggaacttaacaaaaaactatgcatggagatacagcccatgcagctacgccttcgtggctgagaaagcatggtaagttaaatagtagtaataaagaaaatctagctatcaactctggtaacacaattactactccatatgcattggtgctaatattagtatagggacaattgcgtttttaccctattttaaggactaactactaatttggtcctgcttttttagttgaccctcttttttataaatgaaggcgagacttggccctactctgggaagtcaacatgacggtgttaacttaagacaaatgtttcatttatacccttgtgaatttaacccagtttcttaaagttttttattcaatgcagttttgtgcacttattactatatattaaattgcctcaaacacaaatatggcacggatttatgtctaccaaaaaaaagaaaagaaaaaaaaaacatgccacccctcctcctcgtagtcgaactgccgccgccgccgctcctcttcgtcgagccgccgccatccctcccatgccgccgccgccgccgcagccactcctccaccttgtcaagccgccaccaaccctcctattcatttagccaccgccggacggcagccattgcacaaggagagcagcgggaggaagttcctctaaggccgccgccgccgctccctccctacacaagccggcgtcgcctcgccgctccctccctccgcgagccagcgccgcgcggatcccctccctccacgagccgccgccgacgccagcactcggagagagagagagagagagagagagaggggatacgggggagagacgggatagataaggatagggtttgttcgagggtattttggtcattacgaaatgtaattatatttctttcttttttttaaaatgaaaacttaacggtgctatgaaaacatggtcaaacggagtgtttgttttaaaaaagtagggtcaaataaacaaactagaaaaaatagggtcatattagtagttaggcttcaaaacatagtaaaaaagcaattgtcccattagtatatgttgatttaggcaccacatttataaattaaactatggtagtttatagaatttagagcagatataagcgcatccttcttctacttactttaataataattttataaatatttctggtgaaccctacattcattttcatatttttaattacatataatttatgcatagaagaatgttatattattttgtgaatatatatttctgttcttattatatactattatatatagcacactcaaaagaaagagagagagaaaacaatatatcatatgcgggcgtgatctattggggcggggtgtggtaaggaaattacagtttgcattgtgttctctccgtagtttttctcaaaggcatgtatatgttatcacgtgaaactatttatacttctttaaaagatctaaatggtggtgttgagtgtggtgaatttgacaccaccaccattatgtgggtccccgcaaatagtgaggtaggtggacttttgtccatttcctaacctcaagccatcaaacatgaagttttttttttgagtgagataaaaatgattaaaataatatgacctaaatattttacaatgagaatagctttattttaattttggaggtttaaagtgtacggtgaggctctcatatttaatttccattgtaacatggaacggagggagtatcattcatggaaattgtggagttggcaacttactgaggatagatgtagatatctgacccattttcactccctactcaacaaactggactgtttagctagggcacccattgagtttactgatgcacatatatatattataatatatataggtacaaattcagccgtggagattttagccgtgccggtagcaagagctttatgaatcgtgctggagacagaagtgtcgttacagtgcttgattgggctatcaggagcgacggatcgtgctcgtcaacatcgcgggtcgctcctgcctgtgtcagccccaacagctactgcgtcaacaccaccaacggacagggatatctttgcaagtgctccccgggatatgatggcaatccctacgtcaccggtgacagtgggtgtacaagttagtctttttaatcaattatgtttagttagtcttttaatttccggctctatattgatatgcatgcatgcatggactaatattaatttccttcattggcatgaatgaattagttactacttcttgtatgtaggagtacgttgtaatctttgctgaatttgctcgtatgggattggttaatatgtttaattatactatttagtatttcatcaccaattattatatgtgcagatattaatgaatgcaagcttagaagagaagaccctgccaagtacagtgaactttatccatgttacggtggtagcaaatgccatgacacagagggtgattacaggtgcaaatgccgtttgggacgtagaggggacggcaaaatcgataatggatgtcaacccataattcccccacctgtaattgggattcttggtgagccatgaccattgttcatacttatagcgttttttaatagaaattagagtaaattttagaaaacctcacgcttttatgatcaaggttaaataaagccacatatattatgatgcgtgtcacataatctcacaggtttaatgtatgatctttgtgttttataataagacttcacctttattaaaatcttgattaattacagtatatatatttgaaacaattttttcacagtagcgaagagataaactatatatcaaccatactcaagaacataataatttaaagttttatatacaccatatgttttcaactttaagtaaattcatgctcaacatgcataaagatagggttttatgaaactttagagccataatacatagagttaaagtgccacaagtcataatacatgtggtttcgacaacttcagctatgtataaaacatgaagtttttgaaatttactcaaataatcaatgtattatgacttaagttgtagctagttactccctccgtcccataatatatgggattttgagtttttatttgcactctttgatcactcgtcttattcaaaaaattttggaattattttttttatgacttgctttattatccaaagtactttaagcacaacttttcgtattttatatttgcacaaattttttgaataagacgagtggtcaaacagtgtaaacaaaaactcaaaatcccttatattatgggacggatggagtagttagttaagtagttagttaaagcgtcatcatttaatattgcccctacttaagtatagctagttagttatatatgtatgtaacgtagctaatatattgattaatggtgctttctctaatctatactttctatagagttaaaaggccaataaatctaaagctcaatatgcaaccataccacaccatcatccactagcaataattacatatttaatctcatacaagcatacaacatgatctacaatttttttaattctagaaatcaaaatacaagcatattcaatcatcacccctcatatcatttgcataatattttaacaaatctatctatcaactttataatatttaacatgtacttatcaatatcaatatgtttcacactaaagcacgggtatcatttgactgataaaccttgatgtttcattattttcttttcttttttacacctaggttgattgtcaaaaaaaaaatattgagaattgcttagtaattcctgcagcaaatcacggggaatcacctagttacttatatgtttaattggtttgtttgcatttgcagtgatagccggtgttgtgctatttggtttggtccttgtgtgcttacgtaagaaatggaagcttaaagggtgctatgaccgtaatggtggccaaatgctagagaagacgagcgttaaaatctttacaaagcaggaattggacaagataactaacaacaaaagcaacaagatagggaaaggcgccttcggtgtggtctacaagggaacccacgacgatcagccggtcgccgtcaagtactccatcgaaaagagcatatcgcggactcgtggcaaggatgagttcgtgaaggaaatcacggtgcaacttcaagtcagccacgacaacctggtgtgcctcattggttgttgcctcgaggtggaggtccctatgctggtcttcgagttcgtccctaatggtagcctcgagagcgtccttcatggggcagagcggtgcgctctcccgctgctgaaacggctggatattgccattggctctgcgaaagctcttacctacatgcactcgcattcccgccgctgcatttttcatggtgatatcaaacctgccaatattctccttgacgacaaccttatgcctaaagtctccgactttgggtcatcagagtccgtattgaaaaccaagcaccgaagcgtgtgtgccgacatgggctacatagatcctgtgtatatggtaacaggcaattttagactgaagagtgatgtctacagtttcggtatcgtggtcttagagctcatcacccgaaagaaggccgtgtacgatgggaaaagccttccgatagaatttaccaactgttacgaggatgataatgccagaaggaatatgtacgaccaggacatattgtctgcagaggctctacaacctcactgcatggagtgcctcgacagaatggccggcattgctgtccagtgccttgaatacaacatagacaagaggccgactatggcggaggcgctacaggagcttatccaattgagagcaaaggttgcaggaaaatgaatgcaaggtccgatgttcagacaacccgtatgttgatagtttcgctttgtatcgtcgttaatttattatcatatcccccagcaaatgtcgacgttggtttgagttgaccaacgggtcattttaatttatctttttggcggggaagtgtcgttttaattagtatgtgtaccatttaccaacaaagtggcaattaaaagcaaaaataaattaagcagcatagtaagaaagttttcatccgatcaagcatatatatatatatatatatatatatatatatatatatatatatatatatatatataggcaacatatcctatgcacacaggccatcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgcataggatacgctcccatatatatatacctcccataccaaaccatggcatatttcatttagtggaatgttacggtccttcatatatataaaaggaggtctcaaattaatactgtacgtccatttagcaaatcatttttgatcgttagatctagcaatgactatcctgtccagctaaatccaacgatcggaaataccttgagatattttttgctagaccagatcaaatctcataattttagctatagcgatagctgatgcttgcatcagctgctggacctgacttggcccgcccagggggtaatgggcaacagacttgggccaatgggccgaaatcttctggcccaagaaggaggatcagcaacccaattagccaacttgctcgagcatgcatatgcatgcaaagtaaattaacatctcaatcaacaggacacatttaattctgtcaacttattattatattgatgtcattggccacgatagagatgctcgctctgcgtgcttcagatttaactacttaattccacaccatctactagctttgacccccaaagatcaaagacagccaaagcttgggagtacagtattcgaagatctgagatgtcctatatgaattaatttagtcttgccttgtcgccttggtgtaatatcatgcatggctacttacacttctttacttaatggtatgttcaattacattaattgatctgcttgttgtctcataaaaatattcactgctcttcttatgcatgcatctgcttcaattactacaaatactatgatttaagtgtatctagatttctagaattccccgtcttgtcaaggttgatagatggatactcctcattttagaatacccgtcattctagcgttcaaattatatatcaaaatacttgtcattctcatatttcatcatagcatgtttatatttcatcatagcatgtttagagaggtgaagttcctagcttccttgcttttcatcttgggcaattgcaaatttaccgctactttaaatcgttattacaagactgtcactacaaaattgcaaaaatgacactagaactgttattcgagtggcatccttacaacattaaaaaaacggtggcaaatttgcaaatgcccctcatcatcatcaaatgtaaccatgtgcagctgttaatcacaattgacagctactgtaaagaactattcggatgtccttaatgagggtaatgatgtaatttgtcatatcccctgtttgatctgtaacggagaggtatctgttttccttactcaacttattaacacgggaaaatgtgttctcacggcatagtttcgctgaatatatatacacacacacagtaataagcagtttccagttcttgtaaggtctggagtgttatgggtcactttttctttccaattggaggcacgttcaagaacacatgggttcttaatatagtacacttaatataatgagctctagatctagatagacggacgatgggcggacctggagcacagcgtcataaggggataggctagcagcagcaggcaatgtgtggatccagtggccatgattggatttatattgctgaattggtgaattttagggactatattggatttcgattttattttatttttgctccaaagatattagcgaatgcgagtctcttatcagggccgcgtacgaaaatcaattttcatttgcgtcgagggaggcacctatgaaaaagattgattttcacatgcggtgtgtccatctgctgccagctgcaaaatccattttggccgtataaaaataaatttgatagtagccggtactgatataaattaaacaccataacaagatcttaggtagctaacacggactctttttatatatatcttggacagtactgtcatttaattaatccaatcgaatgatgaatgaatacacaagatgaataaaaggttttaaaatggaagtggtgccgctagtgacgcacgcggcagctcctgttgctgacggaccaagattacgcaataaaaagcaaagaaggactcagacctagactgggttggaattaattaaggtttgtaacagcaataatgcaataattaagtaagtttttctttgatgttaaccatttcgacggaagtcggtcaatgatgaggttgaggtcttgggttgtgaagggacaaattgatgtacatgtacttatagagagaggcacgttgggtaaataaccagctagctagttgcaatagtatagaaaagtaagttttgactaattaattaacttgcgattaattggtgcatatgaatctggatcgccaacagctagcgtaacatgcatgtagattccatccatcgtgtgccccggccgcatatatatagacatgcatgcatgctagctgatcagtatgtgcagatctgctataagcttaagctcagcttaattagccacggtacgtagtttgtacagaaatggcggtgaagaaacacaacgtcgccatgcaattacaagtggtagtactgtggcttgtaggagtagcattattttctgtgatggcgtcgtccgctccggcggccgtagcggcagcaccgccgcccgcggagtgcccgagcaagtgcggcgacgtcgacatccccttccccttcggcgtcggcgacgactgcgcatggccgggtccagatgacttcaacgtcacatgcaaccatagctttacccctcccagaccctactacagcaacatggagatgaaggacatctcgctgccgaagggggagatgcgcgtctacacttccgtgctgcaaaactgcttcgacttgtccaacaccagcagcagctccgagtccgacgtaggctcgccatggctcgacctcgccgggacgccgttccttgtgtcgccggagaggaatgagttcacggccaccgggtgcgacacgctggggatgatgtacggcagggaggacgggagctacttgaccggctgcgtcacgacgtgcgcgagcttggatgccgccgccaacgacggtgaccactgcgcggggctgggttgctgccagatccagtccatccctacaaaccttaccttgctaaggattgtgctgtcggccaacatcaccgacaggaagattgctgcgtggaacccatgccgctacgcctttataaccgaccgagacgggtacgtgcttactacctccttcttagaatatactccctccgttcctaaatgtttaacactgttgactttttaaaacatatttgatcacttgttttattcaaaaacttttatgaaatatgtaaaactatatgtatatataaaagtatatttaacaatgaatcaaatgataggaaaataattaataattacttaaattttctgaataagacgaacggtcaaacatgtttaaaatagtcaacggcgtcaaaaattttaggatggagggagtagaatgtattttgtttcgttagtatatgatatattatactttatgacgcaaaaatgaatatattagattatcaaaagtatttacttaattatgatatagtattatactttattagcatataaatgatatcctcatagaataattgttgatcaaagtcacacatacctatcaatatcttaaaatgtattttaataaaatcgtatatttgttgatatttctatatatattggaatagaaaataatggtcaaagtttttggcaccgtgttcttgttcaagacaataattattttttaatctggagggagcatatggattgagaagttcattcctcaaaggttatgcacatacttttccgtactcgtaaaggaagtcgtttaggatagcaacacggtctctaaaacacaactttgacttcttgtttctacaaaaatatttactgaaaaatgatatatgtatacttttataaaagtatttttcaagacaaatctattcatataatttttacattttcaaactcaacaacttaagagttatttatgatttatatttctaaggtttgacttaaacattatcctaaacgacttcctttatgagtacagagggagtatgtacgtttatgacaagttctgaaaacattaaattgatgacccttgtaaaatactatcccaaattaaggactaaaatgacccaggagcgaaactttaaggaccatattaactattctccttatattatgcatgccaatatctctagccatacatatatagtatgtagctattcatagtatgttatgtttactagtttcaaaccatccattataattaggtactatatattatttattaaaaaatatttagaatttaatagtttataagaaatttaactttttttaatgtaataccttattgtttcaattatatttgttaattattaattcaaaattgttctacgggacattcacgacgatggctgacagggatgatcaatttgacggttttgtgccattcctgatgttaaaaaccgtgaggaaaaaaatatctttctggtagaatatacccacagcaatgtgcatatggcatcctgtagatacacacgtatgagtaccgcaaaaaatgacattttttctccctttatttcttaatataattattatttaagtagaattatatataaatatacaaatttagagacggcaagaaaatttgtaccaacatatagcaaaactagctagtgagatgcgctattttctcaagacataatatgcctagtgccattttaattaattaattgactaattaacgaatggcccaccaagatatttgatgcagaaggcaatcgatatctgaaaaatatatatccgatcgagtaattaaacatactatttcaatattaagatctaggattttgtttttaatcaggcaattcaggtacaattttagccggaaggatttgggtcgctcaggcaacaagatatttgcaaaccgggacggcgagatggtcgtccctacggagcttgactgggccatcaggggaacaaataggtcatgctctgtctgcgtcagcgaccaaagcgactgcgccaatgccactaacggagacgggtatctctgcaagtgctccgagggatacgacggcaatccctatctcaaaggcaatggcggatgcacaggttagttcttaattaaatttccttaattctccatcatggattatactcctatatcattactagtacagtatcactcattgacaatataatatgacgattatttaaatttactgttttaccattgatacatgtgctgcatgcagatattgacgaatgcaaggaaccagatcgttgttctactggcagcagatgccataacacagagggttattattattgcaaatgccgttttccacgtagaggggatggcaaagttaatggcaaaggatgccaccttcccaaatatatagtcccgacgcttggtacgtaaataagcgttaattaattattctccgcacttattactatagcattacattactaaagtctgatttaagaaacaccctaaagttctttcggctagctccacaaagtggtgggctagctagtttgggtctgaagctctatccctacagtttagttgatattagatccttccctaacattcgcagtgcagtctgatttgaatcaatggctcattctttcaattgatcatttgatttgtctgcatatatatatacagcgacggtgtgctctgtgatttctcttacggtccttgtgtgcttgtataagagacggaagagaagaatgtttgccaacaacaatggtggccggctgctcaaggatatgaacatcgtcctcattacggagaaagacctaaacaagatgacaaagaataggagcaccaagatcctcggagagggttccttcggcaaggtctacatggaaacccacaagaaccagccggttgccgtgaagtactccaagggaaagcgcaagctggcacagacgacgcatggcaaagacatcaagtgcatgaacaagaacatgttccaaaacgccttttgttggtccaaagttccatcctcgccggaagaagattcgtcgtcacgagtgtccggcccggagttagtggacgagctaagggtccagtcactaatccagcacgaaaacgtggtcagtctcgttggatgctacatagagacggaggaacccacgttaatccttgagtttatcccaaacgggagcctcgagaaaatgcttcatggagatgaccggcgccccctctcgctattaattgcagcgccttgacatcgccatcggctctgcgaaggctctttcctacatgcactcctctagccttatgcatggagatgtcaagccagccaacatcctccttgatgacaacctgaaccctaaggtctctgactttgggtcatctgagctcatattgaaattcaagcacgtgtgtgttgacaagaactatgtcgatcctgtgtgcatactgacgaacaagtatactatggagagcgatgtctacagctatggggtcgtgctcctggagctcatcacccggaaaagggccaagtacgacgatgaaagaagcatccgagtagaatttgtgaaccagtacaaagacaacaacgaaaggaggaagatgtatgaccaagacatgttgtcgtctacggattccctatatccttactgcatggagtgccttgacaggatggcggccgtcgcggtccggtgtctgaaaaacaaggtggacaagagaccgaccatggcggaggtcgtcgaggagcttaagcagctgagagagcaaataagcacgcgtatgtcctagctagccggcttgctgcaagatcagctcgtgtagaagatgaatgcttttctctgcctcgttcttcagtctctctattagttaactttcctttgcctctttgttaatttctctccaccccagcagatatcacgtactcacgttggtttgagttatgtactatattccaccgtacgtttcaattgttatccatgtagtgttttggtactatgttgtttaaaaacaagtgttgttgtgctgttttttatcttttgctataccttttgtagatgtggtctgcatataagcgatatatatatataccagctcctgtaatcctgttatccctccttgtgcaataataaagtacctcatttaagtatttattgtcctacagaaaaactgaggtgccacgtaacggtactgcaaccggtgtacgtggcatatcgaaaatgggccgttaaacaaaacgtcacctgagccaggccgttaaatgtgccaaaaacgagagaagcgaccagaagaggaataagtctgcttatgtaatacttaaaaaaatggggttaaataagaacctctgatagtatgcatgactgttttagctaatgtgacatcctagtcagcaaagaagaaactactcttttcgtttcaggttacaagacattttaactttggtcaaagttaaattgttttaagtttgactaagtttatagataaatatagtaatatttatcatactaatttagtttcatcaaatcaataattgaatatattttcataataaatttatcttgatttaaaaatgatactattttttttctataaacttgaacaaacttaaagcatggttaaatcgtcttataacttaaaaaaacatatggagctcacgtgtaagtgagttatctctctcatccttcttgagctgaggctcgtcggcgccggatgcaccaacgaataggttattttcaaaaataaattacaaataggtcctcagaagctaatgatagcgcaaagcaagtcaatcttccagtgctgcaaactgatctcaatcttattttcgccgttctaattccaccggcggattgtggcgacattttgatccaactttaaaaaagaaagctcaaacaaggttccaatcaaaaccggtgcgtgcatgattggtcaacagtcaatatattcgactcatatgtacattgtatctatcaaggtcttgattggtcaagagtttgaaagaaaacaagtttcacgccccacatgtggagagaaaacatccaagagctcattgattaccgtcagtgagccaatcaggaggagcgaaatacatgtaatgtaatgctttgttagttcttagattgttgccagttaattgccacaaaagcatcacttcagcgtcgccatggcgcctggatctccagtatgcatcagcgtgtccgctctgctgttgatcactttgtcccctgcggttgctgctgctgctgcttctcctccagggaggagcaagagcaatggcagcgacaccgatctcgctgcgctgctggctttcaaaggcgagctctccgatccctacagccttcttgccaccaactggactgctggcactccgttctgccggtggatggggatcacttgcagccggcggcagcagcagcgtgtcaccggagtggagctgcccggagttcccctccaaggaaagctgagccctcacatcggtaacctatctttcctctccgtccttaacctcaccatcacaaacctcacgggctcaatcccagacgatatcggaaggctgcatcgcctcgagctccttgatcttggcaataatgctttctcaggtgtcatcccagcctccataggcaacctcacgaggcttggcgttcttcgtctcgcggttaaccagctctctggacaaatcccagccgatctgcaaggcctgcacagccttcgcagcatcaacattcggaacaatggcctcactgggtcgatcccaaacagtctgttcaacaacacccctttgttatcttacctcaacattgccaacaacagcctttctggatcaataccaccttgcttcaattccttgacttgcaggtcaatcgtctcaccggaccggtaccaccaggcgtcttcaacatgtctatgctaggagttattgctcttgccttgaacggcttaactggccctatcccaggcaacgaaagcttcagactcccgagtctctggtttttctccgttgatgccaacaatttcaccggtccgataccacaggggtttgcggcgtgccagcaactccaggttttttccctcattcagaacttattcgagggtgctttgccatcatggctgggcaagttgacgaatctcgtcaagctcaacttgggtgagaatcacttcgatggtggttcaatccctgatgcgttaagcaacattaccatgctggcttccctagagctcagcacgtgcaacctaacaggaaccattccagcagatattggaaagcttggaaaactttcagatttgcttattgcaaggaatcaactaagaggacccattcctgcttctctcggcaacttatctgcattatcacgcctggatttgagcacaaacctgttggatggatctgtcccagcaacagttggcagcatgaactctttgacatactttgttattttcgaaaatagcttacaaggggatctcaaattcttgtctgctctttccaactgtaggaagctttctgtccttgaaatcgactcaaattatttcaccggaaacctcccagactatgtgggcaatctatcaagcacgctgcaagcattcatcgcacgtcgaaacaatatatccggtgtccttccatctacagtttggaacttaactagtctcaagtatctagatcttagtgataaccaactgcacagtacaatatcagaatcaatcatggatttggagatactacagtggcttgatctcagtgaaaatagcttgtttggccccatcccgtcaaatatcggcgtgctgaagaatattcaaagattatttcttggaacaaaccaattctccagctccatatcgatgggcattagtaacatgaccaagttagaatacctagatttatctgataaccaactagcatccactgtaccaccgagcttatttcatcttgatagacttgttaaactagatctgtcccacaatttcttaagtggtgcattaccggctgatataggctatttgaagcaaatgaatatcatggatctctctagcaaccacttcactggcatcctcccagattcaattgaacttcaaatgatagcctacttgaacctatcagtcaatttattccaaaattcaattccagattcttttcgtgtgcttaccagcttagaaactttggatctatcccacaacaatatttccggtaccatcccggaatacctggccaattttactgtcctttccagcttgaacctatctttcaacaacctacatggtcaaataccagaaacaggtgtcttctcaaacatcacgctggaatccttggttgggaactcagggctatgtggtgctgtccgtttaggattttcaccatgccaaacaacctctcccaaaaaaaaccatcggatcataaaatacttagtccctcctataattatcacagttggagctgtagcttgctgcttatatgtaattcttaaatataaagttaagcatcaaaagatgtctgttggtatggttgacatggccagacatcaactactctcctaccatgagcttgctcgtgctactaatgatttcagtgatgataatatgttgggctctggaagctttggaaaagtttttaagggtcagctgagcagcggtttggtggttgccataaaagttatacaccaacatatggaacatgccattagaagctttgatactgagtgccgggtgcttagaacggctaggcatcgcaacttgataaagatacttaacacttgttccaaccaggacttcagagcactggttcttgagtacatgcccaatggaagcttagaggcactcctacactcttatcaaagaattcaattaagtttccttgagcggttggatattactccctccgtcccacaatataagggattttgagttttcgattgcagtgtttgaccactcgtcttattcaaattttttttgtaaatataaaaaatgaaaagttgtgcttaaagtactgtatataataaagtaagtcacaaataaaataaataataatttcaaaaaaaaaatgaataaaacgagtggtcaaacgttgcaaacaaaaactcaaaatcccttatattatgggatggagggagtatgctagacgtttcaatggcaatggaatacctgcaccatgaacactgtgaggtggttctgcactgtgatttgaagcctagcaacgtgctatttaatgatgacatgacggcgcatgtgtcagactttggtattgcaaggctgctgttaggtgatgatagctccatgatttctgctagcatgccaggaacagtcgggtacatggcaccaggtaagctagtatcatctgttcttgctgaatccttgctgatcttttatagagtaattatcaagtggtgcaactaatgtttggtggtcattttttcttgagaagagtatggcgcccttggtaaagcgtcacggaagagcgatgtattcagctatgggatcatgttgcttgaagtgttcactgcgaagagaccaacagatgctatgtttgtgggagaactaaacatcaggcagtgggttcttcaggcatttcctgcaaaccttgtccatgtcatagatggccaacttgtacaggacagctcttcttctaccagtagcattgatggctttcttatgccagtgtttgaattgggcttgctctgctcgtctgactcgccagagcaaagaatggtgatgagtgatgttgtcgtgacattgaaaaatattaggaaggagtacgtcaagttgatagcaactatgggaagagatgacaaccgaacagcagtgttccattgaccctgcttgactgcgtatacgaaagaacgaatcatcctctgcatccatatttgcttctgcattaagaataacagaagaatagcatcaattactctttacttctttatgtgtatggatgaatatgaataaatctcttctgtttcttagttacacaatagttaaattgcgtacatctgtgattgatctgctgctacataaatttgcacgcaccatgacatggcagtaaatgatcttgtgcgcaggtattcttatgtccagaccaacattaaaaaaaaaatctaaactacaaaggactgaagtttgggtgcaagcattcaacataagacatggacttgactggttgcatggcacacctcctctgctcataggtcacaggatagttttctttatattatatattatcttgtttacgatttgaaatgtttgatttataacattgaaatggagagaacaatgaacacactgcctaaacggaaaatggaaatatgattatagttcttatttaggacatacagatgataccgaaatcaacgagtacacgacagttcaagagataatctttagtaagaataaaaacatcatcaaccaatgggtagtagatagataagtgaagaatcacgccagttagctaccacgattacgatgtgaagaaacaggacatggttcaaatcagcatacgagttgtgaaaagcaaacacattttcatggagttgtcagagatcaaataccttgaaatccttcttcagagactgaaagtagcacagcatcttgatttactgttggatgccgcacgccgcgtggtcacttggccaaatatgcatggttaggcaagctgtccagtctcagattccttagccttagatgtgatcttttagctcagagtgtacaatctgctggctggatgcctggattgttaccagcaacatttgtagcatcaagtccttgatgtctcttgatagtatttcagaaatttgcctagcaattgtacagaactatggctactgatgatgattagtaccgaaaaataatttcacagggaggatctccggctgtgcacggaactatggctactccagtttctagtccgttcaaacttcaaaattgtattactgcatatgattggtcagcagtcaaatatattcgacttatatgactagctagttagctatttgtccactatctatcaaggtcttgattagcaacaagttaacaactcacaactgggaaagagaaaaggttgcatgctaatttccatatggaccagcgaaggaaaaactgtggacagttggacttgttcacgtcaggttgagcaatagtgaaggtcttggatgtagacagaaccagatgcctgcacgcacaattgaatggagagctaaatatataaattaacctcaacccgatgattcctgtcttgccaacgcataagagctcagacatggcgtttagaatgccagtacggatatctgttgtgctgctgatcatcgctttgtctgcagtgacttgtgcttctgcagttccgagcaagagcaatggcagtgacactgactatgctgcactgctggctttcaaagcgcagctggccgaccctctcggcattcttgccagcaactggaccgtcaacacaccgttctgccgctgggtgggcatccgatgcggccgccgccatcagcgcgtcactggcctggtgcttccaggcattcccttgcaaggagagctcagctctcacctcggtaacctctctttcctctccgtcctcaatctcaccaacgccagcctcacgggctcagtcccagaagacataggaaggctccatcgcctagagattcttgagcttggctacaattctctgtcaggtggcatcccagccaccatagggaaccttacaaggcttcgagttctttacctcgaatttaaccagctatctggctcaatccccgcagagctgcagggcctaggaagcattggtttgatgagcctccggaggaattacctcactggctcaattccaaacaatctattcaacaacacacctttgctagcttatttcaacattggcaacaacagcctttctgggtcgataccagcctccatcggctctttgtcgatgctcgaacaccttaacatgcaggtcaaccttctcgcaggaccggtgccaccaggcatcttcaatatgtccacattgcgtgttattgcacttggactgaacaccttcttaaccggccctatcgcgggcaacacaagtttcaacctaccagctctccaatggctctccatcgatggcaacaatttcactggtcaaattccactggggctcgcatcgtgtcagtacctccaagttctttccctgtctgaaaattattttgaaggtgttgtcacagcctcagctgcatggctgagcaagctcacgaatctcactatccttgtgttgggtatgaatcactttgatgctggtccaatccctgcttcactaagcaacctcaccatgctaagtgtcctagatctctcatggagcaacctcactggagccattccgccagagtatggacagcttggcaaactcgagaaactgcatctctcacagaatcagctaacaggaaccattcctgcatctcttggtaacatgtccgaattagccatgctagtgttggagggaaacctactgaatggatcattaccaacaacagttggtagcatcagatcgttatcggtacttgatattggggcaaaccgcctgcaggggggtctcgaattcctgtctgctctttctaactgtagagagctttatttccttagtatctactccaattatctcaccgggaacctcccaaactacgtgggtaacctgtctagtacgctgcgattattcagtttacatggaaacaagctagctggtgaacttccaaccaccatttccaatttaactggcctccttgtgctagacctttcgaataaccaactgcatggtacaataccagaatcaatcatggagatggagaatctccttcaacttgatctcagtggaaatagcttggctggctctgtcccatcaaacgctggaatgctaaagagtgtagaaaaaatattccttcagagcaataaattctctggctccttaccagaggacatgggcaacctctccaagttagagtacctagtattatctgataaccaattatcatcaaatgtaccaccaagtttatctcgtcttaatagcctcatgaagctagatctgtctcaaaacttcttgagtggtgtattgccagttggtataggcgatttaaagcaaattaacatcctggatctctctaccaaccattttactggtagcctctcagattcgattgggcaacttcaaatgattacttacttgaacttatctgttaatttattcaatggttcacttccagattcttttgctaacttaaccggcttgcagactttggatctatcccataacaacatttctggtaccatcccgaagtatctagccaattttaccatcctcattagcttaaacttgtctttcaacaatcttcatggtcagataccaaaagggggtgtattctcaaacatcacgttgcaatccttggtggggaattcagggttatgtggtgttgcacatttagggcttccaccatgccaaacaacctctcccaaaagaaatggtcacaagctaaaatatctgctccctgctataaccatagtagttggagcttttgctttcagcctatatgtagtcatccgaatgaaagttaagaagcatcaaatgatttcttctggtatggttgacatgatcagcaacagattactctcctaccatgagcttgtccgtgctactgataatttcagttatgataacatgttgggggctggaagctttggaaaagtttataagggtcagctgagtagcagtttggtggttgccataaaagttatacaccaacatctagaacatgccatgagaagctttgatgcggaatgtcatgtgcttcgaatggctagacatcgaaacttgataaagatattgaacacttgtaccaacctagacttcagagcacttattctagagtacatgcccaatggtagcctagaggcactcctgcactctgaaggaagaatgcaattaggtttccttgagagggtggacattatgctagatgtttcaatggcaatggaatacctgcatcatgagcaccatgaagtggtcctacactgtgatttgaagcctagcaacgtgctacttgacgatgatatgactgcacatgtatcggactttggcattgcaaggttattgttaggtgatgacagctccatgatctctgcgagtatgccgggaacagttgggtatatggcaccaggtactagcagcttctgtactcttgctcaaagtagtggtattttcataattatcgtatggtgcaatcaataagcattgaccaattttattcctgcagaatatggtgctcttggaaaagcatcacgaaagagcgatgtgttcagctacgggatcatgctactcgaagtgttcactgggaagagacccacagatgctatgtttgtgggggaactgaacataaggcagtgggtttaccaggcgtttccggtagagcttgtccatgtactggacacccgacttttacaagattgctcttctcccagtagcttgcatggcttccttgtgccagtgttcgagctgggcttgctttgttcagccgactccccggagcaaaggatggcgatgagtgacgtggttgtgacactgaagaagattaggaaggactatgtcaaatcgatatcaacgacagggagcgtggccctgcctgcatatacgaaagaatgaattgtcctctgtgtccatttctgcttctgcattaagaataacaagagaatagcatcagcaacatgtccagtggtcgattaatctttgcctctatatctttattatggtcgaatatgaacatatttcttctgttcgttagttacacaatatttgattggtgtacatgtatgattgatctgttgcttcatgaattttcactgtaaaaatgggagtaaatgatggatgttgcttgaatgtgcttactttcaggtgaaaataataataatagaaaaaagaacattgtaaacctagaaaaggaatcaagtttgggtgcagacattggacattaagacatgggcttcactggttgcctgacatgcccgctctgttcatagcccataggatatatagtcttcctcatatcctctttccaatttgcacaatcttttttttttttgacaacatagaaatggagagaacaacgaacactacccaatgggaaatggaacgcaacagtccaagagataatcattactaagaacaaagatatctagtagatgaagagatcaagcaatgtgtagatgttggatatgagatggttcaagtgagcattggagttcaataaaagcacatattttcatgggggttcgcagagaccattaccctcaaatccttccttcctccgagattgaagcagcatacccgcagggtgcgtcgccactcagccaactccggcgcacgcggcagcgtcgaggtggtcctggatcttggcggcgatttgcagctggccggagcgaagaggtactggagattggggcggcatgagcagttggtggaggaactggagatggacgaggagatgggagcagtggcggagtcctgggtaggacagggagcccgcggcggcgtcggagagagtcggcggcggcggcgaactcctctccgtctccggcgacaagaaccaacggctcagattggtacccattacccaactatacaaatcgtaatccttaacctcttttcatcaaggttcctttacttaaccaatattaattttcggtactgaaatttacaaaacaacacccgattttgatcgctatgagtagtagtatttccaaaatggtcctttctgaggaccgctgcggtggccgccggctgcctcctccggcggcgcgtgagcatggcggatctgtgctcctggccctctggttgcagtgcaggttccctagatgatcgatgcggctacaagtaaaaacatcattctccccggcactgattcctgcactaaatgtctcatttacccccttttaaaatgggaacagtagaggagctagataagatttatagtctcttaatacaaaagtgcgcaatcttttgcgtattcccgaaaaaaaaaagttcataatgtagtttcctgtaattgttgacctcaggttgactggtagtcaaagtcttggatgttgaaggtgatagatggttggatgcagcatacatgtacagtggaatagagagctaaatactttatccgtcccataatataagggattttgagttttagcttgcactgtttgaccactcgttttattcaaaaaattttaaaattattatttattttttttgtgatttactttattatccaaagtactttaagcacaacttttcattttatatatttgcataaattttttaaataagacgagtggtcaaataatacaaacaaaaactcaaaatcccttatattatgagacggatggagtaaatctcaagctgatcatccccaccatcatcttggcaatgcatcagagcccaaacatggagtttgcatctccaatattatgcatatccgttgtgttgttcttgatcacttcatccactgtggctgctgctgctactccctctctaggtcagagcaggagcaacagcagcgacaccgacctctctgcactgcttgccttgaaagcccagctctctgatcctaacaacatccttcaccttaccggcaactggaccgtcggcacgccgttctgccagtgggttggtgtatcgtgtagccgccgcaggtaacatgcatggcttccttgtgccagtgttcgagctgggcttgctctgttcggctgactcccccgagcaaaggacggcgatgagcgatgtggtcgtgacactgaagaagattagaaaggactatgtcaaattgatggcaaccacccgacccggcaaaaaattgatggcaaccacagtaagcgttgtgcagcagtgattcatcgctctatcgttgtatatgagcgaatgaaatacatatcatttgcatcattttcttcttctgcattaggaatagcatcagtgatcgattaccctttgtttgtatttgtgtatggttgaattgaatatatatatatatatatatatatatatatatatatatatatataaaacaatttcgttggtgtaaatatgtgattgaaccgctggtcaataaatttgcatcacgaaaatgggagtagatgatgtgctacttatgttttcttatttctggccaaaataaataaataaaaaaggaatattatcggcacagcatcacaactccggctcattcagccttaaacaaccacaattaacagtcctaagcagagaaacttaacaagcttttcaggctaacagaacatcaaaaggtccacaagacaacagggtcttcagagagcacatcttcaggctgtcatgcacgcaaaaaagatcagacagccagatgagagcgggtacaataaccggtagccatctcagtaaaactaacgaggctgtaggacagagaagaaaaaaggtagtaggaacgggcgacaatagtcggccagctctacatgagctccaaggtgaaaaagcctacaaggtaggaattttcaatttttaaaaatggccatgggcccacaagtagtgtgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccatatatatgggataagtgagcacagctgtgctcacctaaccgcatttattgcggtctggtcaagcgtgtcgggctgca

SEQ ID NO: 30748 - DNA, 46825 bp, Oryza sativa
caaacatgcatgttgttaagctgacacgcggtgacaaagaatgacgattttgtgaccggtctggcactgctcatgttgtaagcgcacggccacgtcccacgacgcgcctgcccccgtcaagagtgaaggtaggtgtgggctgtcccatcagaagggctcccggatggaaaccgtactgatctccgcccattaaagagaaaaagaacagtccagtttggaaagagaaaggtgcatgtggtatccccttgagatataaaaggaggaccttgcccatttagagaggagacttcttcccttttgaaaggctgagaggggaaaggaagttaatcttttgtaacttgtccatacacaaatccacaaaaacacaggagtagggtattacgcttggcagcggcccgaacctgtatacatcgccgtgtctcgtgtgtcttgcggacgggtgatctttccacatacagagagagagagagcttgggattgcaccctaagcccctggtcgaaccggcaaaggggggcttgcgcagtctcccggtgaggggccacgagctccgtcatctggcgcgccaggtaggggactcagtgtgtgttttctgagctctcagactcttccgtgggcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccggtcgcgggtgatgtaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttccggcgccgccaccaccggttccgtgtcatcaaggcggagggcgcggcgagcggcggcggctgcacggcattcggctgccactccctcgtcgacaccttcgactcgggaggatcagcatggggagccagatgcccgcctcaacatcgagcgccggcgtaatagccggcgtactccccgtgcaacggagggcgcctcctcgtccagagtgtcacctcgacatggacgtgaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaaaaggtcggtccattccggcgacgagggtcacgtcctcgccatcgagggcgctccgcgggccactcgaaaggggaggcctgcgagcgacaaaaagaaagaggctggtactcccagcagggagcgcccagccagcaagtggtgctccgtccacaacacctccctccacgatctcgcggactgtcgtgcagtcaaaaacctggctgagcgaacgaggaagtgggaggaggacaggaggcaggaacgccgtgagggcaagtcccggcggttccttccagcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgagccaatgcgtcgggccggtggtcgaaggttgctctcactttcgaccagaccgaccacccaccgtgcattgcccggggagggcaggttgcgatggtggtttcccccaccatctgcaacgtgaagttggggcgtgtcctcatagatggaggagcggctctcaacatcctttcccccgcggcttttgatgccatcaaggccccggggatggtgctccgaccgtcccagccgattatcggcgtgacgccggggcacacgtggccattaggtcacatcgacctaccggtcaccttcggtggacccgccaacttccgcacggagcgggtaagcttcgatgtggcggacctcagtctgccctacaacgcggtcctggggaggcccgcgttggtgaagtttatggcggcggtccactacgcctacctccagatgaagatgccgggcgccggtggccccatctctgtccgtggcgaccttaaagtcgcgctcgcttgcatggagcagcgcgcggaccacctcgctgctgcgactaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaagaccggtccggcagaaagtgcggcggcaggccccggaacgtcaagccttcatccgcgaggaggtggcaaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgttgactccactgcggggtgcgaccttttgtgttttctagatgcatactctggttaccatcagattcgcatggctagggaggatgaggagaaaactgcgtttattacccctgtaggaacctattgttatacatcaatgcccttcgggttaaagaatgcaggtcctacttttcaacgtactactcgaatttctttgggtagccaaataggacgtaatgttgaggcttatatcgatgacttggttgtaaaaacgcgcaaccaagaaactttactttcagatctagcggaaacttttgagaacctccgctccgcccgcataaaactgaaccccgataagtgcgtgtttggtgtacctgcgggcaagcctctcgggttcttggtctctgcccgaggcattgaggccaactccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagttcccccccggttctagtcgccccggagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgcttgtcagacggtgccgggtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaggcccctgacgaccggagctggccctttgcccgcttgtctgacgacaccaggagcccccgacccccgggacggccccgaggccactgtgggaaggccgcacctgtcatcttcggaccccgaggtcatcagcgcaggagacgagtgtgccccgagaggccacttggacgaagagcaccccggggatacggcccctagcgaagaggatcggccccgccgaaaggtgcagcggcctgtctactttgttagtgaggccctccgggacgccaagacccgatacccacaggcccagaagatgctttacgctattctgatggcctcgaggaaactgcgccattattttcaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaattcccgaggccagcacggacccctcacagctgcctcaaaccgcccattgggtgatgcagttcgacggttctctgtctctccagggcgccggtgcaggggtcacgttgacctctccaaacggagacgtcctcaaatacttggtccgtctcgactttcgagcgactaacaatatggcagagtacgagggactccttgccggactcagagtggcagctggactggggatccgccgcctcttggtgttaggcgactcccagctggtcgttaaccaggtctgtaaggaataccggtgctctgacccacagatgaacgcttatgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggcctcgggacccgaagggagcgctacaagctcccttagattgattgcttggatctctgagatccaaacatacctcacagataagactctacctgaggaccgcgaagggagtgaacgcgtacaacgcatttccaaacgctatgtgttggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgtagcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactctttggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaagacggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaaaccgtggaacatcgaacaccttcgtcgcttctacccctgaggaggggggggtcgggtgtcaggttttggctcaggccaaccccgcacccccctcgggtgtgcagggttggccgggggctaccacacgtgcattacattcttatttctcttttttcaacatttcaatagaagcagtttcaatttcctaaaggttgtgtctgtgctgttctttccttttgaagaatcttgacttaaaataaggtcactcgtactcaaccttgccctcgggggttcggttcggtcagctaaaatcgtcaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatgacacagatacatcctcatcgcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggcgctcattccaatgcgcccgggtcgccggcctcgtcgccaccgtcgtcctcgccgctggcatcgccctcctcgtcggagctgggggcgaacgcgagccgaggggccgagccctcgaagccgttgacgatgtggtcggcggcatcccggacgcgcgcgcgcgcgtcgttctcggtcccgggagggaactcctccagcgccatccagggagagaaattggggtcccgggcctggtaactcgctagcacgagttcgaccgccccccgggcgaggtccctcgaggatgacttgatggtcttctcgagctcctcggggagtcgttcaaggacccaggccattctgttaaggtgcggagcgaggccttccagattggtggggcgcatcctcgtctggcctttccagaggcccgcttgccgaccagcgcgatccatgcgggagaccgagtcccaaagcatgtcgggccccatctcgcccgccaagcggagggcctcggcctccccgatggaggaatctagtgcgcgctgcatgtcagcgacggtgtgttcggcagccgcgaggcgagcggctaagtcgctttcgcccgcaaccgccccaccgacgcgcacccttgcgtccagctctttctcccgcgcctcgaggtcggcagcccgctgctccagtgcggctctctcggcgcggacgcattccagattgcggcgcgcctgctcctcctgcgctgcctcgcggagggacaggctgtccgccagccgttgcgtcgtggcctcggccacctcgagagctcgctcccgctcagcgagtgcatcctcgcggaggcggagcgcggactcctcctcggcgcaggcggcctcatgcgccgccagcgtcgcctctcggagaccagcggcggcctcgcggtccgccaagcccctctccacggcgccggcgtgttcttccagcgccatggcacgggcctcaagggcctcctcgcgccgccgagacgccgcttcagtcttcgttacccgccgctctcgggcagcggcggagtcaaggaccccttgggcggcgtcgagctttttcttcagctccgcctcccagcttgcgtgctgaaggcggagggtgtcttgcgcctcgaccattgcggtggtagagatgagggcggccgcccgctcctcctccacctcacgggcgacctccgccagcgccgctttccgggcttcaagctccgagacatgacggcggtgagccttacggcccacctccaccatggcgtccaccgagcgccgcccctcctcaacacgcgtccatgcggcctcgagctccgctcgttccgcacgcagggcctccacttgggcgttgaacccatccagcactgcggtgtttgcggcggccagggcttgcagaaggggctcggcgctcagcggggcgacagaagatgaggagaagagccgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggacgtcgcctgagggccgcccgagggagtgggcccaagtgacgcgccagcagcagctgtcgcctcagcctggcgagcccggtcggcctcctccttagcagcttcctcagcctggcgagcccgggcggcctcctcccgagcagcttcctccgcttggcgaacccgggcggcctcccgggcggcctcttcagcttcccgaaggcgatctgcggcttcacgccggtcagattctcgcctccgctcctctgcggccgctggatcttcggcctcggactggccggacttggggtggcgggaggaatgtgacggggcatcgctgaagcagaataaaaaaccagaagacaaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggagaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagaccagcgccgggggctggcttggaagtcggaggcgcgcttcgttggcgaggggggtgtagaaccagtcgctcttccagtcgtcccacttcttgcggaggacgcaggggatgtagcggttcagcaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagttgggcgtagcagagaaagagtttgagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcgtaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccatatatatgggataagtgagcacagctgtgctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccatcccgtcaagacgagaacctctaggcactcgtccccagctggagctagcgtgttacatcccggagatggcacgttagccccgatcgatatatgccaggcttcatcctaaccattacaggcaagatgttgtgtgaagaagggcaaacatgcatgttgctaagctgacacgcggtggacaagaatgaccgatttgtgaccggtctggcactgctcatgttgtcagcgcacggccacgttcccacgacgcgcctgcccccggcaggagtggaggtaggtgtgggctgtcccatcagaagggctcccggatggaaaccgtactgatctccgcccattaaagagaaaaagaacagtccagtttggaaagagaaaggtgcatgtggtatccccttgagatataaaaggaggaccttgcccatttagagaggagacttcttcccttttgaaaggctgagaggggaaaggaagttaatcttttgtaacttgtccatacacaaatccacaaaaacacaggagtagggtattacgcttggcagcggcccgaacctgtatacatcgccgtgtctcgtgtgtcttgcggacgggtgatctttccacatacagagagagagagagagagcttgggattgcaccctaagcccctggtcgaaccggcaaaggggggcttgcgcagtctcccggtgaggggccacgagctccgtcatagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctataaacatactttaaagagataaaggaagagagagaggaacaacagattacatatctgtagtcagctgcagcacggattacaagacgtaatatgtgtataacatgtgagaccagatattaatagtatagtaagcaactattgtatgaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgtcccgattacttataaattctcctattgtcaccacaacttattattattgttttaaaagttatgatctataaatagataaaactggatatgtaccaataaaataagcctaatacatcattgatacactaaaatattcactacttatctaagtgttcatgtttcacttatttccgaatcaatatataaatattttaaaaataccacttataccaattaatgaaataacaccgttaaagataaacatgaatgcccctctaacgggtgaagcccatcgtagccaccaagactttctttctctgttgagttttctaaaaaaaacgaaaataaaatttttgataaattaatccaaaaaattaaaactaaattggatttacttaaaaaatagactaaattgttttttatcattttttacatttgtagatttaaattagtgttgtatatttatcaagtgatattagaaatcctaaaatataatgtgaaactatttgaaaattaccacaacattaattattatatgttggtcccatgtgtcatgatgtatttaggaccataatataccttttataagacataagtatttcatttaattaaagcatgaaactaatcacaaattgaatataattgttgcttactatactattaatatatggtcccacctgtcatacgcatattgcgtcttgtagtccgtgctgcagctggctacaaatctgtagcccgctgctcttctctctcatcgtttatctcattaaaatatatttgtagctggctaatagcttgctattttacttgctctaagataacagtcctaccaatttaaataaaaattaatgatgagattagacaaagtcacagggtggcctacaagagttggtagaaatggcacataagataaaatatgatatagtagtaaaaatatagctaatatagctcaggaattggtgatttaattaaaaaaacctacagctgctaaagtgtatgcgtagatcgtctataaaaataattgtttatttacaacaccagatcacttctattgtaaattcctagcgtttgcgcattcacactaagattactctctatgaaaaaactgatctaataatttatgataataaattatgatgtacatgtatcatgtaatttgaaaaaagaagaaaaaaaggagaattaggatctggatggcatcaatcgagctcgccgaggcagatcagtctccatggaaatgataacaaattatgatgcacatgtattgtgtaattagaaaaaaaaggagagagggagaatccagatatggatggcatcaagctaacagaagcataagtatgtacgtacgtacttatgggcggaaaatctaatgggcgatcaatcgctaccgcgatctggtagcgatcgcatcccctcccccctccctccttccacgtttccttttctggcaccgcattacttttctattttagtaaaatttatgcacctaaagtttatacacctaaagtttatagacccaaagtttagagacccaaagtttataaatcaaaagtttatatatccgattcaaatttaaatttgaattcaaatattttttatatatagtatttatatacatctaaagtttatacacctaaagtttatagacccaaagtttataaatcaaaagtttatataccctattcaaatttgaatttgaaatatattcgattcaaaatttgaatttgaattcaaatattttttatatatagtatttagatacatctaaagtttatacacctaaagtttatagacccaaagtttagagacccaaagtttacatacccaattcaaatttgaatttgaattgtatccgattcaaatttaaatttgaattcaaatatttttatatatagtatttctatacatctaaagtttatacacctaaagtttatagaccgaaagtttttagtaaaaagtttatatacccgattcaaatttgaatttgaattcaaatattagtttatagatccaaagtttataagtcaaaaatttacataaccgtttcaattctgaatttaaatttaaatatttatggtgtagtaggaagagaaaaaggaaaggaggaaggggggagaggagggagcgactggataggaggggcgggtgatcgcctgaggggcgggagctatcacccgcccatcaggcgtacccacttatgggtccggagagaaagggtgagaaagatttagttttgatccaacggttaatattattgggtccaccactttaaataaaaacttacggtcagatatttttctttttctcagaatattatttaaattattagagcgccatgtggcgacttaggagcgtttatatataggagtctcacgtggtagcttgagagcgtacgtagaaagtttaatgaacttttagtatataaataatagatagatagatttaggattttctctaatttgctagaacgccacgtggtggcctaggatcgttattggtccaaataatatgtaattacttatttatataaataatatgtaatttagaagtatacttattcaatatgtattgttgcagaacatagtaaagagaggaaggggaggaaaagaaacggagaggaggtactcatacatgacgcacggcaggattccttctttgttttttagaaagtaagagaataaaccaatctaatctaacggcttggagtaacgggcccactaattttaatgaaaattaatggctagatgttttgctttttttatagaatttctagtacacgtggcgtcgtaggagcgtttgtaggaagtttaatggacttttagtatataatagaagatagataatagatagatagatagatagatagatagatagatagatagatagttacatactacactattaatatctagccccacctgtcatagacacactgcgtcttggagtccgtgctacagctgtctacaaatctgtagcccgctgctcttctttctcctgatttatctccttaaaatatgtttgcagctggcttgtagtctgctattgtacctgctcttatacaggcaataatcactgccactaaatacagacaactatatttcttcatttataactgtatactgctttctaataataaaaatatattacattgccgacctctgcctgccacacgattaggcttgcaggccctacgtcatgttatttgtaattgatacagtttttgtatttatcaatccgtctcaacaagattgatcgattaggtggacattaattgatttattcaacgactaatcgatcttgctttgcagcagcatttcacttgctcattgcagtaggcgcctttccagtctaccaaattaccatagtatttgaggcagtaggctccacacattctcacttggcatgcccggagacccgtatagaaacacacatctgtactctctacaaaataaacaacaaactctgtataaaatgccatgattttttttgtaagtggtacccacaagttaagcgcatctacaatcattaatttctagtgatgccatgcttacagtaggtactaaagaaaaacaaatttgtagtaactaccacaacttcaaaaatcttcgcttataaaatcttcaatctgtttggcacaactctgtatattggccttgttcggcacaactctaatttattttttttaagctaggtatttctaaatgtagaaattctgtgcttatgttggtaatatttaaataaatcattttatttatattttagaggaaattaaatattttaaacaattgtagtttaacatatatacaaactttaaatttgacatggatctaagatttggagcaatgtttaaatttgtagcaaacattgtagagaggaaattaaatctaaccgtccgctttgcaggatgagagagcgacagccaagatcacaaaagccaccaagcagccgagggccattgtgttatttttcttggaaatgattgccatcacaagatcaggctacagtgttttgttctcccgatgatttgataagctacttctacgaccttcactgttgccggtgttcatataggggtacaataacccaccataaatgacatatattaatgcaaacattatcttactcatatcccttgcatttatgctgagcaatttattagctgtttattttataagatttgatgttttgggccgacacgtacaccttaccggctgggctcaaattggtccaaataattcggcccacggttagattgtaggtgtgaacatttgacattttttttttgcggggaaacatttgacatatttatcagagctgtcagtgcttccgtgactaatacttgctaatcgagcttatcaacaaataatataaagtcctggttcgttctcctgatttattgttcactcttaattactttctctagctatgagtgagttaaattttataaaacatgtaatccataggtttacactttgatcgttaatacatatttgaatagttcgcttcatgaaaatggtaataaaagacatcttttaaaatatatagatttgaaatattattacgtactttgctatcttttcttatatattttctattaaaagtcaataatgaagtcgctaccgacttatggaggaagagagaaggggtggagagtgggaggagggcctagtcatctctcggccagccagcgaggtcagacggtggtgcactaaggcgggggacttgatcgcgcgaagaaaacaactagttactgtggggataaggagttgggggaagaataaaaggataagcgggttgcaggaatcttgaaggcatcctcgccgtccaaatttgattgtttttatttatttatttttttcatttctatggaactaaaaagagaagacacagtccctatcaggttttatcgtacttgaacaggctagagatcgatcaaataagagtttatttgtgtacatggccagtgccaactccatggccaaggcgagttccacagcagcattgatcagaatcgctgtcgcaattgcctccttcattatgattggcttgacagagactcgtggtgcagcctcgtaggtatgtgcatgtatcctttactccctccgtttcgaaatatttgacaccgttgactttttagcacatgtttgaccgtttgtcttattcaaaaacttttgtgaaatatgtaaaattatatacctacataaaaatatatttaacaatgaatcaaatgataggaaaagaattaataattacttaaattttttgaataagacgaacggtcaaacatgtttaaaaaagtcaacggcgtcaaatatttcgaaacagagggagtatttcgtatgcacctgtgtacagaatggttagacccatgatcagatgcttgattttgattcatccattggccattgcaaaacgaagaaaattaattaagctgttatattcagcatggtgatggagaaattgaagatgtatatatatgtgtgtaccttgggctgcatgagaggatgagaaagcaatagccatcaccataagagctgccaagaacaccacagccttactattatccttgccaagaagtgccatgatagggagatcttttcagaagggaagggcgcagctgtattattgttgtttacctagctatccccttggtttgataggtgtttatatagccacaaaggcaaatcttggatgatacatcattagtttcctccattattatgcgacgcgacatcgacatttcttgatcgacgtggagacggaggagtgggagcaggtcgacgacaagagccttccgagggccgggccatgcatcccatcggtgagaagagaacaacctgatatcttcgtctcccactgcatcaacaagtcaagtcgtcgtcggcacagggcaatgtcagcatcgatcgaggagctgtctgttgtcctcaagatgccaacggtataaattctcggccggggtcttggggatatggcaccttctgcagagatgcttcctccggttgacagccaggaaaaatccgtcgtaaatatctgcacacccttacagcagcaccgcacggttttcttttacgaatttatattagtatactatataagtataatattactactcgatctgattggtccatttaaacaagctagtacatataatggagataaatttttcggtactacctcgaattcaggtacttaatgtagctgctagtatctggtagtatcaaactttacactacaaaatttcacacctccccatactttctcaaagataataaaattacactatcaggaaaccttgggagctttctttgccactcgatcaataaaacacaagcaatgcgtgattgttcttccttgaatatatataagtttttagatgtagtgcaatgcgatagactcaattttatgtgtgtacaagcaaactgcccgtagactcgtacgttttaacaagattttaattaatgaaaattatgaatatgctattaccattatttcttattcattatctcctaatcatatatatttgttattgatatgttggccgtttggcccacatatatcctttcttaattcgttccaaaatgttacttagcaagttgatgccttggtggtgggagtggtgacaaattcacccctcaccactgccactacttatctctttttaagtgtagacagctggtttcgtattttgggtgggtcggccatgcacggcactcgattataacagatggaatgtccagatgtggaagactaggacatgtgcaaatgggacatcagatgctcccaggtgagtttctgtcagaggaaccaatatattgtgtccattccttccactgtccttacatgttagtccctggaaatttgaagtctttgattacgcaggctgtgtagcactagttccggctttaaaaacatcctatttaaaacatgttttgaatcaaattttaaaaacctaaaaccctgatactcttcattccaaatctttctgcatgccacacccgatcccattcacagattcaagcaaatcaagcgagagagagagagagagagagagatgcacaaattcatacacacaacagattccattcacagattcaaaaagagagcaacaacatcgatcaaggcactgctcaagctgccattgtggcgttgtcgctgtcgccgagccaccgaggcacccctccctagttccaagcaccgccaccagatctggatctagagtggtgggccagcaccaccaccaccttagggctttctctcctctgccgtcaccagccctaccatttgccaccattggtagatctaagagcatatccaacagactctccaggctaaaatttagccaatttgacaaaaaaaaaagctctccaacagccttgccaaccgaatggccaaactagggcatcctgcctggctgaccaaaccaggttgccaaccatgggtcccacgctgctagacacccctcttcccctttatctcttcgcacctatcctaaacccaaacagaggagtgccaccactatctttgtcgtcaaggtcgccatcgccattcgccgctgctgccaaggtagtcattgccggatgccgctgtcatcgtctgcgccgtcactagctgccaccgccgtcgccatctgctactgtgccgaggtcgccatctgctactatgccgaattcgatggggtgcgcgacgcccgccctgtggatttggccatgtgttcggcaccgtctcctcgtgtttgtctccgttccccctgctctgcgtccgttgtcttccctgtcaataccgtccctagcgccaccggctgccgttagtaggatcgaatcacaagaactaagccaaccagagggagggtgaatggttggtatacccaaaaaccgaaaacttttagcggaaataaaagttaccctcgaaatcgatggaaaccggtctgaccgagattgatctgtcagtctgaccgagtggatgccgccggtctgacatgtgttgaatctccggtctaaccgccgaagtcgcctgccgcgcctgttgccgccgccggtctgaccgccgcaatgccgtcggtctgaccgccggtgagttgccggttagaccgccgaaacccggtgaaacacaaatcgaagaactcttaaagtgaatgacgactttattacttctctctgtgtttacaaagtgcaccaacaacactccttacaaaaatttcgactaaactcgaaaccctaactcaaaaaactcaactcaattgctctctaaagcgataccgggaagcctcatgctccccctctatttatacccgaggtaggcagcctaaagccacgaaccaaactcatattaggagtcctaaacaccttaggaaaccctctagtacaagaaagaaactttacatcaccaatcgtaccaaatttggactctttccaaattcgactccgcatcccatacgcacacaataactccatcgtatgccatatggaaactccatcaatccacgtgcatcaactctagccatagtatctcgcatgatctctgaccaccacgaatgtcatcttatccccaagccgactcccggtccatcaccgcaaatactctcccagacatcgagtcacctacacatggaacaaacaaagaaaccatattccgagaccaagctatctccaacttgactcattagcagcaaacaatagtattacatatgtatagtatccatctagaagtcataatcatgaaataaactcggatatccaaacaaacaacccgaaaccgaaaccgacacagtgtcggccggtcagaccgcgggctggccggtccgaccgctcgatcactgccggtctgaccggcatgcacagcccggtctgaccggtcacataaaataatgaatcctgcgatcacctatgaaaccaatcatctccaaaaccacttcgtgaataaattccaaataacaaaaccaataatctccaatgcccaattgtacatcacagaataataatcaaaaacacctttgattttacaatctcccccttgatgaacacattggcaaaccctttaaaaatgttttggtgtttggaaaaataaaaacaaaagtggtaaaaagcacacttcgtacaaatgtacacatcgtgctcaaaaattcaaaagaaaacttctccccctttttaaaagaaagaaattcccaattgaaccaaaaacatgctcttctcaacaactctccaaaaattcatcttgcttctccaaaatatccaaaaaagttcacattacttccccttttgacaatgatttcatcaagcgcttaatattcaagagcttagcatacatatagcataccaagtcatgtgttgcaataaaaagaagatgaacccatctataacagaacaagcatgcattagagtataaccatgaaccaaagattttacaattaagcttgaatcaacaatcaaaattcatgatttcatacgatttataatgcaacatcttaacaagcacataggttgaagaataaacactaaacacatatacctatggcatttatcactctttctcaaataaacctttagcccaaaataaccaagaaaatttttttaactttttcttttcttgagcctttttgctcataatttttctcttttattccgagtacgtccctgtcgtcaagactgtttccagggattcggcacccattattttgctcacatcgaatacgtccttgtcttcaagactgtttccaaggattcggtattcatttttttcatatttttattctctttttcacaatgagcaattaaagctatttgaggaataacatgtcaataaagcatatatatagggcatttaaaaatcaaaccatatgctagcatcaacattgcatatttgcttaattcaagtagaatttaagtgtcatgcatcatctcccttaaaagcaaaatctaaatctcatgaaaagactagaatacatacaagctatgctagagacaaataaaccttcaaagtattgcgagcatgcacaagaaaataccatatgcataaacaaaactctcttttctcaatttttctcattgtcatattgttgcttgataaaaccatgaggtacaaactccccctcaaaccatgccaaaaggatgaattatgcccaattcaccacgaagaaaagcaaagcgattagaatccaaaggtttagtgaaaatatcagcaatttgcaaatttgtgtccaaaaactgcaattcaacatctcccttctcaacatgatccctcaaaaagtgaaaacgaatatcaatgtgctttgtgcgtgagtgttgtacaggattcttagcaatattgatagcactagtattatcacaaaagagatgtactttctcaaaagtaagaccataatcattcaaagtagataaaagccaaagcatctgtgacagcgacgatcagcagccacatatgtagatccagcagttgcttgagcaccctgagattgtttcctagaagaccatgcaatcaatgatgtaccaagaaaatgacatgttccactagtacttttcctatcaattctacaaccaccaaaatcagcatcggaatatccactcaagcatatagaagatgaagtagaataccaaattccaaactcaagtgtatgattcaaatacctcattattcgcttgaccgcttgacgatgtgaagcacgaggagaagcttgaaagcgtgcacgcaaacacacagcaaactgtatgtctggcctagaagcagttagatacaacaaagatccaatcatacttctatattccttttgatcaacagctttaccatcttcatcaggatccaacacagctgtagaaccaattggtgttgaaattggcttgcaattctccatcttgaaccgtctcaaaagatccttggtatacttcgtttgatgcacaaaagtaccttgaggtgtttgcttaatttgcaatcccaaaaagtacgataactcacccatcatgctcatttcaaattccctgcgcatagtctcagcaaaatctacaaccaaagcgtgaattgaacaaccaaagatgatatcatccacataaatctgaacgaacagttgattatcaccatgcttaagaacaaaaagcgttttgtcaaactttcccattgtaaaacctttcgcaagcaaaaagttcttaagtctatcataccatgccctaggagcttgtttcaaaccataaaaagctttagacaatttaaaaacatggttgggaaaatcaggattttcaaaacctggtggttgtttgatataaacttcctcctgtataaaaccatttagaaaagcacttttcacatccatttgatacaatttaaaaccttttgaagcagcaaaagccaacaaatgtctaattgcctcaattctagcaacaggagcaaaagtttcatcaaaatccaaaccctcaacttgagtaaaaccttgagcaacaagtctagctttatttctcacaatcaaaccatcctcattttgtttatttttgaaaacccacttggttccaataatattatgtccaaactttgtttcaactaaagtccaaactttgtttctctcaaaattttcaagttcttcatgcatggcgttaatccacgattcatcagttaatgcatgtgacacatctttggattcaaaagaagcaacaaatgcagaatttgcacaaacatcatgagtcgttaccttagatcttgtagtccgctcacctatattaccaataatttgttccggtggatgtcgtcgttgaatgtgcaaaggagtagtgacgtctgaagttgatccacgttctgtaccagtactggttgaagttgaagtctttggaggtccatctcgatcagcatcaacagtaccagaactcgacgaacctggccggtctgaccgctcctcctgaaccggtctgaccggaggtgtgccagcggtctgaccggcctggcgcccggtctgaccagccgagccgacctcatcatcgtcgtcgtagtatctcttgtcttcaaaaatacgaccatcctccccctgaacctgtgacagtgtacctgcaatatcgggtctagtacctggactagcctcattaaaagaaacttcgcaagtcgcaagtctcgatcactgccggtctgaccagcatgcacagcccggtctgaccggtcacataaaataataaatcctgcgatcacctgtgaaaccaatcatctccaaaaccactttgtgaataaatttcaaataacaaaaccaataatctccaatgcccaattgttcatcacagaataataatcaaaaacacctttgattttacaccgttgtgtcgtcctgcgtccctaccgccgcctcccgtcgccggctagtccatagccctagtgggaaatgagaagaggtgtaagggaagaaagagaaggtgctagtagaggctgacatgtggctccctttgttattttggagatggtaatagagattgttggagtgagaatctagtttgactacccaaatcagttggcaagttggctatatgggtatttggagagtctaatttggataagttgttggagatgctctaaggtgatagagggcaggataggtgagggacgttcttagaaagagaacttactcaccgccctctcatcccatcatcacccccaaatccatccacctcctccaccgccactgcctctagagagagggaggcctcccatggcccctcccaataggggtgggcacaaaaaaacaagaccgaagaccgataccgaaaaaaccgagaccgagaccaaagaaaccgatctatcggtcatcggtctcctgatcggtcatgtgttccaaaagaccgatcttttttttcaggcttctgtattattcctcggttacccgatcagaccgatcttggtcttgggccaatactatcagcccacctactcaacgagaggttgagcccaacaagtctaccacaatagtccatttatcttcttttgcatgtattatatctaataatatatattatttatttattgtgagtagttaaacgtgcacgcaaacaaatatagaacaattcaactctgtactgcacggaattatcaaaatcctagaaataacaaaatcgtgtaagtaggtaaaagtagcaactatattttacccaatcaactcaaattgaaatataaaagttatagccaacatgcatgacataattgtgcatgacataattgtcgaaacatgaattcggcaataataaaagggggtaacgcacgagacctaaaagtggatggatgcggagacaaaggatttagacaggttcaggccctctcaatgagaggtaataccctactcctgtttgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccggtccgtaacatacaaggaaacgtaatacccaagtcatgatctgttacatattccatagatataagttatcccctatagccagtcggataactatgccatgtgggtatggggtacccataatctgcacagtagcccctgagaccttcacagtcgaaaagataatcttctctcgaactagattactccaaagctgagtgcttcaatcatcttcgccatggtctccgaagtacttttaccaaatatgaagactgtggagggctgaaaaataaagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgaccgctttgtaaaatatgatgagtgtaacctaaagttggttacatcattgaaaattcacatagcaaaacagctataaagaagcttgtatgttgtgaataaataaatttccaaagtattgggcatacgctatgcgcacactgctttaacagacgtgctttagtccctaaaagacacatggtttcaccacagctggaaatatatggcatatgtggtgtaaaatccgagtgaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattggacacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaagtaggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatcatgaagatgaagaaaataattgacgacgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccatcaaattaatgttatagctgttgtagatgcttcacttggaggagagttgatgttgttgtccaactcgttcaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccatgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaacacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcagcataataggccagccgtgcaggcggaaacaccaatcggcggcggtcgaggcggctggtcggtgaagacgtagacgcccaacaacggcggcataataggccagccgtgcaagcggaaaacaccaatcggcggcggtcgaggcggctggtcggtgaagacgtagacgcccaacaacggcggcataataggccagccgtgcaagcggaaacaccaatcggcggcggtcgaggcggccggtcggtgaagacgtagacgcccaacaacggcggcataaaggccagccgtgcaggcggaaacaccagtcggcagcggcgaagacaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacactagtcggcggcggtcgaggtaagccggtggtgatgttctgactgatccattcctggagcgtaagagataagcttaaagccatgaatcccttttatgcatatctggatctggattctgcagaacaaacatataggatgagtagtatctgatataaatataatactcgagaaaaaatcaagtattttaaaatatttataaatatgtatttctcctcttgtcaattttgatttccccgagcagataattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacgacgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtgaaaccaagccagtggtgtagatgatgaagcccattaacggcggcgaagtccaccaaccgtataggcgaaaacaccagtcagtggcggcagaggcaggccggcggtgaagtcgtagacgcccaacagcggcggcataataggccagccgtgtaggcggaggcaccactcggcggcgacggaggcaggccggcggtgaagtcgtagacgcccaacagcagcggcataataggccagccgtgtaggcggaggcaccactcggcggcgacggaggcaggccggcggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtagacggaggatccactcggcggcgacggagacaggccggcggtgaagacgtagacgcccaacagcagcggaataataggccagccgtgtaggcggaggcaccagtcggcggcgacggaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaaaaacggtggtgtgaccaaccaaccatataggccagccgtgtagacggaggcaccaatcggcggcgacggaggcaggccggcggtgaagacgtagacgcccaacagcagcggcataataggccagccgtgtaggcggaggcaccactcggcggcgacggaggcaagccggcggtgaagtcgtagacgcccaacagcagcggcataataggccagccgtgtaggcggaggcaccactcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtataggcgaggacaccagtcggcggtgacggaggcaggccggtggtgaagtcgtagacgcccaacagcggcggcataatagaccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagcgaaaactcccaaagcgaaagcgaagtcggcgactcatgaaattgattccatcgcgctcgttgataggaaactcgacgcaatccctacctggcgcgccaactgtcgaaacatgaattcggcaataataaaagggggtaacgcacgagacctaaaagtggatggatgcggagacaaaggatttagacaggttcaggccctctcaatgagaggtaataccctactcctgtttggggatttgaatccgccgagtgtgtattgatctgacgatcaggttgtctcataccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacaataatataaatggttcacacattataatcagggtttagatggagaaaacaaacagatagagtaatgggccggtctttttgttcgttccttcctgttgtttccttttcttttcctttatttttttcttttctttttttttatatggtaaggctataatggtcatttcatttgtattgttgcatgcaagaataacttggcatgctcatgtggcattttttgtgggtccaaggactatattaacccaaatgattaatttggaggacttatttggacgttttgaaaccttaaggactaaattaagcccgaagcgaaactttagataccgtattagctattctcccaaaaataaaagggggaagttgtgctctcaatgctacatcacgaacacactgtatgtagtgcctaacatggcctggctacttcttccaccattcaacagcattcgtcttctcatgcttgtactgccacttaccataccatatgcttctggttccatcccgcgtgacggtggtagcagcagcaatggcaccggcgacgacctgtccgcgctgctggctttcaaagcgcggctgtccgatcctctcggagtccttgccggcaactggacaaccaaggtgtccatgtgccgctgggtcggcgtgtcgtgcagccggcggcggccgcgggtcgtcgggttgaagctgtgggacgttcctctgcaaggagagctcacgcctcacctcggtaacctctctttcctccgtgtcctcaacctcggtggcataaacctcactggccccatcccagctgatcttgggaggctgcatcgtcttaggattctccgtcttgcccacaatactatgtcagatactattccctctgcactagggaaccttacaaagcttgagattctaaatctctatggcaaccacatctcagggcacataccagccgagctgcaaaatctacatagccttaggcaaatggttctcacgagcaattacctgagtggtccggtaccagagtatctattcaacgccacacaccttgggtaaccgagatacacctcgggctgaatagtttgtcaggttccataccagactgtgttggctccttgcccatgcttcgtgttcttgcgttgccagacaatcagctctctggtccagtgcctcctgccattttcaacatgtctagccttgaagccatacttatatggaagaacaatctgactggccctatacctactaaccggagctttaatctccctatgttgcaagacatagaactagacacgaataaattcacaggactaatcccgtcagggcttgcttcatgccagaatcttgagacaatttctctgtcagaaaatcttttttcaggtgtcgtgccgccatggctggctaagatgtcacgtctcactttactctttttggatggcaatgagctcgttggtacaatcccgagtctgttgggaaatctccccatgctcagtgagcttgacctctcagactccaacctaagcggccacattccggtggagctgggaacactgacaaaacttacgtatctcgatctttcatttaaccagctcaacggcgcctttccagcttttgttggaaacttctctgaattgacattcttgggattgggatataaccagctgacagggcctgtaccatcaacgtttggaaacatcaggcctctcgttgaaattaaaattggaggcaatcacctccaaggggatctcagcttcctgtctagcctttgtaactgtcgccaacttcagtacctcttgatatcacataactctttcaccgggtctctcccaaactatgttggaaacctctcaactgaactcttaggattcgaaggagacgacaaccacttaactggtggccttccagctacactgtcaaaccttactaatctgcgagcgctaaatttgtcatacaaccaactcagtgattccataccagcttccctcatgaagttggagaatttgcagggacttgatcttacctcgaatggaatatctggtcctatcactgaagagattggtacggcaagatttgtatggttgtacctgaccgataataagctctcaggttccatacctgatagcattggtaatctcaccatgctacaatacatttctctatctgataacaagttgtcatcgactatcccaacaagtttattttatcttggtatcgtgcagctctttctctccaataataacctcaatggtacattaccatctgatctcagccacatccaagatatgtttgccctagatacttcagacaatttattagttggtcagctcccaaattcatttggataccatcagatgttagcctacctaaacctgtctcacaactcattcacagattcaatcccgaactctattagccatctgaccagcttagaagtattggacctttcttataacaatctttcaggcactatacctaagtacttagcaaactttacctacctcactactctgaacctctcttctaacaacctaaaaggcgaaataccaaatggtggtgttttctcaaatataaccttgatatctttgatgggcaatgctgccttgtgtggtcttcctcgtctaggatttttaccatgcctagacaagtcacactcaactaatggtagccactacctgaagtttatactccctgccatcacaatagcagttggcgcacttgctctttgtttgtaccaaatgactagaaagaagattaaaaggaagctagatactactacacctacttcttataggttagtatcatatcaagagattgttcgtgccacggaaagtttcaatgaggataatatgttgggagctggaagttttggcaaggtttacaagggtcatttggatgatggaatggtggttgcggttaaagttctaaacatgcaggtagaacaagctatgagaagctttgatgttgagtgccaggttctacgcatggttcagcatcgcaacttgataaggatactaaacatatgctccaacacagacttcagagcactgctgcttcagtacatgcccaatggcagcttggagacatacctgcacaagcaagggcaccctccactaggattcctaaagagacttgacattatgctggacgtatcaatggcaatggagcaccttcactatcatcattctgaagttgttttgcactgtgacctcaagcctagcaatgtgctgtttgatgaggaaatcacggcacatgtggcggactttggcattgcaaaattactgttaggtgatgacaactctgcagtttcagccagcatgcccgggacaataggatacatggctccaggtacttgcacttactattcatgagaattttgctttaccatttgagttatgtaagagacttaatttagtttatctctttctttcttttaaaaatcattcattgaacagaatatgcatttatgggaaaagcatcacgaaagagcgatgtgttcagctatgggatcatgttgctcgaagtcttcaccgggaagaggcctacggatgccatgtttgttggtgacatgagccttaggaagtgggtttctgaagcatttccagccaggctcgcagatattgtggatggtaggcttctacaggctgaaacattaatagaacaaggtgttcgtcagaacaatgctacctccttgccgcgttctgctacctggccaaatgaaggccttcttttgccaattttcgagcttggcttgatgtgttgcagtagctcacctgcagaacggatgggaataagtgatgtggtcgtgaagctcaagagcatcaggaaggattatttctcttttacaggagcaatataaaattagcatttgagtgcattttgtttatctattatatgtggacactatctcactagctactagccacaattattctcaagtaagactcattcgagcctaaagtactgtatcgacatataaatgaagagaatttttaccgtccagcaggtggaggcggtaccaaatgcgtccaatgggacagatctaatggctgaaaatcgtcggtatcgtgaggtaccgtaaatcctgtgcgatggtacctcttctctgtctgcatgaattgagcaggtggaagggtagaaccggattttcaacttaaatttggagttgattttgagggtttttttatcgtagtttatttttcagtctttgcttttacatcgctatgacacacatataaataaaagttttatttataaattatttttcgtttgcaaatatatcgtttcgcttattcgaaacgatggtcctgagtttttttcgaatgtgaaactagattactttctactacaaataaagagcatcttagttttttttcgaaaactatactttgatctaatttctttgtaatgttatcaataactacaaaattagtataacatgaaagtatataatgatatgatatgcatgacagtaagcatataaaataaactagaagtagaataaaaaaaccgtttgttcgtcccacttgcatcagtacttctcgtagtaatattgatttgttaccttaacttaggtggtgtttggatccagggagtaaactttaatccctgtcacattgaatgtttgaacactaatttgaagtattaaacatagactacttacaaaactaattacacagatagaggctaatttgcgagacgaatctattaagcctaattatgccatgatttgacaatatagtggtacaataaatgtgtgctaatcatggattaattagtcttaatagattcatctcgcaaattagtctctatctgtgtaattaatttttttaaataatctatgtttaatacttcaaattagtgttcaaacatccgatgtgatagggactaaattttagtctctagatccaaacaccacctaaggtacagagcatgtcgttttaaacacgcatgttttaagtcaaaccccgactgattgctaccttttcatatgtacatggaccaacactagaggagccaaggcatgccaacctcatcatcattaattaatttttgctactgagtgaatcggtacaattaagcatcaactgcaagagtttactatcgaatctctgcttcatcaatcaataataagattgccgttgattatacaaccgtcgttgttgatttggacaagagaaatctattatttgtgcgggcctcatcagtacagcagcagtggtcgttcgactcgccgtcgcacaggcctccgttgaaccccttgatttggcagtcactcatgcacttgttcatatcgcaatttacaaggaccatgcacgaatccatttctccatatccacctatatatatatatgcacatgtaaaatacatatttttagaggaaaaatcattatattgttaatgaccccgacttttacagagagccgaaatagttcatacagaaaatgtaaaatgcatatatacttgtcaggctatatatcagattattccagcatcattgatcactaatcatttcatgcaaaagagaacaaattaaactgtttttgcatttggatgtgatcaatcgagaggtgtatatatatatatatgtataccttgtgtagtatgaccggatgagaaatttacggtggccatcaccataagagatgtgaagaagaacactgctgcagccttcttgttgagaatttgcgccatgatgagatgagatgagaggagatccttttgacaaggaagctactgcatatgctggctactacctggcccctagcttcattttgcagctgtttatatagagtcacaagagcaaatcttggatgattcattagtaaattacctccattattatgcattaatgacgtgtgtgaggtttcattaatgaccgtttctcaaatttattgcatgagcatatcgtttcaattaattttgtttctatatcattttacctatgtcgtcgtttagtgtccacctctacaaaatattccattgttcaaacaggcctaaatgtacgttgagtcattcgaatgaaacaaaagcccattacaaacataggcccatgggctataaagcatgtcaggctaccagagaagtccacgacaaaggcccaatgtttacaagcaaaccacattcctttttcaggtcagaatattcctttttttttttgtttcagccagaaataagaaaatacaaggagcacatcatctactttcattttcatgatggaaatttattgaccagcagttcaatcacatttttacaccaactataaattgttgcagaacctgaagcaccatagatatattcaattcaaccgtaaacacatagaagcaaagggtaattgatcactgggtatacactgatgctacctaatacagaagaagaaatggatgcaaaggatatatatatttcattctctcatataccacgagagagcgatgaatcactgcgagaaatccccaggtccagatggctacaccgcccttttctaccaaaaatgttggggagtgatcaaagaggatcttcttgcagcactaaagaaattttgtgaagggaacacccaaaacctagaaatgctgaactcggcaataatcactctcatccccaaaaaagaggcccccacgttgttgaaggacttcaggccaatcagtctaatccacagtttctcaaagcttgcaaccaaaattatggcgcaaaggttggctccaaggatggaggagctagtgccacacacgcaaacggccttcataaaggggagatgcattcatgagaattttatttttgttaaaggtctatcgcaacaattccaccgccagcgcaaagagatgattttgttcaagttggatatttcaaaagcatttgatactgtctcctggtgctttcttctcgacatgttgaaattcagaggatttggccccctttggagatcttggctcgctgcgcttttcctgacagctgagacaagaattctaatcaatgggagtgaatctgacccaataaagcctgcaagaggtttgaggcaaggagacccgctatcgcctcttctcttcgtcttagttatggacacgcttcaggcaatgatggcgaaagcaagggcaagaaatctgttatctgagctgaatgctagaaaaagattgcccaacatatctgtatatgcagatgatgctgtcctcttcttccgtccaattcaacaggaagcacaggtgatcagcagaatcctagaagtgttcggggcgacaacagggttgaaaacaaatctcgctaaatgcacaatcacacccatccaatgtaacgtacagcagctggaggtagtaacagaaatcctgcaatgtagagttgagcacttccccataacatacttgggcctgcccctcgccatgaggaagccaaccaaggcagaaatccaaccaatccttgacagattggcgaagaagattgctggctggaaaccccggttgctatcacctgacggccggctttgcctcatcaaatccactctaatggccctccctgtgcatctcatgtcagtgttacagctacctaaatgggcgatcaaagatattgagcgcaagtgtagaggttttctctggaaagggcaggaggatgtaagtggaggccattgtctagttgcttggaaaaatgtatgtatgccggttcaaaatggtggtcttgggataaaaaatctggattactttggccaggcccttcggctgaagtggcatgctattaaacttgaacagaaaaacaggccgtggacaatggttgattaccaactaggaaaggaggtggatactctgtttcaatctgcagcagagttcattgttggtaatgggaagaacaccaggttctggacagcaaattggctgggtggggggagcatcgcctggagatggcctattctagcaacttatgtaggcagatcacatctcacagttgctcaagctctatcgaatcacagatgggtcagagatttgcaaggctccctttccaacgaagctatggcccaatatttccagctctgggatgaaattcagagatttcacctaagtcacgaagaagacacaatccgatggaaattatccaccaatggtcatttcagctgctcctcagcctacagtgtattcttcttggcaaaagaactctgcccaatcagcgaattaatctggcaagcgaaggcaccggcaagaatacgtttcttcatgtagctggccgtaaaaggacgttgtctgacagctgataatcttgaaaaaaggggatggcctcacgctgattgctgtactttgtgccaacgagaacctgaaaactgcttacatctgtttatcaactgcgactataccatcacagtgtggagacagatgcggcaatggatcagtgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgcgaattgcagttcttagttttctttctgttgtgttgacgtttccagttctttagtttgccgggctgtggttcctgccacagtctaattcgacagcctcctgtcgttgcaagcgagaactacttgtatttgattttttttccctcccaatcttaatgaaatttggtcgccggttccttcggccgacccggcaaaaaatcactgctgcacaacgctcactgtggttgccatcaatttgacatagtccttcctaatcttcttcagtgtcacgaccacatcactcatcgccatcctttgctctggggagtgagccgaacagagcaaacccagctcgaacactggcacaaggaagccatgcatgttacttgaagaagaagaagaaccattctgtagaagttggcagtccaccacatggacaagctctgcaggaaacgcctgttgaacccactgcctgatgttcagttctcccacaaacatagcatctgtgggtcttttcgcagtgaacacttcaagcagcatgatgccgtaactgaacacatcactcttccgtgacgcttttcctagagtcccatactctgctcaagaaaaattagataccaaaaattagttgcaccctatctactcaataataataaaagatcgggcaaagtttgagaaagacaagaaaaactattaagtacctggtgccatgtacccaactgttcctggcatgctagctgagatcatggagttgtcatcacctaacaacaaccttgcaataccaaagtctgccacatgtgccgtcatatcatcgtcaaatagtacgttgctaggcttcaaatcgcagtgtaagaccacctcatagtgctcatgatgcaggtattccattgccattgacacatctagcataatatccaacctctcgagaaagcctaattgcttcccttgttctgagtgcaggagtgcttctaagctacccttgggcatgtactgaagtaccagtgctttaaagtccaggttggaacaagtgttcagaatctttatcaggttgcgatgtcgagccattcggagcacgtgacacttggtgtcaaagcttctcatggcatgttccagatgctggtgtataacttttatggcaaccaccataccgttgctcaattgtcccctaaaaacttttccaaagcttccgaagcccaacatgttatcatcactgaaatcatcggttgcacgaagctcatgataggagagcaattgatggctgataaggtcaggcttaccagcagaagtattttgatggttagctttctttctaatcattacatacaggcaacaagctacaactccaactacaatgattatagtaggtagcaagtattttagcatatgaccattatttctgttgggggaggtggtttggcatggtgggaatcctaaacgggcagcaccacatagccctgagttccccaccaagtattgtaaagtgatgtttgcaaagacacctccttccggtatttgaccatgtagtttgttgaaagataggttcaagctaacaagggtcgtaaaattagccaagtagtttgggatggtaccagaaatactgttatgggatatgtccaaagtttgcaagccagttaaattaccaaaagagtctggaacagaatcatagaatccgttagctgatagattcaggtgtgttaacatctgaagttgtcctgtcgaatatgggattctaccagaaaagtggttgtcagagagatccatgatggtaatttgcttcaaataccctacatcaaccggcagtgcaccactcaagaagtttcgagaaagatctagcctgacgattttatcaagatgaaataagcttggtggtatagttgacgttaatttgttatcagacaatagaaggtgctctagattagtgaggttcctcatgtcctttggtatggagccagaaatttcgttgctttcaaggaacagttttacaatgttccttagaagtgcagtactcgatgggatgaagccagacaagctatttccacttaggtcaagccattggagattctcaatcgtcatgattgattctggaattgcattgcgcagttggttatgtgaaagatctatcacctcaagagcagttaaatttgaaatggtagctggaagcgtgccagttaacttgttgttagataacgtgaaccatttcagctgtgacgacaggttcccaacatagtctgggaggattccggtgatataattcaggtccatttgaagggtagaaagctttctacaattggaaacagtagaaaggaagttgagatcgccgtgtagattgtttttagtaacatcaactgccgttagtgagttcatgctatcaactgtcgatagtaatgatccatccagcaagtttcctttcagtagcaggattgccaacgatgaaaggttgccaagagaagcaggaataggtcctgttagttgattcatcgcaagatgcaaccatgaaagttggcctaggtgcccaatatctgtagggatgtttcctgttaggttgcacgtcgtcaaatctaagactgtcagcatggtgaggttgctaagtttagttgggatggggccagcatcaaagttattcccacccaaggagatggcatcaagattggtcaacctgcccagccatggtggcaaaacaccctcgaataaattataaggcatggcaataacttggaggtatggacacgctgtgagccccagtggaatctgaccaaagaaattgtttttactgatggcgaaccatcgtagaactgggaggctgaaacttgtattaccagggatagggccagttaaaccattcgatataagagaaatggtacttaatttagacatgttgaagatggctggtggcaccgccccagttaagttattggcctgcaagttaaggtgttggaggattggcatggaaccgatgcaacccggtatcagtcctgacaggctattgttaccaacgttgagataagttagcaaaggcgtgttgttgaacagatcgtccggaatcgatccagtgagttaattgtgacagagattcatgctgtcaagactgtacagcccctgcagctctgccgggattggaccgtatagctggttaaactgtagattaagtagctaaagcctcgtgaggttccctatggcgattgggatgccacctgacatggcattgtggccgagatcaaggagctcgaggcgacgcagccttcctatttcgttgggcaccgagccagtgaggctggtgttggtgaggttgaggatgaagagaaaagaaatgttaccaaggtgagagctgagctctccttggagaggaacgtttggcagttccagggcggtgacgcgctgccggcgccggcggtggctactgcacgagacacgcacccaccggcagaacggcgttccggtggtccaattgccggcaaggatgttgttagaatcggagagctgggctttgaaggccagcaatgcagcgaggtcggtttcgctgccgttactcttgctcgcgatcggacctggagaggaagcacaaggcacagtactggacgaagcgatcaacaacgccgcaacgaaaatccatactggcaatcgaacaagcgccatgtctggttgtgtgtgatgcattggcagcaagagtatgcatcatacttcacagtgacgatcaagttgagctttgtttagcacagtagtgctagtttgctttcgacatgtaggacgaccttgactgttgctctcagaaagcgaaagaaacttaaatgatactccttccggtcataaatatttgacagcactactaggtaaacgctgaaaaataaagacatcacaaaatatatattcagcagatcgcggtgtgcacgacacgctagatatgatagctgtgtcgctccgtcatcagccatacgctcactgattttttttttctgtcaaacaatttgacggcaacggccttacgtactcttttgttgattgggtggttagatcggcaacgattgtatagttttagcaagtttaatagtatagcccgctactagctccaaatcatctatagctaacgtaatagataatctatctatctatctatctatctatctatcttctatctatctatctattatatactaaaagtccattaaacttcctacaaacactcctacgacgctacgtggcgttctaataaattagaaaaaatactagaaattctataaaaaaaagcaaaacatctagccattgattttcattaaaattagtgggcccgttactccaagccgttagattagattggtttattctcttactttctaaaaaacaaagaaggaatcctgccgtgcgtcatgtatgagtacctcctctccgtttcttttcctccccttcctctctttactatgttctgcaacaatacatattgaataagtatacttctaaattacatattatttatataaataagtaattacatattatttggaccaataacgatcctaggccaccacgtggcgttctagcaaattagagaaaatcctaaatctatctatctattatttatatactaaaagttcattaaactttctacgtacgctctcaagctaccacgtgagactcctatatataaacgctcctaagtcgccacatggcgctctaataatttaaataatattctgagaaaaagaaaaatatctgaccgtaaagtttatttaaagtggtgacccaatatattaaccg

SEQ ID NO: 30749 - DNA, 7732 bp, Oryza sativa
ctcgatgtggtcaggggacgcagatttgacttcccccgtgtaccgggtggcgccgcagccttcttcccccgaccacacgagatcatcaacaacaaaacaacagaaatatacaatattttttaatgcaatagggatgcatagttctttggatatccaaactgcatgtctgggctctaacgcattgccaagaagatggtaacattatttttgcagacaatcggtttgagatttagcgctggttcagtttgttgccaaaactagcattaccaaaatttggtattgtccaattctggcacaatttagagttaccaaattttattaacgttggatatgttcaatttgtagccatgttaaaatttagtagctagtgcttgtatgagaaggaacttccggaaataccaaattgtggtgaagtgacaacggcaaaatttgtttagtttgttatcttactaaaatttgataacataaaaaattaataaagttaaaattgacggcgaagtgaataagcccttatttagctttccattccgctaggcatgcgtgctgcgtaatcatttgacgcttcaacatccaagaccttgactctcagtcaacctagaaggaaaaaccagtggcagtacgatccttatcttcccatccaaaagtgggtttgagcgacaattattaggcggctttccactctacttaggcattgtgtagttctaaatttttttttctaaaaatatcacatcgaatttattagccgcctgccacagtcgctcctggtgtcgcctgtccgccgacgctcgttcggtgagggagagagagaggagagaagaaagagggagaggagagtaggagacagaaagagaaagagggagagttaaaataattatgagaggaggagagagaggggaaaaaattgaagcagtgggagggaaaagagagtggagggaaaaaatgaatggagggaaattatgagaggagagagggcaaaaataaattttgaattgaattttatgatactaaatgaactcatatgaaaaagttgtcaaaaaaagtttatatatctcatcaagatttataacttttattttggcatttttctatataacattttttgaacagtttgaatttgaatttaaaaatatgacaactccaaacaatattttcaaatattaaatgattttaacttaaaaaattcatcaacaacaaagttgtatacctcatcaagatctattacttttatttgggtatttttctatataacaattttttgaacaatttgaatttgaatatgaaaatatgacaacttcaaacaatattttcaaataataaatgattttaactgaaaaagtcatcaacaacaaagttgtataattcatcaagatctataacttttattttggtcatttcttcatccgacaaagtgatagtaacattgttcacaaaattcacatatctctcatttggttttataaactataacatagatatgtaaattttgtgaacaatattactaacattttatcggatgaagaaatgataaaaataaaagttatagatcttgatgagttatacaactttgttgttgatgacttttttagttgaaattatttagtatttgaaaatattgtttgaagttatcgtattttcaaattcaaattcaaattcaaactattcaaaaaaatttatataagaaatgaccaaaataaaagttatatatcttgatgagttatataactttgtcgttgatgacttttttagttgaaattatttagtatttgaaaatgttgttttgaagttgtcatattttcaaattcaaattcaaactgttcaaaaaaagttgtatagaaaaatgaccaaaataaaagttgtaaatcttgataagttatacaactttgttgttgataattttttcattttaaataatttattacacgaaaaattattttgactaataaaacgaattattatactgcagttaattattttgctacaggtcaactcacaaatataaacatttcatatgaaaaatggaaaaaatgtcatcaataacggccattagttaaagtccgacagaggttaagtcatctcaatcgggcattaatatagagcccgtcacggatgagtcatatgcgacgggcctagttgttatatcacacggatgtgtcatatgcgacgggcctagttgttattttaatcgggccccaagttggtgcccgtcacagatgatggtcatctgtgacggacgccaacttgaagcccgattgtgatatggaatgttatctcaatcgagcctaaattatggcccgtcacggatatgtgtcatccgtgacgggtctgagttttatatccatctaatatgtctgttcgaccatatctcaatagggctttttttggcccgattgagatgactttcttgtgacgacccgttaattataggcatattagaggccgtcacatatggaagattctgtactcatggtggtttttctttttttttccactcaccctcaaataaataatctttactgcgtgaaacactacgcacgatatgtaatatttatatgcaaattgaacgttgaaaagtggtcaattcataacccttcgtcacgccgcagaaggaaaattaatagcatacaggcatgcatttacgtacttgaaataattttatgtcgattgggtggtgagtggcaatgcctgtctacccctaccgttacgcacatacctcatgttcattaatttatgccgtttccatttaacatatctctacttcctaaggaaactgactgactgacaaataggacatgcgatttttttttaatcttcagcatatgactttgacaataaatcaataaaatttaataagttctttctatggaaaatctcgacataacagttttatgattttatattaagcgttttatttttttttacgatcaataatttaaagttttgactaaaaaaagttcaaagttgatcacaagagaatcttattaccagtcgtactcgtgttctctctctctctatatatatatggccaaacaacgaaaacacagacagagacacgagcaagctaacgagtgagtgcaaattaagctagtgatcgatagtggtcatgggtgttggtcctcattgtactactagtctgctaataatactggccgtcgtcatcacgtcgtctttgctcacgacgacgatcaaggcagatgagccgagcaatgataccgacatcgccgcgctgcttgccttcaaggcacagttctctgaccctctgggtttcctccgtgacggctggagggaggacaatgcatcctgcttctgccagtggatcggcgtgtcgtgcagccgccgccggcagcgcgtcaccgccctggagctgccgggcattcccctgcaagggtcgatcacccctcacctcggtaacctctctttcctctacgtcctcaacctcgccaacaccagcctcacggggacactcccgggtgttataggaaggctgcatcgcctggagctccttgatcttggctacaatgccctgtcaggtaacatcccagccaccataggaaacctcaccaaacttgagcttcttaatctcgagtttaaccagctatctggtccaatcccagcagagctgcagggcctgcgaagccttggcagtatgaatctccgtaggaactatctcagtggcttgattcccaacagtctattcaacaacaccccattgttaggttatctcagcattggcaacaacagcttgtcagggccaataccgcacgtgatattctcgttgcacgtgctgcaggtccttgttctagagcacaatcaattgtccggctcactgcccccagccatcttcaacatgtccagacttgaaaagctgtatgccactcgaaacaatctcactggacctatcccatacccagctgaaaaccagaccttgatgaacatccccatgattcgggtgatgtgtctctctttcaacggattcataggccgaattccacctgggcttgcggcatgccggaaactccagatgcttgagttaggtgggaatctcttgacggatcatgtgccggaatggttagcgggcttgtccctgctaagcaccttggttataggtcagaatgagcttgtcggttcgatcccagttgtgctaagcaatctcaccaagctcaccgtgcttgatctgtcatcttgcaagctaagtggaatcattccattggaactaggaaagatgacacaactcaacatcttgcacctctcatttaatcgcctaactggtccttttcctacctcccttggtaacttgacaaaattatcttttctaggattagaatctaacctgctgaccggacaagtacctgagacccttgggaacctcaggtctctatactcccttggtattggaaagaatcatctacaagggaaacttcacttctttgcccttctctccaattgtagggaactccaattcctcgacataggaatgaattctttctcagggagcatttctgcgagtttactagcaaacctctctaacaacttacaatatttttatgcaaatgataacaacttaactggcagtattcctgctaccatatcaaatctgtctaacctgaatgtaataggcctttttgacaaccaaataagcggcacaattccagattctataatgctaatggataatctacaggcattggacctctctataaacaatttgtttggaccaatcccaggacaaattggtaccccaaaaggaatggtcgcattatctctcagtggcaacaatctttctagttacatccctaacggtgttggcaatctaagcacgttgcagtactgatttctgtcatataataggttgtcatcagttatacccgcaagcttagttaatcttagtaatcttctccaactagatatttctaataataacttaactggttcattgccttctgatctcagttccttcaaagtaataggcctaatggacatctcagcaaataatttggtcggtagcctcccaacttcgttgggatagctccaactgtcaagctacctgaatttatctcaaaacacattcaatgattcaattccagactctttcaaaggtctaattaatttagaaacattggatctgtctcataacaatctttcaggaggcataccaaaatacttttccaacttaacctatcttacttctttgaacctctcctttaacaatctacaaggtcagataccaagtggaggtattttttcaaacatcactatgcaatctttaatgggaaatgctggactctgtggtgctccacgtctgggatttcctgcatgtctggagaagtccgactcgactagaacaaaacacttgctgaagattgtgctccctactgtcattgtggcgtttggtgccattgttgtgttcctatacctaatgattgcaaagaaaatgaaaaatccagatattacggcttcttttggcatagcagatgcgatttgccacaggctagtgtcctaccaagaaatcgttcgcgctaccgaaaatttcaatgaggacaacctacttggagttggaagttttggcaaagttttcaagggtcggctggatgacggtttggtggttgcaatcaaaatcctcaacatgcaggttgaacgagctattaggagttttgatgcagagtgccatgtcttgcggatggccagacatcgcaacctgataaagatactaaatacatgttccaacttggatttcagagcactgtttcttcagttcatgcccaatggaaacttggagtcatacttgcactctgaaagcaggccttgtgtgggatcattcctcaaaaggatggagattatgctagatgtgtcaatggctatggaatatctgcatcatgaacaccatgaggttgtcctgcattgtgatttgaaacctagcaacgtgctatttgatgaagagatgactgcacatgtagcagactttggcatagcaaagatgttgttaggggatgacaattcagcagtttcagcaagcatgctaggcacaattgggtacatggcaccaggtacttacactagccaatctaaagccacatacattttttgttggagttgttacaaattcacttcaagatattggccgggcttctgacgaagcggagcggaggcccgtcgccggaggcttgggccggagccagtgggttggtgtatcgtgtagccgccgcaggtaacatgcatggcttccttgtgccagtgttcgagctgggcttgctctgttcggctgactcccccgagcaaaggacggcgatgagcgatgtggtcgtgacactgaagaagattagaaaggactatgtcaaattgatggcaaccacccgacccggcaaaaaattgatggcaaccacagtaagcgttgtgcagcagtgattcatcgctctatcgttgtatatgagcgaatgaaatacatatcatttgcatcattttcttcttctgcattaggaatagcatcagtgatcgattaccctttgtttgtatttgtgtatggttgaattgaatatatatatatatatatatatatatatataacaatttcgttggtgtaaatatgtgattgaaccgctggtcaataaatttgcatcacgaaaatgggagtagatgatgtgctacttatgttttcttatttctggccaaaataaataaataaaaaaggaatattatcggcacagcatcacaactccggctcgttcagccttaaacaaccacaattaacagtcctaagcagagaaacttaacaagcttttcaggctaacagaacatcaaaaggtccacaagacaacagggtcttcagagagcacatcttcaggctgtcatgcacgcaaaaaagatcagacagccagatgagagcgggtacaataaccggtagccatctcagtaaaactaacgaggctgtaggacagagaagaaaaaaggtagtaggaacgggcgacaatagtcggccagctctacatgagctccaaggtgaaaaagcctacaagataggaattttcaatttttaaaaatggccatgggcccacaagtagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctataaacatactttaaagagataaaggaagagagagaggaatagcagattacagcacggattacaagacgtaatatgtgtataacatgtgagaccagatattaatagtatagtaagcaactattgtatgaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgttccgattacttataaattctcctattgtcaccacaacttattattattgttttaaaagttatgatctataaatagattaaactggatatgtaccaataaaataagcctaatacatcattgatacactaaaatattcactacttatctaagtgttcatgtttcacttatttccgaatcaatatataaatattttaaaaatcccctt

SEQ ID NO: 30750 - DNA, 967 bp, Oryza sativa
  unsure (1)..(967): unsure at all n locations
tgttgggcgtctaagacttcaccgccggcctgcctccgtcgccgccgactggtgcctccgcctacacggctggcctattatgccgctgctgttgggcgtctacgtcttcaccgccggcctgcctccgtcgccgccgactggtgcctccgcctacacggctggcctattatgccgctgctgttgggcgtctacgacttcaccgccggcttgcctccgtcgccgccgagtggtgcctcggcctacacggctggcctattatgccgctgctgttgggcgtctacgacttcaccgccggcttgcctccgtcgccgccgagtggtgcctccgcctacacggctggcctattatgccgctgctgttgggcgtctacgtcttcaccgccggcctgcctccgtcgccgccgattggtgcctccgtctacacggctggcctatatggttggttggtcacaccaccgtttttgggcgtctacgtcttcaccaccggcctgcctccgtcgccgccgactggtgcctccgcctacacggctggcctattatgccgctgctgttgggcgtctacgacttcgccgccgactggtgcctccgcctatatggttggttggtcacaccaccgttgttgggcgtctacgtcttcaccaccggcctgcctccgtcgccgccgactggtgcctccgcctacacggctggcctattattccgctgctgttgggcgtctacgtcttcaccgccggcctgcctccgtcgccgccgagtggatcctccgcctacacggctggcctacgacttcaccgccggcctgcctccgtnccgccgagtggtgcctccgcctacacggctggcctattatgccgctgctgttgggcgtctacgtcttcaccgccggcctgcctccgtcgccgccgagtggatcctccgcctacacggctggcctattatgccgccgctgttgggcgtctacgacttca

SEQ ID NO: 30751 - DNA, 598 bp, Oryza sativa
  unsure (1)..(598): unsure at all n locations
ctccaagttctctctgttcctccccttcttcctaccccttctctctgttcgaatctgctcctctaatcccaaaactcccaaattcgcaagcagattcgtaacaataggtatcagagccatccatcctggagtacctcgacaaacctagataccattcccgtgcgcaactcaagtcccaagagatggagcagcaattggcggaactcgcggcggccatggcgacaatccagaagcagaataccgccatccaagcttcgatgggatccttggaggaaatcaagcctatggtggtggaactcgcgagctggaagccagcggtggacaaggccatgacggagatgcgggacgacctcggcgacctgcgttagcaagtggagcggatatcccgcaatccgattctagccgtcaagccagcggatctgccccctcttctacccacgccgacggtgcctcaaatctcggtgccgaaggaggaggagacggcttacaaaggggcggacgcgagtccagggcccgtaggccatggcgttgcaacgatgaatcgngggaaggcgtctggagatgatatttctacaacgctttcccgggcaagggtacg

SEQ ID NO: 30752 - DNA, 699 bp, Oryza sativa
  unsure (1)..(699): unsure at all n locations
nnnnnnnnnnnnnnnnnnnnnnnnnnnnnnnnnnnnnnnnnnnnnnnnnnnnnnnnnnnnnnnnaatacaattcggcgcatcgccacttttttaccttttctactttattttatcgttcggcggaacttggcacctgacgcggggctgcatcggcttcgatctccggcgaatgggtaagtccaatgttccgctggcccaggcaattgtatcgtctacgtcggcgtcgttcaatgctgcatcagtacattcgacctcttggattgctctgatttggacaatatgtttgcctggctatttatcatgtgtctatattaatctagtcttagaatctcaatttagctctatcggttgtctctcgctttagggtttctgccggtatcggctaaatcgccctgctagattagattaacttagacatctaccaccctgaaaatcagtcaatggcttaattgtttagatattgtatttctttttatacttagtgctgcatcagttaagtttgatctactaaatcgtgcttagaaccataatctctagcctgctttttgactgccaataagggtttcatcggggtttcagccgatgagttatctggacattgcatcggcttataaggattacatataagttggatttagtcgatcgcaataaagactttactgaataatctaatcttgtggatttatgacatncgaccc

SEQ ID NO: 30753 - DNA, 702 bp, Oryza sativa
gaagtgataattctcaaacaacataacaatgccaacaaaatgttgatgtccaaagtattagatcattcaaaaaaagcaaagacggttaatagcacctgaaactctgcattaggatcagcaattaattgaggaagcttagaaaggcagatctctgcagccatgtcccatgcatccctaaaattgaaatttaggaaattaaagaaaatggagaagaggtagctaaactataaaaagaatggctagtgccatcaattaccacatatggtgctgatgagttggtggtaacaaagggtatgaaattggggaacaatttgcggaccgcatgattctctcagcaagtaagaagttgcgaaagagactagcaaccaaaagatcctgcctgaaaagtctttggaatagatctgcgtagtgaaagttgaatcataacagattaaaagaaaatgaatgagaaagcaattgatcactggcattaattgtgattaaaatgactatcagtaccatgaggaagaacattccatgcaatagtgtctgtgatagcagtgaaaatccagttcaactcccctagaagagttttgcggtcattttgccttccaggaatttggtcaataagattgtgttccatggaatcacggagtaacgatcggttacaaaacctgaatagtttatatacatgaatatagaccattattgatgcagatacag

SEQ ID NO: 30754 - DNA, 761 bp, Oryza sativa
  unsure (1)..(761): unsure at all n locations
cgccgtccccgtcgtcgaggtcgaagtccccgaagtcgttcgtccatgtcgtcgtcgccgtacgccgcggagacatcgcgccgcagaaggggcagtggggtggccccgcgggaaagggagccggcgaggaaaagggacgtggaggaggaggggttagctagggttttggagagcggcgaggggaatggataggggaagccggaggcggagacgacgagagagagcgacacggtggccgccatgtctgagtttttttttttttggcgcgcggtcgagagcgagtatatccatccacgtaggtgtgtcgagatgtattagcacgaatcttaaagcacccaactttgttctcgattgttctgacggcgagagaaccaaccaaccctaccttggctttgccggcgggcggcggcgatggcgtccgcgacggaggcggaggctgaggagagggacaaacccatcgtcgtccgtgtcaagcgcaagccctcccagacccgccccgacgctttctgtgagtaaacctctctcctttcctctcattgctcctccccctttctctacccaacttcatagtggaaaaaaaacagacatgatttttgtgattcgttagggctagagatcaatgagaggccggtgaagaaggctatgctcgatttctccagcctttcagtctccgagccatcctctgctcctaataaaggtatctactnnnnnnnnnnnnnnnnnnnnnnnnnnnnnnnnnnnnnnnnnnnnnnnnnnnnnnn

SEQ ID NO: 30755 - DNA, 1139 bp, Oryza sativa
tatcagttaatagcacaagattgcatatctgaatgacgaatcttctaattttccatacaagagttatggtcctaattttctgaatattgtcttttcatggaacaatgcaggatgcctaatatagtaggcacaggaaaataacagagcttaaaaattaaattgattttcttctaataattacagttaacacacaatccttgatatgtatatagatgctcttattgtccccacacagttgacacatgcatttatgcattttcggaacaaaacagtgaagatttttatagcagctattcatgattaaatgtggacaataattacatcagttcgatttggtttaatcacatatatgtgctagctttgcttggagatcacaggaaaacatggcttactatgaattttgatgagcaggataatatcttgttcagatgacgaggtcctcgcaaggaaatacagaataagaatgaggtaggtatctacgttgcacctctagatcgaataaaaatttgatgtactactgggaggggtgaagtgcatgatcttttataatttctatattaaaggggaattgatgcaccggagcttaagatgccctacgggaaggaatcacggactgcgttggtgaaactaattggtgggaagagcgtcaaaatttatgtatatgatctggaccagtttgggcgctacgttggtgatatctattgcaataatttgttcattcaggtgaaacataacctatttcatcagtacctccacatgtatcatgattttactgcttcaattcttatgagagaaattatgtgctctctttgagtccttcaggagcaaatgttgaagaatggccacgcatggcacttcaagacttatgataaacgcccagagtttgcaagagtaagagattcaactatattgtgtgttgttacttgttttgctctgacaccttttttttttacataaactttgtcgagtcatgcttacatatgttgttacttctgggtaataaagaggtgttcacttactccctgattatgtagtgggagagagaggcaagaactgcaaaccgagggctttgggcgtcagggaattctgagaaaccatgggattggagaagagaccaacgcaacgcaagacaggacgcc

SEQ ID NO: 30756 - DNA, 598 bp, Oryza sativa
  unsure (1)..(598): unsure at all n locations
actcgagaaaaggttgttgtcggtgacatgggaccgggagtatcatgactagaggcttgggcaggagcaatcacccacgaggcctgaccccctcgggggggtcgggcccgagggtgatgtggccgcccccccctctctttgtctccccgaggggtcggactgctcccatttcggccccgagggctgaggcgccccgaccccttgtaggttttgcgccgcgtgtatgggttaggtgagcacagcggggctcacctaaccgcattaattgcggtttggacgagcgcgtcacgccgcatgtaacgcagtgcagcgcgctcgtttatccggtctgtgaccagtctcagaccggtcagatcgtggattaggtggcgacaggcggtatgacacacgcctcgccccatcccgtcaagatgagtgcctccaagcactcgtccctagccggagccggcgtgttacctcctgaagatggcacgttggtcccggtcagatatatgccaggcttcatcctaaccattagaggcaagatattgtatgaagaagggnnnnnnnnnnnnnnnnnnnnnnnnnnnnnnnnnnnnnnnnnnnnnnnnnnnnnnnn

SEQ ID NO: 30757 - DNA, 532 bp, Oryza sativa
  unsure (1)..(532): unsure at all n locations
gatgtttgcttcatggcgcgtggtgaatctgatacagagtatgaagataatgagatgagtgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgttcaaattgtgaggttttaatgaatgagatttcaaaaattagagatgttaatgctgcacatgatttgaaaaataaatcttatcttgcttatagttttgttttgcacacacgcactttggatgagttgtttttaactaaaaggttgttgcaaaaatatcaaattgcttttcatgctagtttgatgtttaacatgatttgtgctaaaaatttaaaacaatctcatgatgatatgcactgatccccatgtagtttgcataacatattactctannnnnnnnnnnnnnnnnnnnnnnnnnnnnnnnnnnnnnnnnnnnnnnnnnnnnnnnnnnnnn

SEQ ID NO: 30758 - DNA, 711 bp, Oryza sativa
  unsure (1)..(711): unsure at all n locations
nnnnnnnnnnnnnnnnnnnnnnnnnnnnnnnnnnnnnnnnnnnnnnnnnnnnnnnnnnnnnnnncatggccactgaactaaaatacgaggaggattacaagctagggaaaaaaccagagcaagaaaaggaaaaaaagagagaaaaaaacagagcagagaggcaagaagaagcgcacggccacgagcctgcgcatctcacactcaacacgcccggaccggactcgcaaaaggagaagaagcagcagcagcagcaagcgagaggagaggacagaatccaatttccgattttattttttagtaaatagtttcctcgtcttcctcctcctccacctgacctccccgacgcttcccgtccccaaccctctcctcccccctctccaaaccctaaccctaaacccctcccccccactcccgttctgtcaatcttgtcatcgtcctcaccgccgccgaccggggctgcctccctcccgtctccggattcggattcttcaagcttgcctgccggattcgattctgatggcttcggggtgaccgcccgcgaggagggaccaagcgtagatggcattgggggatctcatggcctccaggctcgttcactactgcttcttcttcttcggcgtgccatgcgacggcctgcccaatcaccataccaaccacctcgttgatgaccaccttccccgtggagaatggaccggaccccatgatggacgt

SEQ ID NO: 30759 - DNA, 631 bp, Oryza sativa
tttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccagtttgcattgattaccctattccttgataccttgggttattataacttgactagttgggctttatatattggttcagctagatattagatatgattgcttagccatgcttagaaacattagcacactattgggataacttatgactcattattatttaatgatggcttaatgatagttcatgatggttaatcgtgattggttaatcaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaa

SEQ ID NO: 30760 - DNA, 488 bp, Oryza sativa
  unsure (1)..(488): unsure at all n locations
tatagggcgaattcgagctcggtacccgatttatctctaggattctatctctaggactctatcttatctctaggattctatctctaggatatatcttatctctataatttgtatttgactcttatctctaactaccatattatacttctaacattccccctcagtcgtaacgggagcgaagtgaacgattgcgactggatttgaaatcttctatttcttcatctttctttgactcaccatcatcgactgcatctctgatggacggtcctccacctggtgcctgcgtccccttctgtgtcgtcccttgactctcctttattccctcccgcagtcatagcgggagtgtcatggacgatagcgatgacacggacgcttggactggagtttccgtcaatgatttttgttgtagacgttcgtcgatnnnnnnnnnnnnnnnnnnnnnnnnnnnnnnnnnnnnnnnnnnnnnnnnnnnnnnnnnnnnnnnnnnn

SEQ ID NO: 30761 - DNA, 4236 bp, Oryza sativa
acacctcaaggtacttttgtgcatcaaacgaagtatacaaaggatcttttgagacggttcaagatggataattgcaagccaatttcaacaccaattggttctacagctgtgttggatcctgatgaagatggtgaagctattgatcaaaaggagtatagaagtatgattggatctttgttgtatctaactgcttctaggccagacatacaatttgctatgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggtggttgtagaatttatagaaaaagtactagtggaacatgtcattttcttggtacatcattgattgcatggtcttctaggaaacaatctagtgttgctcaatcaactgttgaatctgaatatgttgctgctgctagttgttgttcgcagattctttggcttttatctactttgaaagattatggtcttacttttgagaaagtacctctcttttgtgataatactagtgctattaacattgctaagaatcctgttcaacactcacgcacaaagcacattgatattcgttttcactttttgagggatcatgttgagaaaggagatgttgaattgcagtttttggacaccaagttgcaaattgctgatattttcactaaacctttggattctaatcgctttgcttttcttcgtggtgaattgggcataattcatccttttggcatggtttgagggggagtttgtacctcatggttttatcaagctataatatgacaatgagaaaaattaagaaaagagagctttgtttatgcatatggtattttcttgtgcttgctagcaatactttgaaggtttatttgtctctagtatagcttgtatgtattctagtctttcaatgagacttagattttgtttttaagggagatgatacatgacacttaaattctatacttgaattaagaaaatatgcaatgttgatgctagcatatggtttgatctataaagcacgctttatgtatatgctttattgaattgttattcctcaactagttttaattgctcattgtgaaaagagaataaaaatatgaaaaaaaaaatgaataccgaatccttggaaatagtcttgacgacaaggacgtattcgacgtgagcaaaataatgggtgccgaatccctggaaacagtcttgacgacagggacgtacccggaataaaagagaaaaatatgagcaaaaaggctcaagaaattctcttggttgttttttgtgctaaaggttatttgggaaagagtgataaatgcaaataggtatatgtgtttggtgtatattcttcaatctatgtgcttgttaagatgttgcattataaatcgtatgaaatcatgaattttgattgttgattcaagcttaattgtaaaatctttggttcatgtttatactttaatgcatgcttgttatattatagatgggttcatcttttttttattgcgacacatgacttgatatgctatatgtatgctaagctcttgaacattaatgaatataattcctattcttgatgaaatcattgtcaaaagggggagaagagatgagtttttggagaagcaaggtgttgagaagagcatgttttttggttcagttgggaatttctttcttttaaaatggaaaaaggggaagaagttttcttttggattttttagcacgatgtgtacatttgtacgaagtgtgctttttaccacttttgtttttattttttcaaacaacaaaacatttttatgagtttgccaatgtgtttatcaagggggagattgtaaaatcaaaggtgtttttgattattattttgtgatgaacaattgggcattgaaagttattggttttgttatttggaatttattcacgaagtggttttggagatgattggatttacaggtagccgatccccgctgtcgccgtcgtcgcactcacccgccgccagctgccgatgttgctgccggcgttgctgctgatgttgctgtcgacgacgaagcggtagtggacgtcgttgcgctcgagccccacgccaccgagccccaggatgccgccgcggagccccggcaacatcagcccgaagtgcttcagtgggctgtacaccgtcacgccggcgcatagtagcggcgccgcctgctccggcgctagcctcgccgggattttcaccacggcttcacggcgacgacgcgggcgcggccatggacgacctggcgctgctgccatcggcttcacggcgacgagcgctacaaggaaaccccgtccctctgctccgcccgagcccggagccgccgctcgcccaccgcttgccgccgccacagccgcgctcgcccactgacgccgcccctccgcttgctccaaccgcgcgccgccgcccgctgccgctcgccctctgcggccgcgctcgccgacgccgcccctccgcctgctccggcctcggcgggggtgaggtggagctcggagatgaggcggtcgagcttgttgagaacgaggcaggggcggaggcgctcgaggaaggcctggcggagggcggcgtgggtctgaatgtggacgccctcgacggcgtcaacgaggatgagcgccgatcgagtcggagagcctcgcggcgccggtggaggagacctcggagcagaagtcgatgtgccccagggagtcgatgaggttgacgcggtgtcccccgtggtggagcacgaggtggcggacttcatggtgatggcgcgacatgtatagttgcagcacattgcaggattcttgctcgctttagcttggctttttttttggatgggcgacgagtgctcggctgccatttcatctcctccacttctcgctggattttgctgtgttcttcgtgtttagattctcgccgccgtccgctttagctagacacgggtgcctactgctagattgttttggagcagaagcaggtgtcaccttgcgatgaagaatcgtcagaaatgagtgtggtgactgcttggatatgcagaggggcatttggttgttgagacgaaaagatggaatactatctgcagcacattgcaggattcttgcaatgtgatggtgatggcgcggcgctgctcctcgtcgaggtagtccatgaagcggaggcgccccgcgagcctcgggttgacgtaatttttttaccgcgagcctcggctgacatgtgggccctacgtatttttttaatttttttttctgactaggatgccacgtcaacaaaatcggaaaaaaaatattaccatgagacctcctttgaacggtttgagtgagtttaggggtacatttctgattttgtagtcaagggatcttagaaaatctcgatgttaagttgagggacctccggtgaccttattccttttatgcgtacaccactctatctctatcgtggacaaaattatcatttccgaatcataaaaggcatgacggacgaaagttttgacaaaaacattttaattttttataatagtagagatagatattaaactagaaaagatgcccatgcgttgcaacgggtagagccgatttaatttgtacatatgtgtcagtggataaataattacaacctattgtttcgtctattcatgtgcttatccgaatcacttattgccaaataaaagactatttgtgtgtaaatcttttatatacatgttcttagcaaccaaaaaacaaatgttgtaaaataaagtacgataaaaaccaaaaagtcaaattcaaaggataagccaaacaatgaggcctttaaacacgagcttattttatcgtccaactttatttcaagtcgggcaggaattgatgatggacggaatcagcaacttctatcatcctttatttcagttggcatgttcttttcaaaagtaaaactgattattatggattattatggattattgtaacagtatccctaatagtacgtacgagcatgtgtggagactgacttgaaatcatgctaacatgttccaggaatcgtgtcgtgtaatacgaatagaatcagatgatctaggcaacaacgtacgtgatatccacatggactctgcgagttttattcgcttggtatctacatcacacggactctcttttgcagttcgcttgcgagtcgtggcttcacaatgaatgttacatgtgatgggaatc

SEQ ID NO: 30762 - DNA, 530 bp, Oryza sativa
ttttatgagtttgccaatgtgtttatcaagggggagattgtaaaatcaaaggtgtttttgattattattttgtgatgaacaattgggcattgaaagttattggttttgttatttggaatttattcacgaagtggttttggagatgattggatttacaggtagccgatccccgctgtcgccgtcgtcgcactcacccgccgccagctgccgatgttgctgccggcgttgctgctgatgttgctgtcgacgacgaagcggtagtggacgtcgttgcgctcgagccccacgccaccgagccccaggatgccgccgcggagccccggcaacatcagcccgaagtgcttcagtgggctgtacaccgtcacgccggcgcatagtagcggcgccgcctgctccggcgctagcctcgccgggattttcaccacggcttcacggcgacgacgcgggcgcggccatggacgacctggcgctgctgccatcggcttcacggcgacgagcgctacaaggaaaccccgtccctctgctccgcc

SEQ ID NO: 30763 - DNA, 10018 bp, Oryza sativa
  unsure (1)..(10018): unsure at all n locations
nnnnnnnnnnnnnnnnnnnnnnnnnnnnnnnnnnnnnnnnnnnnnnnnnnnnnnnnnnnnnnnttcacccttgcgttttggccatgttcattaactggtatgcagtttattagaaagcagtgtctaataacaggtgtggtcttggcaggttgcggtagaaccgtgtgatgtatggaagcagcagtcgcaggatttgcttgtacagtgaaatgtttcaaagataaacgttgtggaaactggggcgtgttttgtggtgttgaatttatctagagcaatatctccagtcctagagaatgagctccaaaagttttgtgccataactggctgaatagtgtattgaattgctgacggtagtattgtcagaacaacatactagtactggtattttgcttgtatgccagtggaggcgagggaggttatattcttgctgtgttgtatatagcgcaggtaggaatcaacaatcaaagagagatcattggggtaaagcatgttgtaagtagtgcggagtatgtgatatgccttgctgtgcctttttgatgcacaatttgattaatggaatggaacattgcattctcactataatttggttgttccatctcctagtgttttatgtggagtgttatctggaatgaggtctcatagcttccttgcctgaataaaggcactgaacactatattggttttctgcgaaggtctgaatgctagctagttgagagctgagacatggtagcgggcggttttgtcaggcatgcccggactgcacgggttcttgttggttgttgctactccagttcatctctcccagcagaaagatggagtcatttacacagtaaggttccatgcatggtccaatgcataaaaatgcttatcactatttaacttttgctggtgttgggcaattgtctccaaggaccggggaaataggtgagggcaattgtcataaaaatgcaagtcacaagtcgatgttacaactgaaatatgtgagaggagggaacatcaacaacaggtaggcacggtgtaaagcattgaagactgaagcggaggaggatggatggtgcgcagcgcaatgcaaaactgcagatgcatgcaggtaggcgattcagcagttgattctggagctgagaaaataaataaatactctaattgcaagcaaccaacgtcccaacccaaccaacagttgtaataatgagcaacttccgtccatccgcaactactgtatactcctgtatactctactatccatcatcgccgttgtgcacagggatccctccatctccacgtacttctccacgcctccatcgatggatcagaattcagatacagctcacttcatcttcagagaaaacctcgtatccttttacaacactgcattgcatttgcactgtcatttccttcctttcagttttactgtgtagtttcatctgcagtatagtagactagtacacatatacactggtagtcgatcaacataaaagatggtagtagtaagatgttgtcctgaaattttcagtcatgaaggacgaaatgctccaaccttaccttacctgtacgacaggcatgcatgttactccagtagtgaggtggttcgttgtatggccgacgcggcgagtcaccaagacgatagacagccggcctggccatcatcgatgcacatccgtcgccattaatggccgatggatggggtgcctgatgcccaacatcaccatcaatgataaaacaacaaaactacttcaaccacccctacgcattcaactccattctactctctttaccccctccttccttccttccttcctaggggagcatcagcagcagcagaagcaatggggatatgctgcagcaaggggaaggaggagcttgaggaggagggatttccatggaagcacgacgccttcttccacgaccagctttggagcgctggcgtctccatgcacaccaagcaaggctggaagggcgccaaccaggacgccatgactacctgccaggtaaccacatctctcttgcattggattgcttgctcatcacattgctgcctcattgcttccatgtttttcccagtcctcctttgcttgtatgtacagattcttctctcattttgatactagtatcatgtactagtactacacaagctgagtctctagccatggaggaatggggtaatgctagtctagaaaggggctttgtttgcctactacaacttcaattcaggacatgatttgactttgagcaccatacactagtagattcatccatgctctgctgaaactgattttttttgtagcctgagctgtacctgcatttctgtaatagcctgtatttacttcaaatcttcaactagacctgattgcttgctcttgcatgtttgttcagtgctgcttagcttcttgtctctgcaaattccctcatctttgtgatatatgtacacaagctaaagctagccatggagggaaaagggtagtgctagtaaggggctttgattagatactacaagctgaattcagaacatgatttgagcaccgggcactagattcatctctgcttttgctgaaactgataaatgtacctacatttctgtaatatttacttcaaccgtacctgatcctctctagcttgcacctccaatgatagtacatttcccttttccccttgatgtgcacattttacttaatatatataagataatctaggtcttgatgtgctacctgtgtcaagttcattaggactttgcggggcacaagggccagatattttgtggagtttttgatgggcatggccctctcggaagggaagttgctcgccatgtccgcgacgtccttccagtgaaactatcctcctctttggcactgaagactgaacaagatccatccagcaacacagataaggaaaccttggaaaagtcagattgcacctcattgagcgatacaagcaatgagaagcaattgttatccacctggaagaacatatttgtcaagacatttgaggatgttgatgaggatctgaggcaacattctggaattgactgcatttgtagtggcacaactgctgtcactgtcgttaggcaggtactagtgctacaactatgcaaacttgcaacatttttttgtattgccaatagtcttgcctatgcactagaaatacaccgtttctgcctaaaaaacaagcttctgaaaccatcagatgcaacaaagaaacttgccgaattttatgcgtatgttacagctatacttgtgcctaaatacagaactctcaaactcgtaatcattctgattaaattcccaaatactattcttatgcacagggtgatcacctgatcattgcaaatttgggcgattcacgtgcggttctttgcacccgagacagcaaggaccgcccaatttcagtccaactaaccactgacctgaaaccaaatcttccaagtaagcctctgaatttctcaaagtacagagatgtctaaattcagacattcacttgtcattcatatgggggcttctgacaggcgaagctgagagaatcctgaattccaaggggcgggttttcgccatggacgatgagccggacgtgcctaggatgtggctaccagaccaagacgcgccgggcctcgccatggcaagggcatttggagatttctgcttgaagagtcatggactaatctgtacaccagaagtctactacaggaagctatctgcaaaagatgacttcttggtacttgctactgacggggtaagcaaacagaaagacttttgcctgatgatggcagccaaattcagtttcatttactcaccatcttttcataatcaagagtaacacttttctcttggttgtttcactgctactccagttccagtactagatatgaaatgagcacaaaattaatagtgcaaagccatatggttgcagccagaaaagcgaaagttaactgaatcatgaatgcttttgcctcaatcaatcaatcaaattgtttttttaaagataatgcaaccaatcaaaatttcatccacagggaatttataaatcagaatagcggatagaggttgtttttcagataatgcaaccaatcaaattgttgtgggtgcagatatgggacgtgctgtcgaacaaggaggtgatcaagatcgtatcgtcggctactgaccattccaaggccgccaagcagctcgtcgagcgggcggtgcgcacgtggcggcgcaagttcccgacgtcgatggtcgacgactgcgccgtggtgtgcctcttcttgaagccttcaccgtcgtcgtcggagagcacccccggggacgcgaaacctcctcaggccgtgtcgttcacgggcagcttccgaaaggtcctgggcggcggcggcggcgaggcggaggaggggacgaatgtatggagagctctggagggggtggctcgggtgaactcggtggtgaggctgccgcggatgggcgccgtgctgagctggcggcggcggtcgacgtcgctggaggaagacgacgaggcgaggattgattgattgattgataacagtcgctttcgttgccggaaaacgtaatccagagggtttgattacatgctttaaatggcaaaaattagggagacgctttagaagttgattgacgtaaacgtatgtcgcattcaggttgttgagttgacggaatagggaccgatactgctgctgctatcctccctctcttgtagtagctgaaaatgattgcctagctgttggatgtggtggcctttgtttgatttatttattgtgattcttccttccttaatggagtacgctatcaacaaattaaatggacatatatgattgatgattatctggaatggattaaactccatttcaatttcagttcatctgatctgggagcagagaaagaggagcccatgcactgaaaattcaggcaaacagatcgggagagaattatatacagatagacagattcttaattagtgttggtagattattgaaagtactccatcgttctgcccaaacagccccttaattcaagtttcacccgtagtcagttcttcttttataatggacaagatttcgagttttcattccgtcgatggcaggaaaaagtgcaccgaaggtccctcaacttgtcatcgagttacaaaatggtcccccaaccacaaaaccagatatatgacatccctcaagttacaaaacccttcaatttagatccttcggtgggtttgactccggtattgtccgacgtggcggctgagtctgcgtgggacccacatgtcagactatccatgtcaccacttcttaccctccccatcaactcacttcctctctccttccctctccatgggcggtggccggcgaagagcagccagggcggtgtggcaggacggtgcggcaggcgcgggcgcggtcgccggtgcagaggagcacgccgcggtcgggcgtcgccacggcctctcttgtccctgtcgaagtcaccccgctcgacgaggtcggcggcggcgagcacggtgtcccgtcgtggcgtgccccgttgaagtcaccctggtcgacgaggtcggcgcacgcgagcggggaggggcgtcggtggcgggaccacaggggtagagcgaagggggagctggagggaatggcggtggcgaggtggaggaggaggacgccgctccgacgaaactcccatccggggcgagggaggagcggaagacggagatggcgacagcgggagggaagtggggatggaggcggcaaggagggagttggccggccgacgcgttgtcgccgccgccgctgctgttgtccttccggccattgctcttccgcgagcctgtccccaacgagccgcctctccggccgtcctcccccgttccagcgccgtggcaagcgacgagaagccggcggcgcggcacccccgccgcggacgagcgacaagaagccggcggcgcggcgcccccacccgaagccgccgacgacaatgagaccgagcggcgcggagtcgtcggcgccgccgctccccatccgcagccgcgctcgcctgctgctgccgctgcctctccgccaccgcgctcgcccaactcccttgccgccgtcggcctgctcccgctcgtcgctgtccactcctcaaccgtgtctccgctgcttccctagccaccgccgctgcgggctcgccttcgccgccctcgcttgcccgccgtcacgcgttgctgtacctcacgcggctgtcgccgtgctccgggagtcccgccatggcctcccgcagcaccacgctccctcctcgccgcgccgcccttcctttgcctcgccgccgttgtcgggagatgacggcctggccctactcttctctgctcctctaattggtcccaaaccggcgccggcagcgcgtcgtatgccgccgccgccacccggagtcccgcgccttggcgtcctcgccgccaccgctcgggcctctctagcggcctgaccccgaggtcgcacgcgcggtgagccggtgacgctctcccttctcccgtatcgtcaacgatgccgccgccgccgccgcatcgccggcccgccggatgtcctctcccacctcgccccgacgagctccccacccgccgagcatcctgcagaggggaaagagagagagagagagagagagagagagaaatagagagagaagaggaagggggagaagggggaagggagaggtgctgactgtacaccctgacatgtgagacccacgtgggtcccacgctgactcagccgccacatcggacgaaactgggatcaaaaccaccgaaggacataaagtgaacgattttgtaagttgagggatgtcttatatctagttttggggttggaggatgattttgtaattcgatgacaagttgagggaccttcggtgtactttttcctctatggcatgaataccaaccagtagatcgttggcgcctcattcccttcctcctgggccgcaacgggattaatggctagcttgaggcccatattattgttgggccgtaacgggaatgctagatacgtgcggcccgtcttctctggtagtcgtcgacaagacaagccaaggggagcggaggcgacgacgtccgaccatcaccgacctctcctcctcttccgccgcgcgcttccttgccaccgcatctaggccggccatcggcggaggagagggaggccagcacgcggtggagcagcgagaggttattgcctgaggcgcttcgcggaccttctacaatggtggtaagagctccctccctcctcttctctcctctcctctcctctccttcctccatccatgacatcagtttggccacacccaatggttcccgctgccgcgtgcaggcgatgcgcttctgctgctgctgttgttcgtgtattgctccatctgtgcacgatttgttcgtgcatagggtttccgactggaattgggttggaggggcttctggtttaccctttattcaatcgcacaaggatgatctgcattctgatcctaaaattatctcttactgtgatggctgatgtcgtgcttgtgaatttgattcatgatatcgcgtggatatattgcgaaccgcatgcggagaagcataatattttttcccttgtgatttgatgaggctatgtgatattggggtggcactggcagtatgccttacacaagatgctacattaaacccgattcaatctttcgctatttttttcctttcctctgaaattgccttatttccactggtagtcgagatatttggggtgaggtgcttaacttatgttacaggactaggctagcgacagcgatgaggatagcgagttcgagtgggatactgatggtgagtctgaggccacgtttgctccagccttttcgaacacggatgcgcctggtccgtccacgagacccaggctgcaagttggagatataagtctagttgaacacacacgagctggtcatttgttttaaccatgatattaccttactataattataatcataatatggtgtttgtctaaaggatgctaatgggaaggccaatggatcagcaccatcagctttggttgcttactttttgggaatgggtttctcgagagagatggtcttcagagctatcaaggagattggtaatgataacaataatacatttcctcatttgcttaggttgcattttgcatcttttgtttcaactgttgccgtttctttcaggggacacagattcggagcaaattcttgagttacttctcacttatcaggtatttgctcacgtggttgcatcactttgtttattatctaatgctctattgtacaagtcatgttacgtaacactgtaatgcaggcgataggcagtgacccttcagtgggtaacagctctcattctgcctgtgacccccagattcttgaagaagaagatgaggaggaggatgttaattgggacgaggatgatactgttgacaattttgatagggctacttactctgatggttctggtgatgaggtattcacatgactccctccttggtcattatatatttatatcagacatgatcgaacctttgttacacttgtttcatgccaagcacacattcccttttagtgcttgtctaaattatctattggtcttggtccaataaattggaaggttttgtgacttaagttatgcttcacttttatttagtaaacaagtgtacatgcttacctgtactgcaatgctgtagttttttgggttatctataaaacaatacctgttcctatagggttgttaaaggatctttgttgatcctgctcttgcttctatgtttctttagctggcatttttgtatggtgcctttatagtgagagagatagcagaactactacagaaccatcaaagagatgatcatatacttctacaaggtcgtattcaaaccaagcaatgatgaaagatagtctactgaatgcctataattgaatggttgcaagttaagaccaccagacagaacaatgataaccactggctacatctgaaaacataatagacaacaaaaaatggaactgaaatgatgcctatgagagcttaggtaatctgtgctgggcatttatccatgtgttgatgattgataagctgtactccccctcctttttgtggtctaacatgctttattgtttcaccattttttaaatagttttactactttttcattacatctttagtatgagtttcctctaactttaatcctcaaaataagttcctctatagtatggtagtatctgtttgcatggagttgtaagacgcaacaacaaatttgacacagaaggataatcgtatattttgttgcagtaaatttgggtgtacatgcatatatgtgatgcctgcattagttgctttgttgggaggctatttcagactgcaattcatgagtgagatgtagcaaatgttttcagtctgcttgtaatgtgctttgttgcaggactttttacaagagatgtccgagaaagatgagaaaatcaagtccttagtcagcatgggttttcctgaagatgaagtaatgagggctattattagatgcggtatacctctattgaagttgctgctttgacagtaaggagccttatactgcctatgctgggttaaaatttggcaggtctggatgcgtctgtagatttgttggttgagtcaatctatgcaccagcgactgcaggaaatgtttgttttacaaacttatctgactatgaagtatgggtaccttgtgattatagagcatctgaatggtgaaattgttttcatttctttaatgtaatgccactggcataatgtttatttttgtgcaggatacagagtttagttcctttggaggaagaaagaaaacaaaattaatagatggaagcaagaaaaaaagagaacggtatagaagtagaccacaatggaatcaagtgccatttgacggcagccatgaagagccaatgcctcttccaaattcaatggtgggattcagcttgcccaatgacgggttaaggtcagtccacagaaaccttcctgaccaggctcttnnnnnnnnnnnnnnnnnnnnnnnnnnnnnnnnnnnnnnnnnnnnnnnnnnnnnnnn

SEQ ID NO: 30764 - DNA, 6107 bp, Oryza sativa
gaaatgtttgttttacaaacttatctgactatgaagtatgggtaccttgtgattatagagcatctgaatggtgaaattgttttcatttctttaatgtaatgccactggcataatgtttatttttgtgcaggatacagagtttagttcctttggaggaagaaagaaaacaaaattaatagatggaagcaagaaaaaaagagaacggtatagaagtagaccacaatggaatcaagtgccatttgacggcagccatgaagagccaatgccccttccaaattcaatggtgggattcagcttgcccaatgacgggttaaggtcagtccacagaaaccttcctgaccaggctcttggaccaccattcttttactatgaaaacgtggccctagctccaaaaggtgtatggacgaccatctcaagattcttgtatgacatttatcctgagttcgtatattccaaatacttctgtgctgctgctaggaagaggggttacatccataacttgccgattaagaacaggtcacctgttcttcccattcccccaaagacaatatctgaagcctttccttctactaagatgtggtggcccttttgggatccaagaaggcagttcaactgcttgcaaacttgtgtggcaagcgcaaagcatacagaacggatacgatgtgctcttggtagattcggcgatgcactacctccagcagttcagaagagtgtcttggaagaatgtaggaagtggaaccttgtctaggttggaaagaacaaggttgctactctagagcctgatgagatggaattcctattgggataccctaggatgttggataagtctttgtggtccttggtcgtgattcttctttttgcttttgggtagtttcaccttttcaggacagcatctaccctttagcatatttttcagttgctaggacagctacggttagtaggacagcagcagttagcatctcctttatgcctcctttatgctttattcagtttggatgccctctaggacagcatcccattcaaatttcgaattttagactaggagggtgcagcaataggctagtagccagctatggctatatatatgtatccaacctctctcgggtaggtatggcttttgtgttttgtgaatgaagaaaaccagaaaattgccccatctcgagtgccatcctcttctcaatgagagtaaccattgaaattctaacataggaattataccaggggagttagcaggacagcgagatatagagctcttgggaattcattccaagttgatacagttgcctaccacctctctgtgctgagggacatattccctaatggcatgaacgtcttgtccttgttttctggtattggtggagcagaagtagctctccacaggcttggaatctgtatgaagacagtggtcttagtcgaaatatcagaggtaaacatgacgttgctgaggagttggtgggaccagacccaaactggcacgctgattgaaatcgcagatgttcaaaatcttactgctgaaagaattgaactattcatcagaagatttggtggctttgacctggtgatcgggggcagcccgtgcaacaacctcgctggtagcaacagataccaccgtgatggcttggagggcaagcactcagcactattctatcactactacagaatcttggattctgtaaagactattatggctagcatgtaagctagcccattaacgaactctgtgaattattgttgctaatgaaattggaacctgatggttgaccttctttcacaaggtttctcttgccatggctcaatacgttctactaatttaccccaagtgcaaaatgctccttccattttgataatgcttgcagttttggtgcgaaaggtatgaaaattacatctgacaacatgtctctcatttttgtactactattatgtatacaaactgaagattgccatggaggaataggctaatgctattaaggggctttgtttgattactacaagctgaattatgaacatgatttgagcaccatacgctagattcatctctgcttttgctgaagttgaaattctgcaacctgaattgtacctgcatttctataataacctttatttattttgactgtgcctgaatgtctatagcttgcacctccaatgcaagtacatttccctttttcctgttgatatgcacaattcacttgatatatctttactataacaaaatcttgaatctttgaaggaaagttgtttcgccatgttcgcaaggcccttctgttgaaacaatcctcctccttgacactgaaaactgaacaagatccttccaataacagtgataaggattccatggacaaataagactgcacctcattcagtgatacaagcgatgagtgtagaaaatctaatacgttgtattttggtattttctgttatattggatcgaccctctcatggggtatatataggagtacataggggataaagacttggagtacaatacaaataagagtagatttatctctaggattctatctctaggactctatcttatctctaggattctatctctaggatatatcttatctctataatttgtatttgactcttatctctaactaccatattatacttctaacattccccctcagtcgtaacgggagcgaagtgaacgattgcgactggatttgaaatcttctatttcttcatctttctttgactcaccatcatcgactgcatctctgatggacggtcctccacctggtgcctgcgtccccttctgtgtcgtcccttgactctcctttattccctcccgcagtcatagcgggagtgtcatggacgatagcgatgacacggacgcttggactggagtttccgtcaatgatttttgttgtagacgttcgtcgatgtagccgatcatgaagtagctgtggttgtcggtgtagccgcatatagccgaaggcgaaaaaaaaatatttacgccatggtgtgaagacaaaaactgtaattgttagcatcttgcaccttgtagatgtcagaggatgccattggggacgtcttgcatatgtcagaggacgtcgttggcgatgaggccaccactttggttggtccttctgcgccgtatagcggtcatcacaatagtgatgccgggttgatgcagtcgttgtagtcgtacatgacgtgatcgatgccgttgtcggtgacgcggtcgttgccgtcgtagaggacacggtcgatgtcgtcgatgaagcgtcttgcagattaatctgtcagaggatgcgaggtgtccatctatgtagacgagtcggcagcggcaagttgatgaaatgatgtagaatcggcgaagacgatcgtcctggagagctcggcgacttgacttggactccgcgaagacgtcgcagatgatcggccggtgtcttgatgcaggtgtgcagcacaggcgtgtgcacatgttggcgacgaacagcatcaggcccttgcttcttgtgaagtaggcgatgcagatcgatccatggatgaggccggatggtatgatgcttgttgacgttgtctgctcctgtaacacctgccgcattgctcctgacgatcatatggttttctgtggctagctaatagatctaaaactaattattagaaaacgcatctaatgatatgcggtaaactaatctgtaaatgattggagaggctagctagctaatgcggtgcggtgccccagggagaaattgatctcatctccctggggcagcgcggatggaacctagctggaaccgaggatcgatcgacgtttgtctacggctctgataccatgtagaaaatctaatacgttgtattttggtattttctgatatattggatcgaccctctcatggggtatatataggagtacataggggatagagacttggagtacaatacaaataagagtagatttatctctaggattctatctctaggactctatcttatctctaggattctatctctaggatatatcttatctctataatttgtatttgactcttatctctaactaccatattatacttctaacaatgagaagcaattgttatccacctgaaagaacatgtatgtcaagacatttgaggatgtggacgaggagctgaggcaacattcttgaattggttgcatttgtagtggcacaaccgctgtcactgtcgttacacatgtattagtactacgattacagaatctttcaactatttttgcaccggcaagagtcttgtccatatagtagaactacaccatctctacctaaaactaagattctgaaatcatagcatgcaagacattgaacattgaacttgccaaattttgtgcgtatgtcatatatagttatagtttgtagggataaatacaaaactctcgaacccttgaattgccctgttttcccattgctatgcttttgcgtaaggtgatcacctgatgattgcaaatttgggtgatccgtgtgctgttctatgcccaattgcagtccaactcaccactgactggaaaccaaatactattccaggtgagcctctgaattttagagatgtaacgggattgtggcgtactgatatagttgggccgaatggaattgtcacgtacatgcgggcccttattagttgggccggaatgaacatgcggccgacgattattgcccgatggaatacatgtggcccatctatccatcctagttggcgtgcacacgatgatggttgactgctgggcccagttgttgacttccacctttgcttggttagctcgtcctttcctcttcttccaagttccaaccaacaatggcggtcctcagttgcatcgcatatttgcatgcaacgtcgatctctctatttgcattgccctctcatccgcacaactaaaaacagccatcctcttctctctgcaccttccacaccacacacctcctccatcatatcgatcatggcttccctccctcatgcacgctgacgctgcaatgctcctcctctgcggcggctagatcattcattccaacaattaaattaacaataattgaattgaaggacattaattagtttgatcgatggcgggtgcaaacgcgtcgacggtgaagccggtggtggcggcgtgctacgacaacaacctggtgaactcgcaggggatgttcctgggcgacgagccgctgcgcttcgccctcccgctcctcctggtgcaggtctccatcatcctcatcctctccgccgccgcccaccacgtcctccgccgcctcggccagtgccgcttcgtgacccacatgctcgtcggcatcttcctcggcccctccgtcctcggccgcaacccccacctccgcaccgccctcttctccgagcgcggcacctacatcctcgagagcgtctccctcgtcgccctcatcctcttcctcttctccatggccgtcaagaccgacctcaccctcctccgccgccccaccgcccgagccctcgccgtcggcctcgccggctccctcgtccccctcgccgtcaccctccccgtcttccacgccctcagcccctccctccccgccgacctccgcggctcctccctcatcaccgagctcgccgtccgcctctccctctcctccttccccgtcgtcgccgacgccctcgccgagctcgacctcctcaactccgagctcggccgcgtcgccctcaacgcctccctcatcaccgacgtcacctcctggtcctccgcgcctgcttcgccgccgccttcctcatcacccaggctaagtccccgctcttcaccgccaaggtcctcgcctccttcgccgccttcgtcctcttcgtcttcttcgtcgcccgccccgccggccgctacatcgcccgcaagcgcaccccgcccggggacctcctctccgagggctccttcgtcctcgtcgtcatcgccgcgctgctctccgcgctcgtcaccgacgtcatcggcttcaagtttatgatcggccccatgatgctgggcctcgcgctccccggcggcatgcccatcggcgccaccctcacggagcgcctcgactccttcttcatcgcgctcttcctcccggtctacatggcgctcgccggctaccgcaccgacctggcggagctgagcctgataggcgtcagcgcggagca

SEQ ID NO: 30765 - DNA, 16406 bp, Oryza sativa
aggcgtcggggtcgtcgcgcgacgcccccgtgtcgctgatcgtgctccacctgacggagctggtggggcacgcggcgtccgtgctgaagccgcacaggaagtcccggagcagctgcggcaacccgacgccgtcggaccgcatcgtgaacgcgttccgctacttcgagcagcaggcgccgctgggggcggtgacggtgagcccgtacgtggtggcgtcgccgtacagcagcatgcagcacgacgtgtgcctcctggcgcacagccgcaaggccaacctcatcctgctccccttccacaagtcctcggacggcgcccggagcaccgccaacaacgccatccgcggcatcaaccggtcggtgatgcagtacgcgccgtgctcggtgggcatcctgatcgaccacggggtggcggcggggtcggcgtgcgccacggcgtccaacagcacgctgcagcgggtggcgctctacttcctgggcggcgccgacgaccgggaggcgctggcgtacgtggcgcggatggcggagtgcggtttggtggcggtgacggtggtgcggctgaagctgcgggactgggtggggatggggggccgcgacgagatgagggacgaggaggcgctgcaggagttctggcagaggtacagctgcgcgggcgcggagagggtggcgtacgtggagaagacggtggaggacggggaggggacggcgtcggtggtgcgcgccatgagcgacaagttcgacctgctggtggttggtaggagagagggcggcggcgacggcgcggaggggtcgtcggcggcggcgctgacgagcgggctgtcggagtggagcgagttcccggagctgggagtgctgggcgacatgcttgcctccgccgacttcgcggccaaggtctctatcctcgtcgtccagcagcaggccgccaccaggaacgacgccgattactgacttaattggctagtcatgctgatatactaccacattccctctgctcttctcttctctgctctgctgcaatattagtgttcttctccaagtaatcttgtgttttaggatttttggcgagcttctgtattttactgtacctaggattgcataatcttgctttgattctggacacagtctagatttctatcgctaggaatatgtacaagtatgcatatgatattgacatatatcatgttcgtgtagagtcaagtgtttctgaactgaacatctcattttggagttcagactgttatctcaacaatcaaaaaagaaagagcaattttatagtctttgagtaggtactatgaggtaccactttttctattgtaaatttggtacctcttggtatctaagtactacgaggtacttaaaaaattagtgtaaaatttagtatctcataatacctcctcaagaactgtaaaattgctcaaaaagaaatccttcttttgtaatggactagtgtggcagtgtttggtactctctacaatatggagtattattgtgctggactgctggcgcaaaaaaaaaatgtcggtaatgcactaaacatctctaacctgactaatcccccaagtcgtaatcctgatcaagtacatgacgtaggtgctacaaacacaaatgacgatggcatttggagccatcgacaacttgcgcctttaatcacgggggaaaggagaacatcaagtacagtgccgacctactagtacagagagtggctatttcaactgaagctcatgctcatcggccggagctgaaggacaatggtgaaggtgtatggatattttttttactgaaatttggaaataccaataactgttatagatactggagtagtatattctgatatgtcaatattactgcgtatgattgattgtctttcttttttttttttttgactacatgagaacaccaacacggtaattattgagtccatcaggcaaaccatcatagatggtcaatgttgtatattatggataagctatctgaatcaaagcctagagagtgtagtgtactagtgtagtctcctcctttccttcccacttgtagcaggctggtgggacccacaagtcacctcctttctctttgcttttcttcactccgaaatttccccgagtccgagtagagtagagttcccaagctcctctgtcacagactcaagtaggcaagtcaagcagcagccataggccatagctgcaggcctgcaactcccggggaagagtggagtgctgatacgatagaggtagagcaagaagaaagcatccatggggaacatcctccggtgcttcaagggagacgacgatggcggtgatcactatccctactacaagccaacctccaggccacactaccagcctcctcactaccatggtcaacctgcagcccccccagctccactccagcagcagcatctcggcccccatggcgtcacgccgtccaccgtcggcgtcgccgccctggcgcacgatctcctcaacttcgaatccacatccatggtaacttctacacatgctcctagctacatgcccttactcccgctttcctctttcattcagcttgcaactgtactaactagaagaggttactgtaggtctgacattaatctatcagcaattcagcatgcatttacatcctaattagaggttatccaattacaatacaaggtttctttggttggttctatgacaaaaggttgggtttggactttggagtaggtgttaattgcatcacatatgtaacttttctcagctttgaacccctctgcaattgaaaccaatctcttgttaccgaagccaatacttacaatattcctttttattggatttatcttgttatatgtgattcattcagtcatttttgtaaggggtttagtgtattgtaaaccaacctgattataagcacactttcgtctttttttcccctctgtttcttttggaatactgatgaatatcttttatctggactgaaaaaatatgctgcattgcgatactaccatttctgttagcacttgcaaatatgttcatattctaatggcgcatcatgccaagttcaattacttctttattcccagtttacatgtataaaataagtattatttgtccatattatcaggttcctgatggcctcagtcagcacgttgtatcatccaggaaagcacaagttaaatggtaaggatcagctctaaaagtctttgtagagttgattttttttttttttagattttgtacgtttggtgtacctactgatatcaaaattgctttgctttgtaggttaattttttaaataaataaatgattggttactgttgtactagcttaagttgggcttttttctaaatgattttatgactgtgcggttaaatgattttgatttgctatcctaggataggatgttccatacttggttcatatgtagacaaatccttatttgagaaggtgaaaaatataaaaaagaacgacattgaaacatacaagattctgttcatttctagtaatggaaatgggggtgtcatgcccttgataaaaaaaaatattgaaacatacaagcaaaagttgatgcaccactagtatggtctatttgtccaggctacttcaggtgttgataaactaaaaccttctcttttttttagggaagggtattttttacatggcctctacattcaaccggatatatgcagccatttaaattgggaagttatccccacaaacaatctaatttgaaattcactcatatgaagatttaaactcaggaccttggggtgctactcaggtcactgcaaccactaggctacatgcctttagcaaactaaaaccttctggcaatggttaaaacagagagtaggataagagtacgcaacggttggagtttgggactaaaaaaaaaatcttaccaaacgaaatgtatagttacatattcacatggaagttgaaattgattaagataaattgtgttcttggctacatttctggtacattctccagaagactcaggctaaattcgaaatcagccatgttgacgtacaagcttcggtcttgaattcttttacatattttagtaggatagaatttcaagtagcgtaaaggtatgtttaatatggttcttgttccaatggtatgttatactgtcagtaacgaaccagtttgtcacaaagcaaatgtatttggcaaatcttgcaactagcagctagtatatatgatattaatacaacttccactgaacaaacttcaaaggaatgtttgatctgatatcttagttggaataataataggtaccagaaactgttggaggcgtataagaatacaacacctccaccaaaaacaccagcaaatgctgctcagctaattgcaagagcccttaatatgatccagagagctgatttggaggtaactttgtttttcctattttgaaatactgaatagttcaacccgagtgaccacagaacaattcatgatcaaggatcgttttttacaaactgaaattatcaatcaaagcaattcactgcaatttgtgttatttctattgcttaaattggctatagatactctactcacctcgtctagaaactatgtttcctctcagggtattcttgaattttacaaccttccgatcccatcactccccacagcatcgtcaaactaccaaccatccttgctaccagagggcgtgcagtttgtgctaaacactttgccggtacggtgtgatcaactattacaactattctgaataactagaaaggaagcccgcgcttatgcgcgggcatctaatttaatgttgcttgaaatattactctatacatgtgaatataatatttgtatatgcgtgactgttcctgattctattctcaacctgtttttttgtcaatattttgtttgtgactattttaaatgctaattatccttgcaacacaaaaattctaaactaaaattacttacaaccatgaaatcttgaattatatgaaagtattatgttgcaacaatggagttggcccctataaactgtcatctaaactatatgctctttttaatacatatcaaatcttcgttttgggttctaaactttatgaaattcattttcttaagaatagttattgaacttcatgcaaaaaagttcaaatgttttgtgcaatttatatcgggctttggattcaacaaaatttgtttaaatttagcccaaatttcgtttgaattccagttgtcctttctatttcttttggaatattagaggcccatgttctatcaatcgttctcgaaatgattttgatctcttaaaattgggatgtaaacagaactatgttgagtgtacaactcgctatgggataaatgcgtcctttctaaaatcttgcctccaaaattgagccaaaaatattataacagtagacatagtgtgttttacttcctccgagatcaatatgtatatgagacatcaatgtgagtatgaattcagggacatgtaaaaatttgatttgaactataaaaaaaaacaggggaaagaaggcgcatatgtacttattgtagccatgcatggagaatattttagtattttatttgttagatagatctaactgtctagaaccatcagtttattagaaattttgtgaaaagagcattaaatatctttaaactactgaatctaactaaaaaaacagggcaaaaagggaatgtgataaggaaacggctacggttcctggttttgtcccaatctttcaaaatgctttgtatgtctgcagcgataatatatatactgtaatctccattttaataactcaagagcagcagcagtattaagatgatagagatctcgtccagcaaagtatatagggtcagacacataagatcgataactccagataaactaagctgaatagctccattagatcaaatttaaacagatagatgattaggtttacaatgaataaactaaccaaatctgtagataaactccacccgtgcagcaagaatgacacacaatcagagcaagaagacttcggcagaaatcagaacacgcccaggaaattaattcccgatcatgctcgtccaaaccaacgcagcaacaatggtggcaaaacgtcaggcagatggaatcaccatctccttcctgacctaggcggcggcggcggcacaatacaaaggaaaactaaaagccaatctcctaatacaaggaacatggcatatataggtggcacaaaggcctagccagctgaacggactaaagcccaacatgggctcctacacaccgatccaaataacagagaaaaacctcattaatgtaataccatgattacttggtaatcctgccgctaagcatggaaggaaagcagccacatgcatgcatacatgcggaggttgtgggagatgattttgtttttttctgtgggtcctcatcttctctcctcgcatcacgtggcagcttgagagcgtttttaggatgccacatggcagcttgaaagtgattttagaaagtttaatggacttttagtatataatagatagatagatagatagataggtttatcaccaagaatccgacatcacacattgaacaatgatttacagaattattgacaaatgctaactctcacatatcactgatattataggtttatgacaagtgcattggagatggtgatggatttactgcatatgttcccacaacggatccgagggaatctgcaaatgtgccattggaagtgcatgagttggtgatagcaagaactcaagcacgcaaatgtagggattaccagagtgctgatgctcttctaagcagccttgatgaagctggatacaagtatggaaactgatctgttttgatccttatcagttaatagcacaagattgcatatctgaatgacgaatcttctaattttccatacaagagttatggtcctaattttctgaatattgtcttttcatggaacaatgcaggatgcctaatatagtaggcacaggaaaataacagagcttaaaaattaaattgattttcttctaataattacagttaacacacaatccttgatatgtatatagatgctcttattgtccccacacagttgacacatgcatttatgcattttcggaacaaaacagtgaagatttttatagcagctattcatgattaaatgtggacaataattacatcagttcgatttggtttaatcacatatatgtgctagctttgcttggagatcacaggaaaacatggcttactatgaattttgatgagcaggataatatcttgttcagatgacgaggtcctcgcaaggaaatacagaataagaatgaggtaggtatctacgttgcacctctagatcgaataaaaatttgatgtactactgggaggggtgaagcgcatgatcttttataatttctatattaaaggggaattgatgcaccggagcttaagatgccctacgggaaggaatcacggactgcgttggtgaaactaattggtgggaagagcgtcaaaatttatgtatatgatctggaccagtttgggcgctacgttggtgatatctattgcaataatttgttcattcaggtgaaacataacctatttcatcagtacctcacatgtatcatgattttactgcttcaattcttatgagagaaattatgtgctctctttgagtccttcaggagcaaatgttgaagaatggccacgcatggcacttcaagacttatgataaacgcccagagtttgcaagagtaagagattcaactatattgtgtgttgttacttgttttgctctgacaccttttttttttacataaactttgtcgagtcatgcttacatatgttgttacttctgggtaataaagagttgttcacttactccctgattatgtagtgggagagagaggcaagagctgcaaaccgagggctttgggcgtcagggaatcctgagaaaccatgggattggagaagagaccaacgcaacgcaagacaggacgccatccaggtgtactgaagttgagtctccagctctcatttggccacaaatgtgcatatatgtctagttgggtaacgttgctgttgagtagcttgctgacaatgaatgtgtcaggaaccaaaagccaaaatgtatgtatggtttgtgttgtacaaaagagattatatatccaggaccaggagtcagctgtgccgtgtgaagtaacctgagaatgtagaggtgaaatgtggtcaatgcaagtgagctttgttcagaaacaagatcaacaaggccgattctccgctgcaaagcaaagttgagaagtaagctgtatatgcaatattgagctagctagctagctacggttgttatttgaagccaaaaccgtaacttattcagacagccccgctcgatcgtcagataaaaggccaggaccaaagaaacaagattgaaagccgaaggagggattcgatcaatggagggcggcttgtcgatcaattgagtgtgttgccattgccaagccgtgccagcttaacaggaggtttgtgattgccattgtcaagcgtggcatcttcatcttggtgctagacttgaaggttaagcggagtgacgcctcagaagcggaggagccagtccgtatgctccgtggcttgaaggcaaaatcacatgggcaggtcatccaaaacataggtatatttgattgcactaccgttatggtcagtgtgcatttggtcaaatctgccgggggccatgttagactagccacaaagattcttttttctttgttaattagcttcttatatatatagcctatgcaactttatttaattgctacttgtttagagatagtaacatatttccagagaaagctttcacaataattaccactgttgagaagtcgaaaacatatatatagcagtagaacaaagagaatgaatgaaaataagtacaacatccaaaagaagcatcagaaggatcagacaattactggtgcagattgtctgacggggaagaaatagcttattctacatgtgtgtgtcttggttggaagtgaaccaatcacttgaagagatatatatatatatatattcctttctgtttaaataattgcacaaatcatgaagcacttgaagggatatttaactgcaactgcaatccatcctttatttgtgctttaaaagttgtgcatttcacaagaagtgaagcatagaagcgcctccaaacacaatatcatctggtttatactcttccatcatcatctgctttatactcttctatccaccaatcacagctctcaacaaattgttgtctactttctagttctacggttctaccaatagtcattgcaggagcaagaaccatctctaaaacaatgaaatcgattgttatctcggacaatgatctcccgatgagttatcctcgatacgagtttaattgcagtgtgacagtcactgcaaactctgaggttcttggtgaccctaatggtctcccctggtccagtgatgagaaggttaaatgcaattgctagtttctcactatgatgcactagtgtgtgctccttctcttcatcttcaacatcaaacatcaccacttctgttgttggttcataacccatggttttcatttccaatcctaattcgtcgagctttttgtaaatctgatctgaaagaggatgcgacttgtctccgacacggaattcatggaccttaccttcaaactcaacccagctgcatgcaggaaccttctcgaccccttttgctttcatgtccaatctaagcttcgctgcatcctcccatctgcctctgttagagtatatgttggagagcattacatagttcccagaattccagggctccagtagaatgagctgcttcaaaacatgttcagcaagctccgtgtttcggtgaatcttgcagccaccaagaagtgcacccaatataacagcatttgctggcattggcatgtcatcaacaagttgatgagcctcctgcaacaacccagcgcgactgagcagatcgaccatacaaccgtaatgctcaatcctagggctgatgtggtataacttagtcatgttatggaaataccgtcgcccatcttgaatgaggccagtgtgtgtacagctgcagagcaagccaatgaaagtattgtcattcaatttcacgccagacttctccatctgaccaacaagggcaaatgcaatcttttcatggccagtcatgccaagccccaagatcatggcattccaaacaataatgtccttcttcctcatttgctggaacaccacccatgcctcgaccgtgctcccacacttggcgtacatatcaatcaatgcagtccctaggactggattgtcaagaaactcatcccagtccaccatcctgattgcctgccgtcccagatccaatgcacccaaccttgtgcaggctgatagcgccccagctactgcatagcaatctggcttcattccctctgcctgcattgcaaggaaaaggtccagagcctctcgtgggtggccgttggaagcatatcccccaaccatggcgccccaggccactgcatccttgtgccgcatcttgtcaaacacctcccttgcctttgccatctccccacacttgacatacaaatctaccgccgcagtggccacgaacacgctctgtgcaacgccctcctgctcggcagccctccaaacagtctccccagttgccaaatccgcaatccgagcacacgcagtcaggacacgcacggccgtgaagctgtccggtcgcataccattcgcaaaagcattccttgcgacatggacggcttccctgaggtccccagcatccatgtaggcagtgatgagagcggtccaggggacggtgctggggtgtggcatttcgtcgaacaccctctgggctcgatgtaggaggccgcattttgcgtataggctgaggagggaggtgagcacgtgggggttggtgtgggagggaagcttgagggagcgcgcgtggagctgctcgcccgcgcggagagggtgcggaaggcgggaggccgacttgagggcgatggggatggtgaggtgggaggggttggggaggaggcagtggacgcggagcgcgtggaggtgaaggccggaggaggtgagggcgcggaggaggagcgaggagaggccagcgaggaggtcgaggcggaggaggcgggcgtggaggagcttgacggtgagcggcgggaggcggttgctaggggcgacgccggcgaggagtagccgcctgatggcatcgccagacataaataagggggtgtttggatatagggtgtaaaaaaaaattttcttgtttcatcgcctattatatagagtgtcgtagcattgataaaaaaactaattataaaatctgtcagtaaaccgcacgatgatttattaagcataattaatctgttattagcgaatgcttactatagcactccattgtcaaatcatgtaataattaggtttaaaagattcatcctgtaaattagttgcaatttgtgcaattagttgtttttaacctatatttaatcatttatgcagttgttcaaacgtttgatatgacagggtgaaaatttctaaaatggtatataaaccgggtctaaataaagcgccaaagccaagcagtcaacgaatgaacaaatttagtcaaatattggaatatctcttcaaataatgaagaaaaaaaaagagcagatcggaatttttacatgttgcctattttgatcttggaacgaaatttcattgacccatgtctaacacgacatagtccttctcttcgactctcatcggtagcggcggcgcatcaacggcgacgatgcagccttctctctccaaaggcgccattgccgcctcctcctcctcctcctcctcgccacctttggcgtacagcacgtcctcctccacgtcgtacaggttggccgtcctcacctcctgcgccagcgcgcacggcgcgcagcacagccacttgccgtagtccgccgccgtggcccgcccgccgcacatggaccagcggtgcgctggcagcccgaagcgcctccgcatctgcgcgcgccagaacccgccgtacgtgaggcccagcacggacagcaaggcgcccgcggcgcccacgacgaaccgcagcgtgtcgtcgtggacgttgagcgccgccaccgcgaacaccagcaccggcgccgcgcacagcagcgcgaacgtgaagacgtgcacgtacatgttgccgagccccaggcgctccatgttccacccgaacacgcagaacgtgcacgacagcgacagcgccgccaccgtcgggtcgtcgccgacgtcgaacagcccgccggcccactccggcttcgcgaccaccgccctgtttctgttgctgtcacactgcgccgtcaccgcgatcgcgttcgcctcgtcgacctgcgagttcaagttctcctcgtcgtcggtggacgccgggatcagcacgatcttccggccgagcgggccgtacaccatgtacaaggcggcgacgatggggaagccgaggccgagcgccatgcagaggttgacggccaagtccgggcggttgtctctttcgaagaaccagaagagcgcgcagtagccgtactgcgcgaagcacgtggcgtggaacagcagcacgacggcggccacgtggaggcgctcgcggcgcaggccggcggcgccgttcttgcagtagagggcacggagctcggcgacgtcagcggcgcgccatcggaggagtaacgcgaggtggtggcagagcttgggatgctggtagacgcacatgatggtgaagagcgcgttgagcatctggttggccacctcggtccatcggcggcggcgcgaggcggcgggcacggcggagttgagcgcgccggtcatgagaaggaagacgaaaggcgacgccgccggcgacgaaggcgagccagatgagcagagccgcgttcattgggtgcttggcccacgcgaggcacttggcgcggagggcgcgccagtcgacggagcggacgaaacgccgcaagcggcgggaagcagcagtattgtttgtggtgcggagggaggcaagccgggtgaagaagccggcccccgaaaaggagaaccatggcgccttggacggcgctgcccggaggaagtcgaggagcctctccttcttcttctccttgtgcttcttgggctgctcctgcttctgcagcccatcgttcactggttcttgatgctgttcttgtgggtccatgttgatcgatttgtagttttttcttgtggagtgaaggagttgcaaaaaatctggtagtagtagctagctgcagcagatcgagtacgtagcaggagcaagctcgaaatcaaaaccatggaactgatcaacaaatatatatgcatgcaatgcaaatagttgacgaaagaaaggcaacattgtcaaatttggcagagcgagcaggtcagcgtcagccacagtttgctgctagttcaattactgcgctcgtgttgtttaattattactgcttcgtgttgtttaattaccagccggattggattgaccgagctggatcggtcaaaacagttaagcgtgactgtatattactccccgtcctaaaataaagcacggttttacactatttatattcaatatttaactgctcgtcttaaaaaattgtgattagtatttttgttattatcatatgataagatatgaacattattttatgtgtgactattttttaaaaaagaaaattataaatttttaaaataaaacgaatatcaaacgttggacacgaatattcaaggctgcacttattttggggtggagttggtagtagtagctctatgtaacaaaacgactacatagtacagactactagaacatataggctgtggtcttatcccatctttcccaacccacttcccgcgttttctacgcacacgtttttcaaactgctaaacggtgcatattttacaaaaagttttttatatgaaaattacttaaaaaatcatattaatctatttttaagttttttttggctaatacttaattaatctcactataatcgtgtgttttgtttttcgtgtcgggaggcatggttgggcgaacacacccatagtacatactgtatcttctaaaatgactagtattactccagaagacttccaagaatatgtatgggcgtccattgtcttctatacacgctcactcatgttcaggaatcaatgttggcttgccatgactttctattgcttgttttgttggccctataactgaagcacaaccttgatcgggaataagtcatcttttgttgccttaaataagttcagcacaacaaaacagaacagctgaacagatcacctgtcggcgtgctctgttcaacattttcatccctattttgatccgctaagttataggccaaagctggatttcataaacttttacttccactgctctagttctgtaccgctactccctaagattaatgaaattcaggtggggaatctctcccccctttgaccagtctaaaaaaacttttacttcttaaaattggcttgatttatttttgatactgagcttctttttcaggttatggctgcaaagcagccaaaagtctctttcaagttatttttttagacaggtctctttcaagttatttcaagtccatatagtcaggcaggtgtacagtctcaagcatgctgcaattataaatactttcagtttacagatggccaataacgacgtttccctattcacagttggcgctctacaacattagaggaacaattggttcatcatatgatagttgatcatgttatcacacataataacttacgcaacaatggacaaaactgaaacaaaccttctaagatttccaaactacgattgctaacaattgtacaattcagttccttctgaaacttcagaagctatactgaaggttttagaaggattctaagttctaactgaaactacaatatctttgtagaaccaccccaagtgagtttcctgaaacacaagccacactgggcaaactgaaataatgagatataattgcattagagattcactatttccaaggtgcaattgcagctgggaacggattacaaatatacaatcccttcaaaatcctgtggcatctttatgccagcagtatgcctatgtacacccaaactccaaagaatgaacttcctctcgatcacaaccaacaaaaagaaatggagaaagatgagagaattcagtcatctagctaagtagctattgaatctgtagccttttgtatgcattttctgtgcctcactaacgaatgaatcccctggtgtagagaagaatgagcaaagaaaccaaagtgacaacatttatcagtctcttcaccttctccaccgtccagcttccatccgacaaactggccggtatctcatcatcatccacaatcaccaccgattccggaagaggcgaacccatgatcttctcatcatgaactgcactgcattcttcttcagatttatcaccttcaacgacgacttgctccaccacaacctgtacagccggtggaaccatctcctcatgaacaatcaccacatgatcatttgatccctctgatgctgccatgatcatcgtgtccggtggttcatggaattggacatggtgtgacgccagcaacggtagcctcttctcgtcttcaacgtcatcgacaacaggaagcttcttgtagaacgtctcgcaatcgatgtggtagaggctctccgtgcgcacctcctgcgccagcgcacacggccagcagaagagccaccgggcgtagtccgtcaccgacggcgagccgcagcacgccgtgctcgccggaagcccgaagcgttctctcatctggatcctccagtagccgccgtagagcaggccgcacacgcagagcagggccccggcgccgccgaccatgtcgccgatgaccacgtcgtggatgtggagcgccgacacgcccatcacccacagcggcgcgaagcacagaagcacgaacgtggcggtgtgcacgaacatgctgccgaatccgagccgctccatgttccacccgaaggcgcagaaggtgcacgacagggagagccaccacgccgtcgcgtcgccgccgcagtcgaacatgccgccggcccactccggctcgaccacggcgtgtcccgtgcatttgtgttggctcaccgagtcgaaggcgttggggcacgcgagctcgccgtagttgtcttttccgagcgggctgcacacggtgtacacgacggcgacgaccggcgcgacgacgccgagcacgaagaacccattctccacgagctccggccgcgtcttcttggtgtacccccagtacaggccgcagagcacgtactggcaggcgacggtgaggtggagcagcgcgaccacgacggccatgtgggcgcgctcgccgtggcgcgggccggcgccgtccttgaagtaggcggcgcggaggtcggcggcgtcggcggggcgccagcggcagagcaggaagaggtggtggcagaggacggggtgctggta

SEQ ID NO: 30766 - DNA, 1076 bp, Oryza sativa
gcatcggggcgttgccattctctgcggtttgtgcatcgtcgtcacaatcacaagcaagaagcattgcaaaattgcaattcgcaaagcccccttctcgtccacctgcatttcaggagaaaaagaaaacagatgaaatttcaggaaaaatctacaatggacacaagaatctggacatgggaaaagaaaagaggggattttgtcgaaaagcagcaaggaagaaggggaggagagagtttggagagctaagtcttaccagaaaggagacaaggctgcaacttgcaactttctgtttgatccactcttattggatccacaactgaatataatttgtttttcagttgaaaagaggggttcttgtacaagcaagcaaagcaatggctctcccaaaattttggagcttgtagagtttttgcagtccggtgtcatcgtgggttgacttgagacggtcaagtcagttcaggtcagacttgggtggcgctgcttatatgttgcagtaattaggaaggcaacagagacatcttcttccaagttccaagtgaagtggacaagtcctatattaggaagaaaggcgttgagctgcctgccattctggaccctgttgctgcatgtgtgattcatgaggaaaatacagacaaggccttccttttcttctccagccagatgggatatgccaaaaaaaaaacattatatttaatttaagatgtatagtctacaggcattaactggagtagggtggtacttgaatcagtgaagtgactggagctggaggtgctgggagagggacggacaacagttgatggtcccataatctcacggactcattcaacaaaggtaaataggcccatcttgctccctgcaattccgttcccgtgcagttgcgttagtattacagttaccccacacagaaaattaaaagaaacgaaatttctctcaaggaacaactgagagagagagatcacacaaacaacttccttggactcatgagatcgagcagcgacggcggcatgtttccttggactcaccgacgccacctccttcaatcgcattctcctctccacctgctgcattactgcacc

SEQ ID NO: 30767 - DNA, 3133 bp, Oryza sativa
tgcattcgcacatatcaggaacaaagatttgacgtgctggaatgccatgctcgaaggatatgttttgaatggttttgggcatcatgccattcgtacggtgctcctgatgcatcattctgggcttgcacctgaccggtacacctatatttctgctgttaaggcttgttcaatcagtgcgcagtgggatcttgggcgacagcttcactgtcttgtcatccacagcatgctcgagtccaatacctcggtcatgaattcccttgttgatatgtatttcagagccagacagaaggaaactgctgcttctgtctttcgcaagattagacaaaaagacaccgtgtcttggaataccatgatttcaggttttgcgcatgatgaagacgacaaggcagtttttggctgcttgattgacatgtcacgaatcggatgtaaacctaatgaggttactttctctgtcttgttgaggctgagtggtgctaaagagaatgaatcattgggccttcagatcgttgcccttgcctaccgtcatggctatactgacaatgttcttgtagcaaatgcagtaatcaacatgctatccagatgtggattgctcaaccgtgcatatggcttcttctgtagtctcacatccacaaacattgtgacatggaacgagatgattgcaggttatggtctcttcagtcactctgaagaaacaatgaagctcttccgcagtttggtttgctttggagaaagacctgatgagttcacctactcagctgttctgtctgccttccaggaagctcaaggtgcaagggatcatgagcaaatccacgcaactattctgaaacaaggttttgcctcctgtcagttcgtgtccacttcactgatcaaggcaaatgtagcagcgtttgggtcagttcagatttcactaaaaatcatcgaggacgctggcaagatggagctggtgtcatggggagtcgttatctcagcattcctgaagcatggcctgaacgatgaggtcattttccttttcaacttgtttagaggtgactccaccaacaagcctgatgagttcatcctggcaaccgtcctaaatgcctgtgcaaatgctgcattgatcaggcactgcagatgcatccattcgcttgttctcaagacaggtcattccaagcacttctgcgtagctagcgctgttgttgatgcctacgcgaaatgtggtgagattacctctgcagagagcgctttcaccgttgtttcatcaggaaccgacgatgccatcctgtacaacaccatgctgacagcttatgccaaccatggtttgatccacgaagctctcaacctctacgaagagatgacaaaggctaaattgagtccaacaccagccacattcgttgccattctgtcagcctgcagccatttggggctagtcgagcaggggaagcttgtgttcagcaccatgctgtctgcgtatggcatgcatccagcaagagccaactacgcctgcctggttgatctcctggcaagaaaggggctactcgacgaggcgaagggtgtgatcgatgcaatgccgttccaaccatggcctgcagtttggaggtcgctggtgatcggttgccggatacatgggaacaagcaacttggcgtgcttgcggcagagcagatcctgagaatggcgccgagcagcgatggcgcttatatttcgctgtcaaacgtgtatgctgacgatggagagtggcagtctgcagaggagaccaggaggaggatggttcagaatcacgttcagaagttgcaagggtacagcaggattgagatgtagtaggaatgttctatatatattttagattggctaacagtaactactgattgctgaacggaattgctaaaaaaaatgtgaatacttccatgtgtccatgttagatgttggaggaagcatagactgaacgtgaatacttctttcttgtaacaatgtttggaagaaagcaagtaaatcctggaaacatgttggatatactgtagtttgggtatttggtgggcaatgctagtatatccagacaggaagttaatgtattcttagcatccttaacaagaaaatgttgatttccaaataagaaccatccaacaatcagattaccagttcgagaggaaacagggatcagaaacctcgaattcattttttccccttcttttcaaagtagtgctcactaaagcagcaggtaatacatttcattcatatcatcaggcatacacatgcctagctaacaatgacaaatatgaactaactattctcagcccacatacatcttcctattccagctgcctctttttaaactggaaaagccagccattcatgtttcacacctctgcaggtgaacacactaaggctattgcattttgattcaacaaccgcagcttattcttcgccctctgcaggtgaacacactaaagctattgcattttgattcaacaaccacagcttattcttcgctcatattagttgcgggaggatctgaacccattgctgtaatatctccaaattcctttgtctctggagaattacacactgcagagttctttggtgtctccttcatgttcgtagcttccccattaggttccgttcttggtgactcctcctttacgaccctagcgtccacgtcaggttgtggcactgcagtgtcaccagctggctcctgctttacacccctatcttgctcattaagttgagaaattacagtatctctggctggcccaagttctacacttccagcttccttacaagcttgcagcattgcagtatcgatgaatggctcctgctttacacttgaagcttcctctttaggttgcagaattgcagcatcgatggatggttcctgcttaacacttatagcttcctcattaggtggcaccactgaaatatctctggatggctcctgttctactctagcttcatcatcaggttgcaccaatgcagcgtcactgtgttggttctccttatcaggttgtaccatttcaatatctctaggtggctcagcttctactcttttagcttcctcacaaggttgaaggaacagagtgccacaagatgcctcctgtgttattactgttggctgcattaggacgtcagaatcgtgagcatctccagccactctagcttcat

SEQ ID NO: 30768 - DNA, 23083 bp, Oryza sativa
  unsure (1)..(23083): unsure at all n locations
ttttaagtggtttgggggtttcaattggcattttctctacctccttacctacccttttaccaggaactacaatatattttgtcgcaccatttgcagaaccctctgattgacctgcaccaagcaatgcccatgcatgacccaatgttcaccataataacacacaaacaagaacatagcaatgttaattttaacagtgaatagcctggataatataaaaaataaaaataagacccttagagaagaacagaacaataccttgaattgccagaagagcagttcgagcagcttttatctctgcatctttctttgttctggctgcagcaccaatatattgtattccaccaatctctacagtgcatatgaaaggagctaagcctgaggctgatttggtgcaaatataagatggaatggcataattcatcttctgtgcatactcctgaagaagattcttgcacagcccagtctcttgctgaaaacatattaatatgtgtaaaaaaatgcacagtgatccaggaaagagattataacactatgctaagtttagtcagcctgattcctaagaactaaagaacatccaaattatctaaatcctggcagtacgagttcagtagctattaaacgactaatttcctattgtattcatgggaataacctagtagagttgtaagcttgagaaaatacaaataaatcatgacagaagacaacaataaagactttctgcaatctcctacctggccgatctatacaaataccctcccttcttgctcactgggtcctaactttagccgacaatctagtgatctacaaagccgaaagctctgagtattcctggagttatagtccatggtttgccttttctgtctctgtttttataattcttatgccgttcttcagatttctgagaattcaaaaccaacaactgtattgaaagtttgaaacaaaaagacaattacaatgctttctaataatcatctactacagcagcaggtcccaatagcccttgcttgcacaatgctccaatcagctgccccaacactggtgcatcgtgcacaaatagtggctccaacagtaactcctgtgactgtgtggcaccatcacctgcctgcagcaagcctatcagctccgacaatgctggtggatcccactgcaggccacgccttattgcctcctgcaccaactccctcactgtgcccatgtccccggcagacatgcacccggcgactaccacaccaaatgtccttacatccggtgggcacccggcgtgctccatgcaggtcatcatctgccgcgctccggcaaggtcacccttcctacatagcgcgctgatgtacacactatacacatccacgtctggtaccagccctctcaggagcatttcatcaaacacctcctccacagaatcgaactccaagcactcgctgaaagcttgcattgtcaatttgaagtatgcaagtgcaggtgccaccctgttagagcccatcttattcttcatgacctcatatgcctccgctacctttccctcctgcagaagcgcatcgaagacggcgtggtagtcagatctgcttggggaaatgccccaatggcacatcttgtccaagaatgctactgcatcctgagcggaagcgtactggcacagggaggagaggacagcacgacaactggccaggtcagggtcaagaagaagcgagggcatgcagcaaaggaggtcggcggcagcagcggggcggtgggcctggcagagtgtggagatgaggatgtggaaggtggtcgcatcaggggagactgatggggcagcgagcaagaggactttaggggcaaagcggaggaacgctggggaagagcagatagcagcgaggagggagttgagggcacgagcagtgcggagggtggaggagaagaaggtggcagcggcagcaagacggcagtggcgtgcaagggttgccagaaggcggtggtggtggtcagcttctcggtgcatttccctcaggttcagttgctgacttcctgtgttgcacaggccagtctcttgctggaaaacatattaaggtgtgtcaagaacatagaatccaggtaagagattatagcactatgctaatttagtcaggcgttaattcctagggactcgaccaaaagagcatcaaaattatctaggtcttggactcggaaatgatcacaaaacttaatatgtgtactttgatgtttgcattgttcatggttcacaaaccggggaagagtgagttcagaagctctttaacaaccaatttcctgttatattcatataatacctgagtagaattatgagcctgaaaagatacagacagatcatgacggcagataataataagaccgtggtgactgacagcaaagctttcacaatctcttctatgcaaataccctctcttcttgctctctaggacctaactctatccaaacatgaaagccctgattcgttctggagttatcaggtgagtggctatctcattcttcggattcgcgcgaattcaaaagcaggcactgtatagaaataagtagactatcccaacacttttactaatcttgtactacaccagcaggtcctcccaggccccaggtattccatcatgttgagttaaacaaaaacacaagtagagcagacagtgacttacaacagctgggatgtttgcgttggctggtatggacttgacaatttccatgagggcaacttcagcagcagactgttctgcagcctttctgttgaagaatccgggcagggagtcatagctggtgttattaatcaccactgtggacttgaagacaggctcatgggaaggtccctccttgaaggtatgatactctggagtctggaggccggctttctgcgcatactcttgcagccggctcttgaagacgtagcagttctcaacccctgggccaaatcaagcataccacaactcagaaaatagcattaccacgatgccgggaagagcaatttttgagatttcgtcccagcaaccagctctctatcaagatgacataataatgcaagtaatgtttcggcaacaaatgtagtagtagttacatcccaggcgcatcaatgcatcatgtatgatggtgaatgctctccagtaaagcaatttccatttaaaaagtggagaggaaccaaaacctgcggttagctcgttggaatgaacagtcctcccttggttcttgttgagaccaaagaagagtgttgagagggaggggggagagagagaaacatactgattccggcggtggcgccgttgggagcgggcgaggtgttggcggtctccggcggaaggggcgtgggcggcatgtccattcccacctcgccgccaccgccgccgcagcgtcgtcgagagtcgagagagaagagaagggttttggttgtgtgcgtggtgcgatgccaagaaaaggtggaaaccaaattgtataagtgcgtgcgtgtggatggtcgattcttcgaggcccagcgatgggcccacttgtaagtgcctcagaacgactacttattttttttattaaaaaaaggaaaagaaacaaaaaacagtagctttctgcttctaagcgctcctagcaattgattttttttttgggtgcaaaacatggtggtggtataaattgtggccaggaaaacatcctcaacataaatagtacaccagtatgatctgatgatttgcattcgctcctcaagtcgagcgtcaacaagatcgatcctttattacacatctcaaacacacagacacccttattactcactcactcgaccaatgtgctatgctcccgacgctaatcagttacttcctccgtttcacaatgtaagtcattctaacatttttcacattcatattgatgttaatgaatatatgtttagattcattaacatcaatataaatatgagaaatactaaaatgacttatattgtgatccgtttcacaatgtaagtcattctagcatttttcatattcatattgatgttaatgaatatatgtttagattcattaacatcaatataaatgtaagaaatactaaaatgacttatattgtgaaacggagagagtacaggttacacctcagtagaatattttccccagggttcttgctcacttccaactctccaagcatcagaatattttccccagggttcttccaagctatggaacccaggtacatttgtgtatttgccaccgccatatgccttcatttgagtttctcatccaagacagtttcagtatcagacttccccagtgtttctccacggtatgaaaacgcccaatagaatcatttctataccaactgccaaaatgccttcatttgagtttctccccaagacaatttcagcaaatgtaagacttccaccagcattttcccggtcctccaataatagatccagcacatccaaaggtcactggtttgtctggcgacccagacaaagccacaaagataaaacactcacagcttcacatcactacttccattaaactatttacagacccaaagtgcttccggccttccaatcctcatcattctacctcaacatcttcccatgtagacatacctgattcttcaactgttgtgtggcgccaaataaacccaagggcgacctcaaaacatctttggacgcattgcatcaaagtgggcaactgtacaagtacaattcatatatacaaaaggacaatgacgccctaccttgatgcactggatgactgtccagtgcttacaatgaaagacttaaaagaaggcattgattcatcaagccatgtaatattgtgttagctggacaaatgcatctatctattgaacaacatctatgagagacatgcgcatgcattctccctgggcccatataaacaaccacttgcccaggcagtccccactaacctgatttatcatatggaagcacctccaaacctttttacatttgggaaaggaagctggctaaggagaacaacaatccaaataggatgactatttacagtttggttaacctagttatttgggaagcctccaagtgtaatgatgggaccagggcaagatgccactttcgcgaccttctgcaagggaggctaatgaaccctgttttgtatcttacaaactgcaggtcagatcagagatgtagatatgcccaagaagcaatgcaccagaagctgtggcacttctataccaccaccaccatgtcactgaccaggctctccataacatcttgtatcttgtagctgtaccattggtgtggatcaacgcttggccatacatgaggccaactgaatgcatcatcattgcatcatggaacaagctgtaaacctcattgtacttggtaattgtcctccgcgtagatagaaacaagagcattatcaccagcaccagcggcaaggagtgatttgtatcggtggaaagaaaggcagtttacgctgcctattcgttgacccataaaagatggctggtagcgaattattgtcaactgttctccttcaagactaaacactttgatcatctgcttggctgagccgcttgcaataactggggcatgccgatgaacagctaatgccattaatgaacccctatgtgcttcaatagtgaggtagggttcagatgcccttctaacatcaaggaactgaatgtctccagcttgagatgcacttacaatctgtaattgcataaataacaaaaagggagctctgtaaagctcaaataatcccataaagttctaaaaaattggctgctctaaacaattaaaactacaagaaatacagaagatgtgcacaaagagggaggatttaccttgtagggatcaaacccaggctgaaatcctataccaacaaccttttctgatcttggggcatgtggtcttgctgtatatactagcctacagcaatgggaaaaattgaacttaggaagtagcataaatgtgtgcgcgcaaataagcatgcatatgtgtgttgtgggcggaggatgcacatgaagcgaaatctctgcaatggaacatgtggttgatatctcatcaaacatctacttacctatcaggtgtacgcacgtcaaatatcctgacagatgcatcaagaaaaccagcagcgaattggccacatcgaacctgagatgcagactgaaaaaagaagctaaaatcattattttaaatttttcacactcaaatagcacatatgcacacagtaacaaagaactcacaagagctgaaatcccgctatcagcagttgactggatggtgttgacaagttgttccttgtcaagatcccatacaaggatagaggacatgtcaccagatgcatactgttttacaacaaaaggagtaagttccatattacaatagccttgattaatgagacattgcaatttgcaaaacatcgggaaaaggctttagagtttcaccagataacccgactgttgctgccaatcaaatacaatactgcgaccagcacttcgatagccttgaactgatgagaaagcagttacaagtttttgtcctcccttttgagtatagtttctccatatgcggacatttccatcacctacaatatgaaaaaaaaaatacatatcaaaatggtacaaaacaaatgagaacagaaaaaacataaagataagagatatacttgagccaactaacaacaagctatcatcaagctcattgatcagcaaaagtttagataggcctctgtcagataacttgtggttttcaaaagtattcactggcagcgcatcatcatagttccatactctgaaatgagaccaaactttagcgcaactgcactagtgtatctgaagcacaaaaaaaaaatcgattttaacaagagattccagtataatctgtttaccgtatttgctcattttcatccgcagcaacaacaataggagaaaatggcaacaacaatgatgcttttgtacccaactcaaacctcgtatcccagctagcaatttggctggtcatcttgcaagctgctaatgccaccaacacacagaagaaggggaagcatatcattaatcagataaataaatagaactccaatagcaaaaatataatgtaaaatagtgttgctaggccacatacaagatcgttggcatttagcaatgcaatccattgcaattcgttctcgctcttctcttctagcatttgcttcctcgttatcatcagaaccagttagaagtggcctagaaaagtgaccacaactccatctgtaaattaatgattggggaagtatatcgagccccatgttgctgggggctgcactggagcttaaaagaggatcagctaagccatcaggtgagttcaaaacatgtggtctgaactccatcgagcacactcggcgcaatcctgtgaggtagtcatgctgagggggactaacaggaggagtcctaaaggccatcgagaaatttcctacaaaatattgaaagagctgaattcaataatcatttacaccccacacaataatgtagtgcatgcaaaaaggcaggcatcctccaagcacttggcaaggatagaaattattaacctaccagagttcatatcaaaccaggaagaggagcgtgccattccaaagtttgatgaagggggcacagatgtctctcctgggtgtgcacctccattgctaagtctactgtttctcatgcttacttgctcaacacctatgagggacaatgcccttttcccaatacttgcaattcttgggtaaggatctttagcaacattgcacatagttgctataaattgggaatagatcccattatcaataggcctcgatcttgagtagttgagaccaccattacttgcattctctctcagtaatatgcctgaatcagagtgttgggaagaatcatctgactgtggagaaccatgcatgatgctatttgttgcaatcgggctgctcgtagagattcttccatcacgagcagtggcactgttatcactgccaacccttaaaacgggaccaatatgtgaggcaaggccactgctaccttgtattaagctgctgggactgtaaacattgctcgaattaatattagccaacgatggtaatgacttgagcagtgaattggtttgaggtttccagtactcggcggcaacagatttgatatgtttattgtgccccattgcaaagcgggtaagcgctgcaacacatcagatcaactcaaaattatcgccacaaaatcaagaggaatctataggcttgacacattactaaatgagtgtaagtccaatgtattaggcaaattcacgtacctacggcaacctcagatctaacaagagggctaccatctgaagagatctgcagaaggcttcggacaacatttatttcagctctcaccttttcatcatcatcagaatcgtcgtcagctccattcagtgatggagatccaatatccacaagatttccaagtgcaaaaacagcagaagctctgacctggtaagatcaaatatttaacacgtatgttgtgaagcaggtataaggaagaattaacacaaaatgacagcagccatacttcaggttgaggctctgacaataagcatataacaatttccggtgcgtttgattgcagaccaagtaactgagcctcagggaaatcttcccaaagtttgccaaggcataaacaaagccattgcaagagcaaaggctctgtctgagcatcattcggattttcaggttgcagatgtctcaggcagacatatataagccctgcattagcacaagcctcttgaccaaccctatgcccatccacaataacggctaaaacgaaagcagccattgcacgctgctctgggtaagcatccaaactgtcaagaaacctgataaagtatgcatgccctccatctttcaccaagtcaacctggcatgactgtcatttgaaaaacagagcaactaagtaaatacctgaatcttgagaaataaaatgaactgtcagagatttcaagttttcaacatagaacaccaccttatcaagagagagaatttttgtccatatgaacacaagaatttggcgcaactccattgcacttgtttgaagcagtttaagtacataagggaagatgccaacggacaaagcctaaaaaaagttccagaatttgaaatacgggtaagataatatacaacaacacttctacagttctacccccaaaaaagggcacgcagaacggtcaactccataccaaatcaactgcccaaggtcccatgtcaagaaatcttccaagcagaacaagtgctctaaatctgtgtgactgactaagcaaaacctacacataacataagtgtattagagcaaagtaaaacaattgataattaaagggaacccatgtagcaaatttccagcataaatactgaaagcagataagagatgggcaaccatgtatttaacaaagttcacaaataagtaacaagggcattttgcaagatggcctgtatgattatgcaatgatataaatagaaccaagaattgcgtcacaaaaaagcctcatagatgtccacccaagtttattttgccatcatttggagagtcagttaccaacttaccactcaaataacaaaaaaaaaaaacactagcatcttgaatagctggatggaaaaaaatgtcttgcctgaagaacaataggtagctgttctgggggtttcttgtcttcagagccatgatcaagccaaacttcaaatgctgtcaattgctccgtgaaaaatggactcggctggtttgagtaaggaaatgaacaaagtgatggtactgaagtgataattctcaaacaacataacaatgccaacaaaatgttgatgtccaaagtattagatcattcaaaaaaagcaaagacggttaatagcacctgaaactctgcattaggatcagcaattaattgaggaagcttagaaaggcagatctctgcagccatgtcccatgcatccctaaaattgaaatttaggaaattaaagaaaatggagaagaggtagctaaactataaaaagaatggctagtgccatcaattaccacatatggtgctgatgagttggtggtaacaaagggtatgaaattggggaacaatttgcggaccgcatgattctctcagcaagtaagaagttgcgaaagagactagcaaccaaaagatcctgcctgaaaagtctttggaatagatctgcgtagtgaaagttgaatcataacagattaaaagaaaatgaatgagaaagcaattgatcactggcattaattgtgattaaaatgactatcagtaccatgaggaagaacattccatgcaatagtgtctgtgatagcagtgaaaatccagttcaactcccctagaagagttttgcggtcattttgccttccaggaatttggtcaataagattgtgttccatggaatcacggagtaacgatcggttacaaaacctgaatagtttatatacatgaatatagaccattattgatgcagatacagcatgagaaattctatgtctacaacaatcaaacatgagaaggggacgaaccagtgcagtgccattttgatgggtgtggtgaggcaagctgtgaacacatcagcaggaaattctgcgctctgtgggagagtttgatgtgcctcacaggccgcaaggagaatgcagtccttcgatgaagatgcagacgagctagaactccagtctaggcgctaaagtgaacatgagtagtcatagtgaatatattaaacagtctaacaatagaaacagataggaaatcatcattatcactttcaacttcaagtatctggcgtacgtataaaaattagaaggaactataccatacctccagaaaagctttcacaatcattccagctgctgagcagtcaaaaacatatatagaaggtgttttcagccatgaatcaagatcagtaatgggaagcggaatatattgtgtgtaactctgcacaaaaagtaaaaaaagggcacttcgtcaaaaacacacatggataaacaatgcagcagcttatgcagtgtctttgcaacattcaccttgttaaatacccaaatctccccattagctgtaggctttggtacaccatgaccattgtaatgaaaaaggactctctctgttctagcaaatttacggcaagtattacatagcttcttaacttcctctaatgtcggatccagctgaagcttgtaacgagcctgcaagcatcattcgggcatgatgtaagtaatgtcatcataataaagtctataaacagcaaaagaagtgcctcacctttggctgccagcgctcatattgtgagtgtaatgttttcccaatagtttcaagggcttttggaggtgccatagaaaatggatctgaaaaataaatgaaagagctatgagaaaaactcaaagcaactgtacaaacgcattaggagtacaaagatgaatcaccatgtttattttagataagctttctcactctagaacaatcaacaaataataaattttattgatcaagtccctatcctccacaacttaaaggtccggcatcttataacgcagacccggaaattttaatcctctacaaccaatcctcaggctttcacaaattaatacacatttggttataatcaaacagaaaattaatggtaattttacagaatagcatgtgtcagaccagtctttgctgcaataacctctgattacaaaataatcacccttgtttggcatttagagcagtcaataaaagatatagcttaaatgagttctaactaacatttgcacgtggagagaaaaaatacaacaatactggagttgcataccataaacatgaaataaaactgccaactgcaggcagacgtaaattttccagctgactaaaattcaagcatatacatatgaccaaatgtttacctatccagcactcctttcttgcacaaggggagattttgatcacatccggcggatcaacactaatgtttaaacacaacacaagtgccacacagccagttttcatctgcactaccaaaacactattagtaaatagcataaaagcaataacatccaacagtacaccagaaaataaaaggaacagaaatacaaatagaagtatagaatatccaaaagaagcatccagaagaaaagaaaaggtattgggacagatttctgaccaacgtagacagtcatttgaaaagcaaagctattttctgatcagctacttctagataaaactgaccacaaccatggagcaattacatgggttctccatcatgtcatagtaatttagaatattctctttttttttatgaatcacatgccacaaactgggttactaaagttcaacacaatggtccaccctagataaataaaaataagatgcaaatcccactagggacatcagtcatctgaagaagaaagaaataatttattcaacatgagtgttcttttgttggaaccaagcatttccacgatgtccaaaaggatatatggggcaaccaaacatctgcattgtacaagcgatttgttttgcccgaaagcttacaactcataaaactatcccagatggggtctcaaggttcctaattgtcatttgtttccagtatgcactacttcccgtccatcatcataattccattgcagaattacagcccttaaactaccgcatgctcacatgctagagcaacatatggtggaaatctgatatgcctataatgataggtttaccttggataaccaagaactgtaacattatgactatactaccgtaatgctggttttgtccattgcccccactcaccattttcacatatcaacttcccaaccaaactcagctgaaactatagtttctctttctattaacttcctcaccaaactcggtgaaactaagtttctctttctattaacgtccccgccaaactcggctgaaactaaagtttctctttctgccaacatggtgccaaactgccaatcagcaattagcaaatactgtcacttggacaaatccaccctactagatttaagattcgaaggacaagcccaaaattgttaacctcaagactaacaacaggctggctctgataagaaagatgagatgggcttattatctgaaacatgcatataggcgagtcggggatcgccatgctgcttttaaccatgcagcaaaatggtgcaacaatatagcaacaccactactatgtcccatatgtatcgattaacatatgataaattcaataaaatgatgcattttttagccctgcacctgagcggccctcattgataaagttgagtgtcctgcttacatagcactactagataaggtaacatcaaccattgtatgacttgagaaccccaattacaactgaaagtgtcgtcataatcaatcatcaaataataataccaataatatgtggaacaaaatggataaaagatattaaaattactagtacgccaccctctcaacccagtcaatagccgcccctaattttcattgtcagctcaatccattaaacgcattgctaatgactaccctatgaatcctcctcctaaacaggaaccagcaaagagttgaagagcagcagcaggcagaatagcatccattacccggtctttggggcgccatttggagacgggcccgctggtggagggcccggccgccgccgcggcggcctcgtcgaacccctcgtgccgctgctcgcacagcacaaccacctggggcagcaaggcgacctgcggcggcggcgggggcggcggctcctcgtcgggcacgtccctcctggggtccggtccattctccacggggaggtggtcatcgacgaggtggttggtatggtgattgggcagggcggcggatggctcggcggaggaagaggaggaggagtggacgagcctggaggccatgagatcccccaatgccatctacgcttggtccctcctcgcgggcggtcaccccgaagccatcagaatcgaatccggcaggcaagcttgaagaatccgaatccggaggcgggagggagggagccccgggcggcggcggtgaggacgatgacaagattgacaggacgggagtgggggggaggggtttagggttagggtttggagaggggggaggagagggttggggacgggaagcgacggggaggtcaggtggaggaggaggaagacgaggaaactatttactaaaaaataaaatcggaaattggattctgtcctctcctctcgcttgctgctgctgctgcttcttctccttttgcgagtccggtccgggcgtgttgagtgtgagatgcgcaggctcgtggccgtgcgcttcttcttgcctctctgctctgtttttttctctctttttttccttttcttgctctggttttttccctagcttgtaatcctcctcgtattttagttcagtgcccatgcttaagcataagaacaaatggaagtttgcatctaaaaaggtgcatggatcctctaactcctaagtcctaaagttagtgactccttttgctagtttatactgcaggatgtggcatgtatagcttaattggactggatcacctaactttctttttacttgtgtttagtaaaagtacattaaataacaattgtgttgctagatatactttaaactagcatggtggcccgaatagattgcgcgtctagcatcattatattttctctcatataatagttaatagtatgtagtatgttttctcattatattatttgaatatattaaaatgataacataattttaaattttgcaataactttacaaaactactaatgtgtaatattcatattgtattttatatacgtgttagttattaattatttttaatatcaaattttagttatttgtaaattatatatattgacttgttttttaatattttttttaattccgaattttctgtaaattgtatttttatatagactctatgctattcttctaatattatttatttttatttctgaatttttattatttctaattgtatttctatgtggactctaaactaatttttaatttcaaatttcagttacttctaaattgtatttctatattgactttaaacttcttcttcccatgtttttcttaattttgaattttagttatttataaattgtatttttatacggactctaaactctagttttaattttattatgtttattccaaattttagttagttttaaattcctatatggactctatactttacttctaatattccttattttttaattccgaatttctaatttttcttaattgtatttctatatggactctatactctacttctaatattccttatttttaatttcaaatttctattatttcctaattgtatttctatatggactctatactctacttctaatactctttatttttaattccgaatttcagttatttcctaattgtatttctatatggactccaatctcctcttccaatattccttattttttaatttcgaatttcaactatttctaaattgtatttctatatggactctgctttttttttctccgattaatgtgagaatttctaggccatgagagcgaacgtggaggctcctttttctattcctttaataatataatagattatttttcaggcaacgcatcaaaacatttaggcccccatcgtttgctccatatagagtaagttttaacttttaaaagttattttttgaagtttttcatcaatatttatttttttattggtatttaaatatctaaggacacgtatataaaaatattacccataattttttttctaatatgtcattcggcatattatcagtatatggccaaaagatggggcattaaatttataaaaatcaaacattgaaagttgggagcattagaacaatttagttaatcaacaaatgtaatccttctctctcttgtttttcttacatccacgtagttaaaagccttacatgacaatatctcctaaatagtgacaccgcaaaattgttcatgtcataagagaaaagcgatgaccattagaacgacgctattagatggggatcgctttcgagagagtacacggtgcctcgtgcttacgcatttatataaatgacatctagcggataaaaacatcgtataaaaaatactacatataattttgaatagaagaatgttttgaaattctacttatcctataataatgatatcgcaataaagcctctttactttcaacatttttctgctacatatttttgtaaacttttgaatgtgccatgaaatgctttaatacaattggtaaatgagagatacactttgattctgttaattcctttttcattcgttggatcgcatgatgagctctaggataaatgtcattctcgtatccacaatttgatttaattaaccatatcagcaattaagcttgcaaaccacattttacatgtagtaccacttgccaagagagattttccaataaacgtgcaacggtggatcccatccatctttctacctataataaattagaaaagaatacgagaaataaatggagaaacaaaaacacgacaaaaagaaaagctgatttgagtatggttgtcgctgaactgaatgcaccgggctaatcaacatggcactagtgcaaccatttagttgcttccccatgcatataatagtgcaaattggatgtgcatatgttgacctctgaacgactcatctgttctttggccgataaaaatatttaggtagggttgcatgatctagcaacacaatccattaacgtttcttattgctagttatatcaagaagatgagagctccctggctaggccacgtctcctccttagcattggcaggccaacaaccgcatgcctgaaatagatttttcaacaaagtttgcttaggaaattgcagagatagaaagaacaaatcaacgtaaagagattttgcactcgatctggagaactgcagaaacacacataggtatagtatcactaaacaatgattaataacagatactcagttgttgtttcaggctgataacactaaaatatgatgtcaaagtgcagagattgttctaaaaaaaaggaagtgcagagattgcaatggatggtttgcatagagtgagctgtcatctggtagcaaaggaaacatggcagatgctagttggctcactcatcacacaccttttatagctgcaggtacccacatttgctgtgctccaacgtcacctgggattggagcctaccactccatatgtagtattgtcacaggtattaacataatagtgtgctactcctacatagtagtataccgccatcaacatgagtctttctgcatgaaatgattcctgggagccaaaaaccctaccacactttgctgctagcatttgggttttggacactgccaagtgccaaccaatgtcaggttgacacccactcactcgcctttactcgactatatctatgaataatcatcatcccgccgaatgggatgattgtcactctgtcagccaccgtgaattgttctatgtagagcttggtgtcactcttaccaacaaacagatctttctggaccagattgtttgctgctgatcattagcaaggctctcttcttattagcatttttagttaagttgttagcaggcttcagaaaatttaggaacttacattggtgtgatgtgcaaattgggcaagagaacaagccctaactgccgcatcaccctcaggtacagtacttgagccaagaaacaaatgcctcggtttgtctttcttgtttgtaaattaattaatacatgtgcaactgtccaagagagcgtatttcattagaggatatttcagctcatatacctgtactgtgcatttcggatttcagtcctccctgccaaatttgcagtttcagaatatgattattcagtaaaagcacagctcagttaattaaaacttaaaacgtcctaacctgcagtgcttgttcatcaatgtaatacatggttggtggatgtgaacttttgtttggagcaagcacgatgtcaggagtagtcaggacgagggggtggagtgcactggcacagagcaacacaattacagaagcaaagaagagcaagctagctgtttacaggtaggctgcttcagaacaggattatgggtggtgtggtcataggacctctgtaccttttggcgcatgtgccactccctgctcttctctcctttcttgctcctcaaccgtgttcatctgtgtgtcacactgtcagcatactagaaactctgcaacaatctggcctttgttttgtgagagtacagtgatgagacttgtcatccacaagaaaaaaaaaaggtagcatttcttcaaagcaaaagaaaagtgcacacatgactaattaaaaagtttttttttctttttcctgtggctgtataataaactggtaaatagacaaattgaagtagccatgtgatggaactgaaaatgccccagaagtcagaaacaacattatagatgagatctaatatagcatttcctccatacactttaatttcacatgccacttcatagcataaaggaagcaattgcacatgaacatgaccaatttatgcctatcttgtaatgtgcatttgcattatgcaccttgtagttgcatgcttggcatgatataacctaaggtagcatgaacagtatgtacagttatatttttattaccatgaatagttgaatttgagtgaattacccaattaagcttttttgctcctctgctgcaaccagatgggccatagttctgcccttatttctcaacctcctttgctaccacccattgtcaacagacaccatggacatgctccagaatggagacttcctcatggggcctagcaggagctgttctgaacactattgttggaccattccctgcagaaataattacagttcaatgcatagatgagtactttgcattccatcaagtggacaaaatttgcagagtaaaatagcaaggtctacaaattcaatattaccagtggacatgtcaaaggttgatcagatgaggaggaagcattcaaccagcagcaatcggttagaatgatgaagcagaacctatccattgtgtatagcattatgaaattcgaaacaccatgacaacagtagatgccctttcacgagttcgacgatttattgtgaagaatctacaacaaactaggatataaagttctatagattgcaatcccaggctgttccgtacccatgactcatgaatcatgcctaatatacttaacaaccataatcaaattcagacctagtagacgaatcacctgattgcgaggggaataccgtgagacgtgagatatgaccaaatcatgcaattccgttatgctaactaataataataaaaaaagagaaacacttccaatgtagcctttttcacctttcagattcacttgatatataaagcttctgtaaaccaaacaaaaaagtggcccagaagcagtttcagcataagtttggacacagccacacaactctgaacattcaacaacagaaatctacgattacaaatatctgtcagagcaacactaacatttttattcatctttcatagccatctcatgcctccgtttctgtgcaacctcaacaagcagagtcagcagggcttcacatacctgtgatgtgtctgcctgatccctaggttcctctttgagtgaagaataaaccatccatgcatggtctaacttccgctctggccggactactactgatccaggaacttcagcatccttccttgtcacaagaccatcactcttctcaccataccttgccaccagaagttgtgagcatgctgccattgcagctgaaagtggcattacaactgggatcctagtaggattcccatcagctgcagctgggagctccaagtgtgcaacatgagagagggcagtaagcacacttggggtgatgctagcctctgtatggaatgagacaatgggaacctcaggaggcaatgggttctgccgcaggaattctttcctcctctcatatgtcaggtcttccagagcctgaagatcaccctgaaggaaaaaaaaagagaaaacaataaacatcagtgtcgtccattgtgcaggctgacaaggtaacaatcaagctcatcaagacaaataccttaaggactttggataccaaaatctccatgagtttacgtaacctgacataatcaccaagctggccttctcgcaagatatctgaagcaaccgggcttcctccatatgggctttgagctaaagccaaacctgcgaccttgtctttcagttgtggccagtaaagggagagggctgctgctgcatctacaccacccttgctatggccgagaagtagcacccgcttcttcgatccccagtatatttcttctatatattcctttatttcccttgcatttttacttactgaagactgtataattcattatatgttacttgatgaaaacaatattaagagtaagtaacaaagaatattactgtatggaagtacctcactgtgaatcttggcaatgtgacaagccagacccatcttggagaaatatgattttgtcttgacaaagtaaagaggcccatggttactaaacaagcctgcaaacaatagaaaagctaatgtcaacacagaaaattgccaaaatgcgaattcacaaccaaagtggcagcaaacttgcctggaaccaacagatagaccatcgaatcaggcagcttgtgttcattttttctgacagtgaatcaaatgatcacatgagataaaaaagacgaagcatacattacatcttttattaagagcagttgcataatttaaacattgaaattttgaaatgcaaattattatgtttgctgacctcacagcatcaagaatttccaagaatctggcagttccgtcctcagttggaggtaagctttgatcctgctgaagccatccaatatcatcggctgagccacgaacagttttccgagcacgttctacaagactgacaaaaagatattaaggatatcaaagactagtcctcccaacaccagaacatcttataaaagaacacctcatccacgaaagctaaattttatattccaatttactcttaatggacatcaaatgacacgtgttttcatgcacacctattgacttgattatttggtacagtgcataaaatagaagtgtgtgcactaaaaaaagagtcagttccaatagatgtcaattgcataacaacttaacaagtgcacttaacacttcataaagttcaagcatgcatagtttattcatgatatagtgatgatatggtatttgcagcttgtgtcacactatcacctatttgtttgattagaattcacaggacaagacgaaaaaccaaatgcaaaagcagtctgtacccttgaaacagtgaagccccattctggaagacgcgcaaaggtgccatctgttctgtgatttcttgagatgagcttccagtattatcaatttcaccaggagatgagtctgctgactgttcggaagaagcctgaaaagaggatccaccagcagttgatgcaggtggcagcgtcgctagctcttgcccttcgtcagaaatagctgtgcaataaatcaaggagatgcagcagaattaccacattgtgtattttgttatgaaattggcacaaaagagtcattcggcgaagtcaaggagaagctaacctgtgtaaccagatactgggaggcactgggtaagatatgaagctgtctgggccagataagacgcagcttggtttaaagctgggacggagaggaagagctgtgaatcttcaatcctgttggctgaataactagcatcaacctagatatatcaatgaacattaacaaaattggaatcatgatatggctgcctatgatggcaacaaaaggctatattgatccaggacaaacttttggcaagtgaatgcataggggtggtccagcaaatagtaacatagggaaaaaaagtagaagcacatacagatgatgcagaagtagaaggctgacccagatttgaaggtaaatcctccatggttggctctttatcctagcaattaacattaaattggtgttggtgaatacgcaattcatggatgtactacatgtgaagcaacgagaatagaaaatgcaataaccagtgggcaatcatttagaaggctatgagatggagtcactggtagcgtgtgaggaagtcaggatttagggcatcaaagatgtcattactggtgggcaagcctaattaaggtatcccctatctgatctcttgagtaaagaggagggaaaaaaagaaaacattccttgaattcgccgatatcggttaccaaccaattccaagtttacggcagctaggcaagagtactcgcaagtggggatctccaattctcgattcatccaaggaagaagaagaagaagaagaagaagttaccgcaatcaagaagatggagggagggtttggaggcgatgccgatgcgttcctttccttgtgctccactcgactcgatcgttggcctgctactgcgactgcgctccctcggaatctgattgggatttgggacgaacaacggaaagaagcgaagccccgccccgccgcgccgctttcttccggagtccagacttttctggtcttccttctatttgggctgggcctgcaatcatcatcacttcagttcacactgtgaaaagtctggacctcctcctatttgggctgggcctgcaatcatcatcacttcaaactgttaatgaggcatcaccaaaagctaagctttctgtatgagtatgatgatgatgatgatgaatcagtcgtcttctcatccaattcaagctagttacagccagcagcagcatcgaaaaccaaacaagatatttcaagggcagagccgacaagatactaccaacaatatgctatactagtaacgggagtaaaatgagactttttttcaacaatgactccagcaatgagctatctatcttatccaacaacaagctgcttgccttcaatgattacacgttcgaattcgccaggaaattctcccatatttaataattcggggatcttactcctagacttgacctgcaggcatgcatagctagttacaggtctaacacgctgagagttgagagttgctgaggctgggaatacaattcatcagtatannnnnnnnnnnnnnnnnnnnnnnnnnnnnnnnnnnnnnnnnnnnnnnnnnnnnnnnnnn

SEQ ID NO: 30769 - DNA, 10418 bp, Oryza sativa
  unsure (1)..(10418): unsure at all n locations
nnnnnnnnnnnnnnnnnnnnnnnnnnnnnnnnnnnnnnnnnnnnnnnnnnnnnnnnnttctcgctatgtttgagccttatgcacataactaattcatgattcaaacattcatgacattggtatgaatgacaaatgaagagcgaaaaatatgtctcctcacactaaaggttgtaacccataaagaaaatcattggtctgttcaatcttgcgttagcacaggagtggcagaatttatttcacactaatcacatcctacttccttctccatagtcaatacagaactgaattcaacacctccaagaatagcatattttagccttagctggctcaactatgaattaatagatggaaaggcaaccaaaatccacaatttctaaagtaaaagttacaatcgaaatttcagatttttttttgaacatctgaaggaaaagttacagaccttccgattgtgccagcgaaataatatctgattcaatttcttcagcagctgatggcaaatgttcccgtataagtggaagaaaattgcataaaattgcaccctcttcaaaagaggtaatcctgaagagaaacacgataagaaccatgaaacagtacaacatttcgtttttggaagaactaataaatctcacaaggaaaaacttgccttggttctgctggatgcttctcttcatcagaatctacttggacagcatcataaagatggcatatttctcgtagtgattcatcaacttcattcctgtctcctttccgactcctccaaatttgtgcaaagcgagcatttcttccaaggtcctataaaggattaatgaacaaaacttgcataaaaatgtgggaacagcacaagaaggcactgccacatctcttctctggatgtgtagcaaatgattcgacccaaaaaaattctagtgacaagaagggtactaataatactgtatcagccggctaccaagtcctaacatatgtaatacgattctccaaggcccatgccaataacaacacctgggaatgaccaaacttaatagagttggctcaaagataatatcacgaaccctgtctctcctatttttgggtcaatccataaaatatttccttcatatactctatccaccaaattcatagtagttagtacaactacaaacttaagcatatgaagttgactatagtaagaaaataggcacacctcatgcctctgtctggctgctgatcgtagctggtcttgtttctgttcgcagaaaaaagaacaatgttagcatatgaaaagtacataacaaccttccttatttcaaaatcttcaagaacaagatgcataaagcagtagtaaagtactgtagctgttactatcagtgaagggtctttcaaatattcaaggaaaatactaaaagaaacgtttactaataatatttttcatgggaacaactgaagacatggtaaaattataacaattaaaataagtaaatactaggaaaaagtttgacttactttatcttgattagttctgttgttccattcctttgtcttgctctttatctctttggcatccaagtcagaatgctacaaagtaaaatggagtaattgtgatccactgttcaactcttatggtacataaggtaaagtacagctcgcaatactttttttttcaaaagataatttagttgcataatgttggtctccataagtcaatcaaaaaattgttcaagatcaaatactgagctctattgtctatataactccctgaaaagtaataacaggagatatactcagatgctgatgagtaatgacacattaactgaactgattatgccatatgcgaggaaaccaaattgtagaagactagacaaatttaacaagcaaggaaaagaaaatgattattaccagaagagagtgcaaaacatcttgaactgcctcagaatggtgtactgtctcaatgtgctgtaccagaagtttcttaattcgtggttcctctgaagctgtaagcacagaaaatatgaatatcacatttatgtgcagtgtcaaagtacattatatgcaactcatgttcgcggtatcatggaggctgattaaccggtaagtagaatcctactattgtattatcaggacgagtatcttccggcaccaatttgcacagacaagcaactgctggtgtgattactgattaagttaatagcgtgtcacaaatgagaacctaggtgtagctcagtggtaaagatgttgccttgcatctgtgaggcctgcattcgagccatgctttcgacgctaatactcaccgattcaccttatatttaatgcataaatatgtttgcccttaatttgatactaatttcttccttagtatctcacttatatattcttctgaaagaaaaaaaatgttgcttctgtcctaatatttgatactaattatctcctcagtatctcatatatgtttatgaaagggaaaaaaaaagcgtgtgacaagtagaagtagatacctttattaggagcagaggatggctcggagactgaaaggctggagaaatcgagcatagccttcttcaccggcctctcattgatctctagccctaacgaatcacaaaaatcatgtctgttttttttccactatgaagttgggtagagaaagggggaggagcaatgagaggaaaggagagaggtttactcacagaaagcgtcggggcgggtctgggagggcttgcgcttgacacggacgacgatgggtttgtccctctcctcagcctccgcctccgtcgcggacgccatcgccgccgcccgccggcaaagccaaggtagggttggttggttctctcgccgtcagaacaatcgagaacaaagttgggtgctttaagattcgtgctaatacatctcgacacacctacgtggatggatatactcgctctcgaccgcgcgccaaaaaaaaaaaaactcagacatggcggccaccgtgtcgctctctctcgtcgtctccgcctccggcttcccctatccattcccctcgccgctctccaaaaccctagctaacccctcctcctccacgtcccttctcctcgccgcctccctctcccgcggcgccaccccactgcccctcctgcggcgcgatgtctccgcggcgtacggcgacgacgacatggacgacgacttcggggacttcgacctcgacgacggggacggcgtgggggacgacgaagacctcgacaacgagcaggactacgacgtcgactacgaccgcctgctcgcccccgtcaaggcgccgccgcgcccactgtccggggagggcgacgaggaggagggggacatcgccatggtcgccgcccagagcttcgtctccacgcaggactccgcctccgacaccgtggtcgactactccgtcaacgaggacgaattccacaagattcgcctactgcactgcgacttttttatccgcaaggtgcctgaccccgacgacgacgtcttcgacttccgggaggtatacatcctcatttatctgtctaacactagtacattctttgctaattgcctgtgttatcaagcatgtatttgacaatgctatctgttaatgcaacatctcatgacacattcattgcagtgctatccaaattgacagaactcaatcttttaggttgattgaactaaatcatgtgttccttcataatgtgcaacagatgtatgtcacgccgcctgacactgacatctactccatcccaagggttcttgctccgatgccgcaaaaggtgcccatgtctcttttttttgatctgtttcaggcaaatgtaaatgggcattgaggtgtaatcattgttttcctggttgaaagcagtatgtgaggtgcatgaagaaaaattttggtcgttaccacgttagtgagccgcctgttgagcatttgcgtgatcccctatacaagacagaaagggagatcatgaaggtatgtgtgagagtgttgtttcctctgctaatttgttctaccactctgttatgcaattatatttgtcataaagaaagattgagtgggtaatgctgcttgaaagctggaagttgccaaccttaaagattctgactgaaatttatccctattttttttgccatacttgtcagagtagagaccttattgttgtttggtgagaaattgcccttactgatggtagtagtgacttgtgaagattacatgtcatgccaaattgcttagcaacaggttttattccacgtggtggttatctgaatctatagatcaaattgtgggatatccgatgcattgtttattgtcctcaaagatcatatattgctaaataggaaataaggtaagaactaaaattccttaggagtttaaaccagctagctctgcttagcctagtcactggacccctattaggccatttttaaactcaattcccatccaggcagtgtagcaattctctgttattcttgtttaacatgtctttctgctttatgcttgttttgtttgtcataatcaatactagttgttcttctcaccagggactcagacttaaaactatttttagtttctacccaatatgctatctttcttataccttaagagcatatatgctggactgttgttttcttcaaaatttatatatgctccatatttgtttatgctgtaggttttcttaacaaaacattacaggaataggcggtgtaacgacccagattttttccttgattttgaagagatatatgttattgactcgaaagcaaggtcaatcacgagagcaaaagttgtggtaagacgctttaaatttaaattcttgaagcattcagaacataagtacataaccattatatatttaggttgcaggagctctttcatcactaatgttagtagaaaaaagtatattagtatctgcatgatgatttgaaggaactagtttaacgatttccatcctttgaaatattgcatgcgaccatttggatgactggtaaactgggtctgtgatgtcattggtttcacagttagtcctatgccttttcatctagacatttgtgacaaacatttatattcacattttttttgcatagttaagttagttaatttttgttttgttgagattatcaatatcgagctgcttattacaggttagtgtccctgaaggaaagaagagggacaggagaaatgacttgctactcatacgagatggaggggaatcattcagaataattgacaaggtactatatgcttttttcatgaatactatctactattgttgttgtagtaggaggcttcaagggctaatgtgggctgtttgtatcagaccaaaagggatgatgcgaccactgtgatccaaagagaggagtgggcaaagtcgaggcaagatgtggagaagcactttaggaagctccgcgactttgactactcgaattggttctgaagaaatagtagctggagtcattcagcagagaaattattttgctaattttgcagctgcttatattagaggaagcgaccatggaccatggtgctcaagggagaatcgccatcttcgagtaggctaattatgtgtactttaggtttttgtagcaggtagaaggcatgccacgtagcgagcctatctgtacaaaactgaaaggtttgatgcttgtgaatgcactaccttgatgggtagcgaacgaatatgtggtccttggattcagaatgcacgtgttttttatagtatcggatatctatacttggattcagaatttcctaggtaagctttccctccggttttttatgtatgaatttcgtaggcaagtcctgtactcggcagaatcctcaatataatctacaaagtggcagacagcagacaattatgtcagtaaaaatggtgttatggaggatgctaatgcaacaatcaagaaagtttatccagataattcttctcctagcagtagagtggcattgctgactgctactgccttggatcaggggattggatcgaactggctggtaccagcggtttgcaggatcaatattctcgatcagcagcggaaaacggcgcggaagcgtacgtatgtcggaatagcatatagtataggggaacgtaagaacgtcacaaatgtgcagagtgcgtcccattcgaagccgatcaaccgaatagcggatcaacagagatgaaaaggagctgaaaaggaagagtcgaatatactaccaggatcaagaaccaggtgttgcaagtccagccttgcagaccttatcatctcaaaatggcctcagaattgcaagaaaaaaaaaagcagatcaaggtgacacatcacacctcagattgtaaaacagtaagatcgataaaattgtctagtgctttaacctcacttgcaccagcaaattaaagcaaatgaagagtctcatcttcacatcagtcaacaaaaaaaataacaaagaacaaaaatatgtatctgttcttatagctgcaacactagaggaaccaaaataatcacaatgcaatcgttattggcctgaccacatggacaaaaaacatgagtaaaaatataagtcattcaaacaatattccacccgaatcaagtaacaaatcacaaacataattaagtagatctattcgatttacgaagtgcaaaatatctagtcaaatcagtacacatattagagaacaagtgcaaaattcagaagtggtttcagttttcaggatatgtgcatcagtgtaccattatttgcaccagaaaagaacggcaaaccacacaggtttgtactctaaaatagagaaaatccataaaatgccatcgacaagcaccttgatcctagaaatgccattgacaaacgcaacttcctgaaaatgccatcgtacaagcctatttctcccagaaatgccatcacaccgttagtccacaccgttagaacaaaacattttacaagaatgactaaattgccctcactccaaataatactatcccaatccaccggtaaaaaaaaaactaccgctaatgcttgatgcgtcacatggccggcctgcctcgaaggcgccggcctgacacgcggctagccagaggaagtgggaggctcacgtcagcggcggcgaatgactcgtcgtcgctgtggttggagtcggagtcggcgcttcgctcgccgtcgctggaggaagaggaggagaggcgggcgagccccgcggcggtcatgctccagacgcgggcgccgcagtaggggcagcggacgtgcggctcgagcgggccacggtggatgacgaggaacgcgcgcgtccgcgacggcatgaacccgcggtacgcgcccacgatgtcgtcgtacactgcgccggcgacggccagtggcggagctagcggcatcgttgagcccgggcgagtaatagcgtttttcggtgatcgactaattttgataggtgttgacagctattcgtagtgaagacgacatcgacggagcacgggcggccgcccgacctgtccgggaggtggatccgccactggcgacggccaccgcgtgctcgcaaagtggcccggcacggcggcggccgcgcggcagcagaagaagagcagcttcgccatcaccggccaacctcccccaatgagtcgatgcctgggaccgtcgtgcggatgcctgctgccgaggcgccgtcgcctgggaccaccgtgcctgcggccgacgcgccgccgcctgggaccaccgcgccgccgcatgccacctcctcgccgcccatcgcgtcaacgcctgggaccaccgcgcggacgcctgctgccgacgtgccgccgcctgggaccgacgctccgctgccttccacctcctcgccgcccgtcacgtcgacgcctgggaccgctgccgcaggcgccgcctgggaccaccgcgccgccgcctgggagccccgcgccaccgcctgccacctcgccgcccatcgcgtcgacgcctggaactgacgtgccaccgcctgggagcgtcgccttgccgctgtcgcccatcgggagctggcgattgaagtggaggggagaaatagtggccggcgatgggatggaagagaaggggatttatcctttgttgaggagggtaatttggtcattttgacaaaattaacggtgtctaacagagtgaaagtgacggcgatggcatttttgggacaaaatggctcgtacgatggcatttgctggaagtcgcgttcgtcgatggcatttcttggattagggtgtttatcaatggcatttcatggattttctctaaactaaaaaccgtatatattgtacctgttcatatcagtgcaaatgtgcaatagaaagatgccaggagaaaaggatctgtcacagtgggtgattactgattccagcaacaagataaaaataactaaataagcaacaattgcttatacatgaagaatgcaagaagcaaaaacgtatgcagaagatatcgtgcaacagatgaagaaaagcaacaggtatggaaacttacaagtacaaaatagaacaaggacaagctgaaatcatacatgatttttagtttctgagtctaccttcactcatactgactgatttctgaactttctgattgggtcgctagctgttgctgattaaggatacaatctgtcatggttatagataccacatacctaatagtagttgactaaatctcggtaggacccaccacataccatgtcctatacggaaacaatctttggatttaggaggagttccgataaggaaagacaactaaaattctatatggaaatgacaagaactactcggattatatccatattggtttctctagttctacttggacaaggggacacctatgagtataaatacaagccccctaggaggacaggggacacacactgaccatgagacgatcaacacgatcaccacgatcgggacgaccacctcatcaacacccaacacaatcaacatacaagcctacatacgccaagacacgccgcctgatatcgactttagggataggcatggctactcccttacggtgtctccggataccgtcaggagagacgaaagcactatctctgatctcgctagacacggattcgaggaggaaggctaccctgttgtagactacgagtcagaccttcagactgccatgtcgacaacagttagataggctatccacatgttgtactggtgtgattatggtgaataaaagcaactccgactccggccaacaggatgtagggttattacctgacaactcaggggcccgaacatgtataaaaatcctcgtccccatctcttttacctcagtctcgcatatatcctagcatcaacggtccccatactaagcaaataccagaatgacggcatcaaacgtcgacagtggcgcgccaggtagggggattttggtgcttcaggatttcgacgagatgggttcaaagatggattctccaacaacaatctactcgacaacttcggttatggggagatctaacccgaccggagtatatcgtccgacgagatcggaaccatcgtcgccaaggagagctactatgtcggcggcatccaagagcaatccgacactaattcctccacgtatgcggcattgactggtgtgagagatcggcttatctccaccaacaaaacgagtgccgtggagcttaaatcaagagccagattgatctgttcattggtgcaaattctaagtcggattggaggagttcttatgcttgcactagaatccaatctctaggcagcatcctggttggccgttccgacgacgtggcaaacagatcaattaaaggaccaaaatacaaggtgcaggcctacacggggaacagtaccatacacacaaacggatcaattaaggagttactgttcctcaccaagcatgcacagtaaggtatttagtagattaattttttaaaattaatctactaattccgtagatatatccggcatatatatacacaggtacgcaatattttatatataatttatcgtacctattcggtatgagatcataccgtattgtcaggtctataatttattatgtttacctagagcatgtttcttatacaatctccgttgcacgagtgcttccgatgttaggccaaccacggtctaacgctgggggctcgctctgttttcttctgtataaatcatgcctatttacggtttacataatgcctgataattccatctgctcgttacatcctgataatactagaaaatccaggcagtttttcgaatatatactcgatattctctgctatatatcttgccttctagaaaatatttttcaggaacaattgagcactcgagtaggttatggtcgagtacactccattatcgagaacattctcgacaaatgcggagttatcgcacccaacctaccaacgaagaccgacgacctatctcatagcaccggccatggctggactactcgagaaaaggttgttgtcggtgacatgggaccgggagtatcatgactagaggcttgggcaggagcaatcacccacgaggcctgaccccctcgggggggt

SEQ ID NO: 30770 - DNA, 7027 bp, Oryza sativa
ttcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggccagcgcggtctcccggtgaggagctccacgctccgtcatctggcgcgccaggtagtggcctctgcgtgtgttcttctaagctctcgcgctctttcgtgtgcgcgaagcttttcctgttcagcccaatggccgaaccagcaaaggcgcacaacctctctccgagtgttagcggtgacgacggggagccgaacccacgccgtcgagctcgtactccactgccccctccacgccaaagtcctaggcgggagaaggcgctcgagagggccgaaggatccgcgacttcggcatccacgggagatggagaagggcggcgagatggggagcgtcgcctcctcgtctacggcgacggcagcacgccccagggtgcgctccaagctgcaggcgcgctcctacgtcacccgcccgtcgcccatgacccggagtctccagcccaacgttggctggacgatgtggccaaattggtcatgacggcgcggcagcgcctagatgctggtgggcggtcctccgccaccaagacctctggtgctgctaccaccggctccgcgtcgtcaaaacggagggcgcggcgagcggcggccgctgttcgccattcggccgccactccttcgtcagcgcctccgacccggaaagatctgcgtggggggccggatgcccgcatcagtatcgagcgccggcgtaatggccggtgtgctgcccacgcaacggagggcgcctcctcgtccggagtgtcacctcagcacggacgcggggatcggccctccgtgcccccggttggtggtgtcggctgtagagcctttgtggcgagccttcggaacgtccgttggcccccaaggttccggcccaccatcgccgaaaaatatgatggcagcgtcaaccccgccgagtttctccaggtctacacgaccgggatcgaggccgctgggggtgacgacagggtcatggcgaatttctttcccatggccctgaagggacaggcgcggggttggctaatgaacttgccacccgcatctgtccactcttgggaggatttgtgccaacagttcaccatgaactttcaaggcacatatccgcgcccaggtgaagaggcggacttgcacgcagtacagcgaagggatgatgagtcacttcgctcatacattcagcggttctgtcaagtccgcaacaccataccatgcatccttgcacacgcggtgatctacgcgttcagggggggtgtgcggcacaaccgcatgctcgaaaagattacctccaaagagccccatactaccgcggagctttttcagctcgcggaccgagtggctcgtaaggaggaggcatggacctggaacccctccggttccggagtggcagcttcggccgcccccggatccgctgctcagacagggcggcgtgacaggaggaggaagaagaggtcaccccattccgacgacgagggtcatgtcctcgccgtcgagggcgcttcacgggccacccgaaaggggaggcctgcgagcgatagaaagaaggaggccagcgctcccagcagggagcgcccaaccggcaagtggtgcaccgtccacaacacctcccttcatgacctcgcggactgccacgcagtcaaaagtttggctgagcggacgaggaagttggaggaggagaggaggcaggagcgccgagagggcaagtccccggcggttccttccggcaatcggcgaagtgaggccaagcagaaggcccccgccgaggacatcaatggcggcgatgatgacctaggtttccaagagcctggggccgccattgccactgtcgatgggggagcgtgtgctcacgtttctcgccggagcctcaaggccatgaagcgggaacttctggccgcggcccctactcatgaggcgacacgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccgaccgtcccaaccgattatcggtgtgacgccggggcacacttggccgctaggtcatatcgaccttccagtcaccttcggtggatccgccaacttccgcacggaacgggtgaattttgatgtggcggacctcagtctgccctacaacgcggtcctagggaggcccgcgttggtgaagttcatggcggcggtccactacgcctacctccagatgaagatgccgggccccggtggtcccatctctgtccatggcgacctcaaagtcgcgcttgcttgcatggagcagcgcgcagaccacctcgccgccgcgtccaagcccgagggtggcgacgagaggcttggcacctccgtccccgccgccccgaggcagcggatgatcacatgcgacgaggtcccggtcaaggaagttgccctgggcgacggcccgtccaagaccacacggatcggtggtcttctggacgacaaataggaagacgcgctcgtctccttcctgcgggcaaatgctgacgtcttcgcatggagaccggcggatatgcccggggtccccagggaggtgattgagcaccgtctcgccgtgcggccgggcgcaaggccggtccggcagaaagtacggcggcaggccccggaacgtcaagccttcatccgcgaggaggtggcgcaacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgtgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcaaccgagacaccttactcacagatctagcggaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcgccggtagcatggccgccctaagtcggttcatatcgaggctgggagagaagacgctacccttatttaagctcctcaaacgctccggaccgtttacttggacggaggaagctgaacgtgccctcactcagttgaaggcgtatctcagctctcccccagttctggtcgcctcggagccaaatgagcccttgctactctacttagcggcgaccccgcaagtggttagtgcggcgttggttgtggagcacgatgaggacaatcctcattccgcgcacccccaccctgtgctgacttggcccgggagagagcagggaggagaggcccccgagccgaacggtggcccaaggcccccgacgaccggagctggccctttgcccacttgtcagacggtgccaggtgcccccgacccccaagatggcccggcggccactgcgggaaggccgcacctattgccctccgaccccgaggctaactctgtgccgactcggcccgggagagagcagggagaagaggcccccgagccgaacggtggcctaaggcccctgacgaccggagttggtccttttcccgcttgtccgacgacgccaggagcccccgacccccaggacggccccgaggccactgtggtaaggccgcccctgtcgtcctccgaccccgaggtcatcggcacagaagacgagtgcgccccacgtggccacttggacgaagagcgccccaaggacgcgacccctagcaaagaggatcggccccaccgaaaggtgcagcggcccgtctactttgttagtgaggccctccgggacgccaagacccgataccctcaggcccagaagatgctttacgctattctgatggcttcaaggaaactgcgccattatttccaggcgcatcgggtcacggtggttacgtcttaccccctcggccaaatcttgcataatcgagagggtactggacgggtggtgaaatgggcaatcgaactttctgagttcgatttgcactttgaaccacgccacgctatcaagagccaggccctcgccgattttgtggcagagtggaccccggctcccgagcccgtctcagtccccgaggccagctcgggcccctcgcagctgcctcacaccgcctactgggtgatgcagtttgacggctccctgtctcttcagggcgccggtgcgggggtcatgttgacctcgccgagtggagacgtcctcagatacctggttcgcctcgactttcgggcaaccaataatatggcagagtacgagggactccttgcgggactcagggtggcagctggactggggatccgccgcctcctggtattaggcgactcccagctggtcgttaaccaggtctgtaaggagtaccggtgctctgacccgcagatggatgcttatgtacgccaagtgcggcgtatggagcgccatttcgacggaatagagcttcagcacatgcccagacgggataacacgattgctgacgaactctcacggctcgcttcctcgcgagcccagaccccaccgggcgcctttgaagaaaggcttgcccagccgtcggcgcgacccgaccccttaggggagatggacgcgcctgaccggcccccgaggcccgtcggagtccaggcctcgggacccgaggggagtgctcccagctcccttagattgattgcttggattgctgagatccaagcatacctcacagataagactctacccgaggaccacgaagggagtgaacgcgtctagcgcatctccaaacgctacgtgctggtagaagggaccctctatcggcgtgcggctaacggaatcctcctgaagtgcattcctcgggaacaaggcgtcgagcttcttgccgatatccatgaaggcgagtgcggagctcactccgcctcgcgcaccttggttggcaaggtctttcgccagggtttttattggccgacggctctcaatgatgcggtcgacctggttcggcgatgcagagcgtgccagttccacgccaggcaaatccatcagccggcccaggccctgcagatcataccactttcatggccttttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacctgcccaccccagaagcaatggccaagtggagcgcgccaatgcggaaatcctaagaggccttaaaaccaagaccttcaacatcctcaagaagcatggcgattcgtggatcgaggagttgccagcggtgctctgggcgaaccgaaccacaccaagccgagcaaccggggaaacgccttttttcctcgtctacggctcggaagtggttctcccatccgagctcaccctgaggtcccctcgggccaccatgtactgcgaggctgatcaagatcagcttcgcagagatgaccttgactacttgtaggagcgaagacggcgcgcggccctccgagccgcgcgcttccagcagagcctgcggcgctatcatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggcctaacccatggaacatcgaacaccttcgtcgcttctacccctaagggggatcgggtgtcaggttttggcctcgggccaaccccgcacccccctcgggagtgcagggttggccgggggctaccacacatgcatatttttatttctcttatgtctgctcttatatctgtatttcaataaaagcattttcgatttcctgaaggctgtatctgttctgttgtttccttttgaagaatcttaacttgaaatagctcactcgcgctcaatcctgtcctcgggggctcgggtcggctaaaatcgccaaacggggcccagaaccgagccgtgtcccggggcgtggtgaactccgggggggaatcggcaaaagcccacaatcgggtcacccataaccctcggtcacgacgcttccggcctggccagtctcgacacgtggatctccccaggcactagccccgacccgcgccttttgaggactgggacctgggcacgagcccttaatcaagctaagacacaaaaggaccacggctcagatcatcctcatctcatacacatagcaaaatgaaattgacacaaaaatttcttcattttgattgcagattaagtt

SEQ ID NO: 30771 - DNA, 21330 bp, Oryza sativa
aagaaaaagctgaagattggcgggggcctgggggctcactccgatgcacccgggtcgccagccttgtcgccactatcgcccgctccaccgtcatcgtcctcctcgtcggagttgagggcgaacgcgagccgaggggccgaaccctcgaagctgtggacgatgtggtcggcggcgtcccggacctgcgcgcgcgcgccgtcctcggtcccgggaggaaactcatccagcgccgtccatggggagaagtcggggtccctggcctggtaactcgccagtacgagctccactgctcctcgggcgaggtccctcgaggatgacttaatcgtcctctcgagctcctcggggagccgctggagagtcccggccatttccgagaggcgctgggcgaggcccccctggttggcggcgtacttcacagtccgcccgccccagaggccagcctgccggccggcgtgatctagacgggagacggcgtcccgaagcatgccgggccctacttcgcctgccaagcggagggcctcgacctccccggtggacgagtctagcgcgccctgcagatcggcgatggtgtgttcggcagctgcgaggcggacggctaagtcgctttcgcccgtggccgccccgccgatgcgcgccctcgcgtccagctcctttgcctgcgcctcgagttcagcggcccgctggttcagtgcggccctctcggcgcggacaccttccagattgtggcgcgcctgctcctcccgcgctgcctcgcggagggacaggctgtccgctagccgttgcgctgcggcctcggcctcctcgagagctcgctcccgctcggtgagcgcgtcctcgcggaggcggagtgcggactcctcttcggcgcaggcggcctcgtgcgccgccagcgttgcctcccggatggaaacagcggcctcgcgatccaccaggcccctctccaccacgccggcacgctcttccagcgccatggcacgggcctcaagggcttcttcgcgccgacgggatgccacctcggtctccgccgcccgtcgttctcgggcagcggcagcgtcaaggacctcctgggcggcgtcgagcttcttccctagctccgcctcccagctcccgtattgaaggcggagggtgtcctgcgcctcgttcatcacagtggtggcgatgagggcagccccccgctcctcctccacctccttggcgatctcccccagcacctttcggcgggcttcgagctcagagacgtgccggcggtgtgccttgcggcccacctccaccatggcctccaccgagcgtcgccccttttcgacacgcgcccatgcggcgtcgagctccgcccgctctgcttgcagggcctctacctgggcacttaacccgtccaacaccgtggtgtttgcgacggccaaggcctgtagaaggggttctgcgctcagtggagcgacggaaggcgtggggaagagccgcctcggagaagatgccgcgcggttcggctcgccgatggacgtgccggactcagggacgtcccccggacccggcttgtcctgagcgtcgcctgagggattgggcccaagcgattcgcccgcagcctcgtcgcgagctgcctcggaagtcgtcgtcgccgtggcctggtggagtctggcctcctcccgagctagaagtagcagccaccaaccaccgacggcggcgacaccgactgtacggtgaagaaccaccggaacagccgaagggatgggcgcaccccgctgaacatctcgcacaggtgcgcaaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagcatggcgctgggcgtccctcgcccagcatgactatctcccggccggtggcagattccggcatgaagcggcgcggcagcccggcctgcctctcgcttacgatgcgggaaggcggcagcatgctaccatcgagcagagcggagccccgtgccatgacgccggaggaagagatgattgagagcgagcgcgtgtggcgaaggtagggcacaggaaaggaggagttagggcgcaagcggcgaagacaaggggaataatggcgaaaggaaggaagcaaatctcctcctcggcgtctttatacccttgccaacgctgtgcccggctcctcgcttctcgcgcccactatctcgctccctcgtttctcgcgcccacgcttccactaatcccgttcgcccgcttgcggcgcatgaggtggatatgcggttgtggcagtcgagatggaacatatcgtgcgtgcattaattgcgctcgctgaccgaagtgccatcaccatatctccaggcaaaacgaaccggctcgtcccgattcgcgtgctactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcaaggagggcgatcgccctggcataacgccgggggctactgtcggtgacatgggaccgggagtatcatgactagaggcttgggcaggagcaatcacccacgaagcctgaccccctcgggggggtcgggcccgagggtgatgtggccgcccccccctctctctttgtctccccgaggggtcggactgctcccgtttcggccccgagggctgaggcgccctgaccccttgtaggttttgcgccgcgtgtatgggttaggtgagcacagcggggctcacctaaccgcatttattgcggtttggacgagcgcgtcacgccgcatgtaacgcagtgcagcgcgctcgtttatccggtctgtgaccagtctcagaccggtcagatcgtggattaggtggcgacaggcggtctgacacacgcctcgccccatcccgtcaagatgagtgcctccaagcactcgtccctagccggagccggcgtgttacctcctggagatggcacgttggtcccggtcagatatatgccaggcttcatcctaaccattacaggcaagatattgtatgaagaagggcgaacatgcagattgtgaaactgacacgtggtggacaagaatgaccggtttatgaccggtctgacactggtcatgtcatcagcagacatccatgttcccacgtcgcgcctgcctccggcggaagtggaggtaggtatgggccgtcccatcagaaggtcattcggagggcaaccaaacaaatctccgtccattaatgaagagaagtgaagttagagggaagagaggagaagtcccgacacaaaaaagagagatggtgcatgtggtatccccttgagatataaaaggaggaccttgcccacctagagaagaggaggattcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggacagcgcagtctcccggtgaggagctccacgctccgtcagttgttaacggataattcctcgcgaacgtcgtcggcttgatcacccgacatgattgcgaacggacatccggatatgctttaagttgggtacatgagtcatgctggccacatgaggtacacttgcaataaaccaactctagcacttccattggtgttcgaggaataattctgcttgcttactggttctcgcaccagtacgcagcaatctctcacaccgcaccttccatcggtgtacgagggataattctgctcgctcactggttctcgcaccagcacgcaacaatctctcgcaccgcaccttccatcggtgttcgagagataattctgctcgctcactggttctcgcaccagcacgcatcaatctctcgcaccgcaccttccattggtgttcgagagataattctgctcgctcactggttctcgcaccagtacgtagcaatctctcgcacctttacttcagatggtcaaggtacgactacggcagcgtagcggtcctcgtaccacgactccaagtgatcgagggacacctactcaccggttctcaaccagttgatcgtagtgatctctcgtacatttgcttcaagtggtcgagttacggctactgcctggtcctcgaccagcgatgtagtattcctccgactacttccactttcagtggtcgcgttacggctactgcctggtcctcgaccagcgatgtagcgttcctccgactacttccactttcagtggtcgagttacggctacttccacttttagtggtcgagttacggctactgcctggtcctcgaccagcgatgtagtattcctccgactacttccactttcagtggtcgcgttacggctactgcctggtcctcgaccagcgatgtagcgttcctccgactacttccactttcagtggtcgagttacggctacttccacttttagtggtcgagttacggctactgcctggtcctcgaccagcgatgtagcgttcctccgactacttccactttaagtggtcaaggtacggctactacctggtcctcgaccagcgatgtatcgttccttcgactacttccactttcagtggtcgagttacggctactgtattgtcctcgaccagcgatgtagtgttcctccgactacttccactttcagtggtcgcgttacggctactgcccggtcctcgaccagcgatgtagtgttcctccgactatttccactttaagtggtcgagttacaactactgcctggtcctcgaccagcggtgtagcgactctcctactacctttactccaacaaagttggtatcaggtacacaatatcgccaagtgttttacccagagatcccttaccacgacgacacctagcgttgaaacctatcctactgtccctttacgccgtcttggcaaggcctccgaggaacctaagggatcttcggctggggacgcccagagccgataaggccttgtcggatccttcagagacgaaagaccatgtaagatctggtcgtgtaagagttctcgccgtgcgtattaaccaagctgtgtaatcggaaaatgaactttccaacttcacggctgggggctaggatcagtgcttattcaaccaagacaggtcaagggtccaagagccttctcctccgagaacgattctccgatgacaaggctgggggctagggagagtgtacaactcaaacgactgaccaaagtcgtgaactgagaagacactcttacacaaaacattggttagtaaatttgattcattttcagtttaccatacatattataacatgtcaccctttgagcattcgctcgggggctatttctatttgatattcttttctgagtattgatttcaggaaaattctattcgacattgtggaagactctatgtctctatggttctacacaaagattgactaaggcgagtatgaccaatgtcgacaaagctccgtcgcagactctacgccttctcgatcgctcgagaacggttgctggatctcgacaaggaatacggaatgaagagatggtgtacccgccgagataaaatttcttgacttcaatccaaattctcaactacagcaagacgggagacttagtcatatgctctatactttctcggtcgacatcagagattgacttagacaaaccctttcggtgcccgcacgaggctgacaaaggaagtccaacgttatatctaaactcaccgagaacggtcacatgagctcgataacagttactccaatgtctgcgcgtggttgagaatatgaattcattcatttgcattaaagtcgggggctactgtcatggttatggataccacatacctaatagtagttgactaaatctcagcaggacccaccacatactatgtcctatacggaaacaaccttcggatataggaggagttccgataaggaaagacaaccagagttctacatggaaatgacaaggactactcggattgtatccatattggtttccctagttctacttagacaagaggacacctatgggtataaatacaagcccccctaggaggacaggggacacacaccgaccatgagacgatcaccacgatcgggacgaccacctcatcaacacccaacacaatcaacatacaagcctacatacgctaagacacgccgccggatatcgacttcagggataggcatggctactcctttacggtgtctccggataccgtcaagagagacgaaagcgctatctctgatctcgccggacacggattcgaggaggaaggctaccctgttgtcgactacgagtcagaccttcagaccaccatgtcgacaacagttagataggctatcccacatattgtactggtgtgattatggtaaataaaagcaactccggctctggccaacaggatgtagggttattacctgacaactcaggggcccgaacttgtataaaaatcctcgtccccatctcttttacctcagtctcgcatatatcctagcatcaacggtccccatactatgcaaataccagaatgatgacatcaaacgtcgatacaatcatgcctactccctctgtttcaggttacaagactttctagcattgcccacgttcatataaatgttaatgaatctagacacacatatatgtctagattcattaacatatatatgaatatagacaatgctagaaagtcttataatatgaaacggaggaagtatttttctactgccaggagtagctagctacttcctccgtcccaaaatgtaagcatttttgaggttggcacgggtattaagaaagtaggtgagaatgattgaaaaaggtgtgtgattggttgaaaagagaaagtaggtgaaaaagaatggttgtgattagttgagaggagaaggtaggtagaaaaatagcttcattttggaacaaagtactgtgctagaaatagctacattttgggacggaggtagtagcattttcgaaccttgtaccagtccacgatagatatctatactaattgattgaaccaatagatttgaaacttcatttattatgcatatatatatatatatatatatgtcttatataaagtacagttgtatgtacacaagcttcgaatttcaagtaaaacaaataattatcctagactggaatatgatgatgatgtatatatatcaaggttatgagccatgtgaacttgaactgagcaattaagagttgaatgcatcatcatgtatctaaaatcttcctctactccatgtccgtgcattgagatcatgtatctaaaatcttcctcctctccacggccgtgcattgggcgagtcaatcttgtctaggactaaaaacatcgcgttccatgtcatcaaaatgctgcctcctaataaatcatgccagtctgagaataaacatagggagaacttgttgggaccaagatagtggatgcaaaatacatatgcaatctcacaaagaactctcagtaccagatctgcatccaggtcacccagtcgaggcatatccttgtaatgatagtatgcacctgaaagcacacaggttttaggggagataacacacacaacactcaaagttaatttcataagggaaatatcagcactaaaagatgtaatccaaaataaatcaaacgcaaggtttgcaagaagaagcagtcaagccactcaaaaggtttgcaagataatttgcagcggtgatgccttcgcgacacaatggcgatgccttaaaaaccatgcttggttcctttttgaatctcagctaatgagagtggacatcacactatctacttgttgcagcaaaatataattcatatctctttgcttattaatgaggaaattatgcaatatgtcacgaaaggaaattcctacttccaacagctaatccggcactcaatcggagaaaggttgttaacgaccaaatttggtaaatcatatatcggatttggagttaaggccgaagtggatttaaaaggaaatcgatgacaggaacagagtatgaatcggtttcggaaccacatcggctacggtgttcatcggctgataccgaatcggacaaggtgagccgatgtagccgattccggcaagataacattagaatcattgtcggatcagattggtgtgcttcatgaggattgccatgcacggattgagtccgaagaaggcaattgtatatattaattaggaatagtctattagttttctttttatctttaggaaagtgtgtttagtgtccgattaggattttatgttttccttttatctttaggaaagtttctttattttcctacaaggactagtatctacccatgggtataaatatgtacacccggggtcattgtaatttatctctatgatcaatacaattcggcgcatcgccacttttttaccttttctactttattttatcgttcggcggaacttggcacctgacgcggggctgcatcggcttcgatctccggcgaatgggtaagtccaatgttccgctggcccaggcaattgtatcgtctacgtcggcgtcgttcaatgctgcatcagtacattcgacctcttggattgctctgatttggacaatatgtttgcctggctatttatcatgtgtctatattaatctagtcttagaatctcaatttagctctatcggttgtctctcgctttagggtttctgccggtatcggctaaatcgccctgctagattagattaacttagacatctaccaccctgaaaatcagtcaatggcttaattgtttagatattgtatttctttttatacttagtgctgcatcagttaagtttgatctactaaatcgtgcttagaaccataatctctagcctgctttttgactgccaataagggtttcatcggggtttcagccgatgagttatctggacattgcatcggcttataaggattacatataagttggatttagtcgatcgcaataaagactttactgattaatctaatcttgtggattttatgacatcggacccccagccgatgtatgtttttacccttcggattggtacttgttctattacatcattttgttggccgattggtttctactagattatattgctagatcattgttatttatcatcatcagccgatcacctttatatcattatctacattggacatatagccaattgtttaaaaccctatcgacatcggctcgaatcggcatcggctaatatcggctatcggctggaactactacatcggcttgtcagccgatcggctgttttatccactgtttacatatcttgtcagttgcaggatcaaactgactggcacgcccgcatctcatcaacctttggacctgcattggagctaagcagatctcccagaccagtgtgtcatattttttcgtcaacaaaggtgaaccctggaccctatggttccaatagctagacaaatattatcttatgccatgcctagtagcattggaagccacatacagatttaacctcatagatagtcataggtatgggcgtatggcagtacactgttgttgcataccagatgattcattcattgaggacaaattgtaacaggcagtacgtctaccaagaacacaaaagtgccttatatatactagtataaaaagttgtccaaggagtgctgtgggagcagaaaagaagcaactaattaacataaatagatgtagggtttggtgatggttcattcatgtcgctggcaacctcgggcgagctgagcagtgtgggaagagagactgggccggagatcaggaaggaaggaagaagctgaggaggagtcacaccttggggatgatcgattcgattctgcacctgttgtgttggcgcttgaaggtgcaatggcgatggggtagctgcctttctgaggaagatcgaagccccggcgctgaggtgtcgtgccggacggcgacttaattgggagcgctgccgcggccgaggggacgagtcgtacgtgagctcggacgagcgcgcgcgtcgtttttttaagcttacaaacagatcaatgcatttaacacgaagaaaatcacttcgtgattcccgattcctattcctattttgttgggatgaatataattcatcgaggagataatccatttgatgccactgagtttgttatgggcttaccactgactttgtcacgttctataatatgcagcttttgcttaacttctacgatttaccatcgccgtccggttagtctccgttagtactgtacactttcatccaaatgaccaaaatacccttgagacaaaaactttcaaattttggacaaaaattctgaaatgtcagactttaagtttttggccaaattttgaatgtttacaatcttatgtttataatatggtatttcgaaatttttgtccacattttggaagtttttatatcagaggtattttggtcatttggacaaaattgtacagtagtaacggatataaaccggacggcgatggtaaatcataaaagttaagtaaaaatcgatggcatattgtagaacgtgacaaagtcagtggcaaatcgtagagctctaacaaactcagtgacatataatggattgtctcttgatcgagactaccgaatccagatagaattttgttaagattcctttattccaatcccacacaaaaccaatcagcctaccatcagcgagcaaacccaatccaattccggtcaacacctaatataatactctactcttgagtagtactacccccgcttttttaatactagaaaaaaaaatctgtgcgttgctatgggtgaactacacgttgtaaacatacaaaaggaaaacccatgaacaatttataagtaagcttttaattgagtttataaaaatacatacatttctaggtttccatctatttgtgactttgggtatggggcgacgtggcatcgctgatgatttggatgcaacggcgctcatggagtccgtgtcgatctggttggcatgtatggagggatccaaaagggatgttctgcgtgtgggatatacaaaatctataacgctaacaagcccaaagatgaattatcaatccaatccaactttattcagagcaattatctacttcctccgtttcataatgtaaatcattctagcattgtatatattcatataaatgtaaatgaatctaaacatgcatatatctagattcattaatatctatataaatataaacaatgctagaacgtcttatattatgaaacggagggagtatactcttaattgtgcaatcatactttaaagtagtagtatagatacgtactgactaattatcaacccggttatctatactctaatttgtgcaattattcagagcgaatctccagcagcagccgcaagcgtcaacaactttgctggcaatcaaaaccaacaagccatgatgcaaagccacgcgattaggctgatgtgtagatatcgcaaacaactttttagtaggccccaaaatcaatgaaagcacgtacatatgttgctacacttgatcggctagtgaatggaaagtagaatcctgcgagccaatcaatcaagcgatagagaaaaagaaaagtcgtgtgttgcacggagaggcgcatacatttggtatactcgcacacacagtagaagatcttagatgggctgagcaagacaaagggagtagcgtgggctgccatggcactcgattgtggaataagttcactttgactcccttaaaagtgacccgaatctaattcatgaccctgaactgcaaaaccagatatcttgacccctaaattattaaaaccggtgcaatttgactccctcagcggttttggagggcggttttgctgacgtggcgcctacgtggcgatattgaccgagtcttcgttccacgtggcgttgacgtggcattagaattaaaaaaatatgcgtgggacccattagtcattcacacaaaaagaaatatggggtccacatgtcagtcctccctgtctcattgcttcttcctccatctctcccttctctctctttctctccctttctcctttcccttcggccggtggcggcggtggtagaggaagcggcagcatcaagcagcgagcagggaagaaggtgggcggcgcggctcactgcgaggagcagggtgggcgacatcagggtggtgccggcagagcgatgtggccgtggcggggggatcccggcgaaccgccacaaccttgcacgcgatgcggggatccgaccgataagtgcttcgagtttttcccctcgtcggagttcatttctcgccgccgcgccgccgcggccgcatcccgaagcctccgtcggtttcacggctgcgaaggcgaagccgtggagggtgggaggagagcgagaggaggaagaacagtcggcctggcttgtggttctgcttccgctgggagtcaccaatccaatccctaatcccacgcttcttactcttcgccatctccatgctacgttccctatgttcttagtgattgtcgatggggctttctgtgatttttgggtggttggaacagaaggctcaagtatagttccctatgtatttcagttggattcatattgcaagttacggataaatttttggcctgtaccagttttacttgtttgttaatctgtatgttacttgttcggctgtgatatccatctcttttgcaaattatactgctatatcatgtaacgcttaatcacattcgtgagctaacttacatctcatggtggtaatatggattgtgcatctcctcatataaattgttcttctactcattgagcttttgcttcttccacttcaggtgtgcagagaaggggcaagcagcatctgcacaaactctactggaggcatcgtctatgattgctgattcatcatcctcttctcagccaaaggcagtagcggtagctcaggataccattgagttctccgaaccatcagggcgctacctttccttgtctcctgtctcacgcatttggtcccgactgatgcatcaatggggatggcggcgagcaggagcaggccgacggcggcatcaagtagcgagcgggggaggaggtggtcggcgcagctcactgcgaggagcagggtgggcaacatcagggcggcgccggcagagcgatgtggtcgcggcgacggggatcccggtgagccgccacgtccttgcgcatgtctggcttggaaggggagagagagagaagggagagaaggaggaggaaggaaggagacaaggatgactgacatgtgggcccgcatgtcagtgggcccacatttctttgtgtgaatgactaatgggtcccacgcatatttttaattctaatgccacgtaagtgccacgtcaacgccacatggaacaaagactcggtcaatatcgccacgtaggcgccacgtcagcaaaaccgtcctccaaaaccactgagggagtcaaattgcaccggttttaacagtttaggggtcaagatatctggttttggggttcagggtcatgaattagatttgggtcacttttaagggattcaaagtgaacttattccctcgattgtctagatggacctgcaggtgcgcgtgaaaggctgcagctgcacggtatggagattccaagcatgacggaagttggaggcgatctgatcattttatgcgtggaataaggtcaacggagatccctcaacttaacaacgagattttttgaggcccctaatgtcacatcctgattttcgtttcaggatttataaattatttaataaattaataatagaatttatattaaattttctttaatttacaagtgaagtaaaatgtgggaaataaaatttcttaaatctaaagcatggatggatttaatttttattaaattctccatgattaagtcaactctctgaactattctcagatttttcagggctcaattcctaaatgatacaaagaacagttcagtaattatttgatcattaatgatctaattatatttgttaagagcttttcttgtttaaaaatccttaaattataaatttttgtttaaaaggaattattagaaatgattttaaaagcctaaaagagaagatctaattttaatttgttaaatctcaatataaaactgggctagataaaattttgttaaatactttacttgattctataattccaagatttttctgggatttatttgagccaaggaagtatttttaataaatggaattgcatttcatgaataatttaaattgaaaaaggtttttaaaagtctcttttggctttgggccaaaagccggcccaaaacctcctctctctctctccccggcccaagtcggcccagtccgtagcccgcagccgagccgccgctctcttctctctctctcagtcgctgacaggtgggtcccacctgtcagggtcgtcttcctcgcgtcgccgccgccgcccgaaaccctagcgtgcgccgccgccgtctctttccaaatttggccgatcctttccgtttccggtgaaatctttagaggggaaatgatcttctcgatctcctcttccttttctcttttggaatcatcgcctaatttcgtttggaaatccgtggattcgaggtcgaatcggatcggtctctctctctccgagcccgaactttccttctcgtcgccggtcgccgtgggcctccgccgccgcctcttagcccctttaaaaggaccctcggagtcgccgctacccgccgccaccttcgccttcgcctctcgtcgtccgtagcgccctagcgccgtgtgccctagcaccgccgtcgctccagccgtgcgccgccgccgttccggtcatcgtcgtcgctcgggaagaccgccgtcgggatcgccaagttgtcgcccgtcctcgtccgccccttcgccgtcgttgtagaccgccggagcaccgtcgccgccgtcaacccgaagaccgccgccgcttcaacctcgccgccggtgccgtccgttcctcttccgccgtcgctttggtcgccggtgagttcgccgcgttgcgctctacccgttggtgtcctccgttcgtgccgaagcgtcgccattcgccggcgggcttgcgcgtccgagccgccgccgccggtggtgacgtcatcgccgacgtcatcgtcgccctctcccgtgagccggtcgtggaccgttcgatctcggccgttcgttttgaatggatcgatctcggccgtccgatcccgtgagccgtcgcccgtgcgcccggtccaccgaaaccctagccgttgacgcaataaatcctctttttcttttcaaatataattcattattgcgtcataattcaattaaaatccatataagtgttttaaaccgatttaatctttgaaaattcataactaattctttgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacttgtttgtttactttttatgtattgtttattttgtttttattagtttttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccagtttgcattgattaccctattccttgataccttgggttattataacttgactagttgggctttatatattggttcagctagatattagatatgattgcttagccatgcttagaaacattagcacactattgggataacttatgactcattattatttaatgatggcttaatgatagttcatgatggttaatcgtgattggttaatcaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtggattgtgttatgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgagttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttaattaaaatttctgattaattactccactgttttacttctcttaaatgttttgctaaatgctgcttttgcaaatgagccaatattatgccatcctttggtatcctcgtgcacttgcatatttgctgtgtggcttgttgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacacctaactacaaaactagaaatgtttacccctaaactcacttaaaccgtttaaagaaggtcccatgacagtatttttacccgattttactatcatggcatcccagtaagaaaaaaaactaaagaaattatatagggcccacatgtcacattttttccttctcttttattccccttctcttctctgttctctcctctcttcgccggcggcaggcaaaacggcaatgggcgagcacggatgcgggcggcgggctgtgtaaaatcaaaggtgtttttgattattattttgtgatgaacaattgggcattgaagattattggttttgttatttggaatttattcacgaagtggttttggagatgattggatttacaggtgaatcgcaggtttatcattttatgtggaccagtcagaccgggctctggtagctggtcagaccggcgtgtatcgcgcggtcagaccggtgcagcccacggtctgaccggccgacactgtgtcggtttcggtttctggttttttgtttggatatccgtgattatttcatgattatggcttctagatggatactatacgtatgtaatactattgtttgttattaatgagtcaagttggagatagcttggtctcggaatatggtttctttgtttgttccatgtataggtgactcgatgtctcgggagagtatttgcggtgatggaccgggagtcagcttggagataagacgacgtccgtggtggtcagagatcatgcgggatacttaggctagagttgatgcacgtggttgatggagattccatatggcatacgatggagttagtgtgtgcgtatgggatgcggagtcgaatttggaaggagtccaaatttggtatgattggttatgtaaagtttgtttcttgtactagagggtttcctaaggtgtttaggactcctagtatgagtttggttcgtggctttaggctgcctacctcgggtataaatagaggaggagcgtgaggcttcccggtatcgcttttgagagcaattgagttgagttttgagttagggtttcgagtttagtcgaaatttttgtaaggagtgctgttggtgcactttgtaaacacagagagaagtaataaagtcgtcatccactttaagagttcttcgatttgtgtttcaccgggtttcggcggtctaaccggcaactcaccggcggtcagaccggtggcatagcggcggtcagaccggcgggagcacggtggtcagaccggctgcggcgacaggcgctgcaggcgatctcggcggtcagaccggagattcaataccggtcagaccggcggcatccactcggtgagactggcagatcaatctcggtcagaccgacttccgtcgatttcgagggtaacttttatttccgctaaaagttttcggtttttgggtataccaaccattcaccctcgctctggttggcttagttcttgtgattcgatccttcaagtggtatcagagccttgttttctactttggatttttatcgatctagagtttttcttttgccatggctgctctggttcggttttcaactaagcctcatgttttcgatggaacggatttttctcattggtgtagtaggatgcaattttatattctggctgaagattatgatatttggagaaaagtttctcatccttatgtgattcctgaagcgattaatactgctgctgaaaaaattgcttttgaacaaaattgcaaagctcgcaacattcttttgagtggtatttctcgttcggattatgatcgtgttgctcatcttcaaactgctcatgagatttggactgctttgagtaattttcatcaaggaacaaataatattaaagaacttcgtcgtaatcttttcaaaaaggagtacattaaatttgagatgaaacctggagaagctttggatgactatctttctaggtttaataaaattttgagtgatcttggatctgttgattcttcttatgatgctaattatccacaatctgagatttctcgccactttttgaatggtcttgacatgtctatttgggagatgaaagttacatctattcaggagtctgttaacatgtctactttgactttggattcactttatacaaaattgaaaacacatgagaggaatgttctttctcgaaaagttgattctaagttgaatgctttggtttcttcttcttcctctttggaagttgatacttcttcatctaagtcgtcttttcttgctatttttaatgccacatccggtgatcaactcgaacaaatcgaggaggaggatttggctttggttgctaacagaattgctcgagctatgaataatgccaggaacaggaaaagaggtggtccaaatcgttgctttgaatgtggttcaattgatcattttcgtttgcattgtcctaagcttgggagaggcaaaagagaagaaaaagatggtgagaagaccaacaacaacaggcccaacaacaataagtcgaagggttcatcccaagggaggaagctggacaatctcaggaaggcttttcaacaagtttgtgccgccttcgagccactaagtaatgtagatggtgaaagtggagatgatgataagggaaagaacgtctccgatgtttgcttcatggcgcgtggtgaatctgatacagagtatgaagataatgagatgagtgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgttcaaattgtgaggttttaatgaatgagatttcaaaaattagagatgttaatgctgcacatgatttgaaaaataaatcttatcttgcttatagttttgttttgcacacacgcactttggatgagttgtttttaactaaaaggttgttgcaaaaatatcaaattgcttttcatgctagtttgatgtttaacatgatttgtgctaaaaatttaaaacaatctcatgatgttttggattgctcaacatgtaatttgaataagatgaaactaaaagatgctttaggtcgtgttgagtacatggaagatgttgtgaaaaacaatgaagtgctttcttgccccaaatgtcgtaaaagcaaatgtgtcatggtagattgtgaaaattgtgctaatttggaaaaaagaggtttcttatttgaaaaattttttgctaagattttctgatggtaaaaagaacctcaatatgattttggatcaatctaaggttagcacacacaaccgtggtttaggttttaatccttatgctcataattctagacatcctcctgttgtgttaggtgttggtgctagaagttgtgagattttgattaaacctgatactaataaaactgtgtttaaatctgctggtatcatgtctaccttgagtgcatcttcttcaaaatccaatgttgtgcatgcaaaacctcatgttgttgcttgtgttgctaagtcttctaattctaacaaggtgtctaatcatcgtgaaaaatatacttgttctttttgtggcaaagatggacatattgttggtttttgtttcagattagctcataaacagaaaaaggagagagagattgcttttgcaaaatcaaagtggcaaaaatcaggttttctctcgaggaaaccggtcagaccgcagtgggtcccacggtcagaccggctactgagcgtcggtcagaccgggcaccggtcagactggcggtacagaagcggtcagaccggccactgtacctcagttagaccggcctcggacgaatttttctgaaaattctcaaactgtttttgcacatggatatatgcctattggatcttctggtcgtgtgtctcagtactggattcctaaatttttattatcatctaaccccagtactgaggcttcgacttctacttgtgtgtaggctttggtggcaaggaaggagaacgtgtggatcgtagattccggttgttcgcggcacatgaccggtgataaaaattggttctcctccctaaagaaggcatcc

SEQ ID NO: 30772 - DNA, 727 bp, Oryza sativa
ccaaatttgtatgattggttatgtaaagtttgtttcttgtattagagggtttcctaaggtgtttaggactcctagtatgagtttggttcgtggctttaggctgcctacctcgggtataaatagaggaggagcgtgaggcttcccggtatcgcttttgagagcaattgagttgagttttgagttagggtttcgagtttagtcgaaatttttgtaaggagtgctgttggtgcactttgtaaacacagagagaagtaataaagtcgtcatccactttaagagttcttcgatttgtgtttcaccgggtttcggcggtctaaccggcaactcaccggcggtcagaccggtggcatagcggcggtcagaccggcgggagcacggtggtcagaccggctgcggcgacaggcgctgcaggcgatctcggcggtcagaccggagattcaataccggtcagaccggcggcatccactcggtgagactggcagatcaatctcggtcagaccgacttccgtcgatttcgagggtaacttttatttccgctaaaagttttcggtttttgggtataccaaccattcaccctcgctctggttggcttagttcttgtgattcgatccttcaagtggtatcagagccctgttttctactttggatttttatcgatctagagtttttcttttgccatggctgctctggttcggttttcaactaagcctcatgttttcgatggaac

SEQ ID NO: 30773 - DNA, 658 bp, Oryza sativa
ggtcaaccatcaggtttccattttcattagcaacaataattcacagagttcgttaatgggctagcttacatgctagccataatagtctttacagaatccaagattctgtagtagtgatagaatagtgctgagtgcttgccctccaagccatcacgggggtatctgttgctaccagcgaggttgttgcacggcctgcccccgatcaccaggtcaaagccaccaaatcttctgatgaatagttcaattctttcagcagtaagattttgaacatctgcgatttcaatcagcgtgccagtttgggtctggtcccaccaactcctcagcaacgtcatgtttacctctgatatttcgactaagaccactgtcttcatacagattccaagcctgtggagagctacttctgctccaccaataccagaaaacaaggacaagacgttcatgccattagggaatatgtccctcagcacagagaggtggtaggcatctgtatcaacttggaatgaattcccaagagctctatatctcgctgtcctgctaactcccctggtataattcctatgttagaatttcaatggttactctcattgagaaaaggatggcactcgagatggggcaattttctggttttcttcattcacaaaacacaaaagccatacct

SEQ ID NO: 30774 - DNA, 1350 bp, Oryza sativa
ccatcacatatgctcaaagttgttgaagcccgtggttgtcttttccagtggattaataaaccctaccaggtattctactatatttcttttctggttatacaaagtaagatgctagtcggtttacttgtgtagaagaattgaagtgcaaaatagttcacccttgcgttttggccatgttcattaactggtatgcagtttattagaaagcagtgtctaataacaggtgtggtcttggcaggttgcggtagaaccgtgtgatgtatggaagcagcagtcgcaggatttgcttgtacagtgaaatgtttcaaagataaacgttgtggaaactggggcgtgttttgtggtgttgaatttatctagagcaatatctccagtcctagagaatgagctccaaaagttttgtgccataactggctgaatagtgtattgaattgctgacggtagtattgtcagaacaacatactagtactggtattttgcttgtatgccagtggaggcgagggaggttatattcttgctgtgttgtatatagcgcaggtaggaatcaacaatcaaagagagatcattggggtaaagcatgttgtaagtagtgcggagtatgtgatatgccttgctgtgcctttttgatgcacaatttgattaatggaatggaacattgcattctcactataatttggttgttccatctcctagtgttttatgtggagtgttatctggaatgaggtctcatagcttccttgcctgaataaaggcactgaacactatattggttttctgcgaaggtctgaatgctagctagttgagagctgagacatggtagcggccggttttgtcaggcatgcccggactgcacgggttcttgttggttgttgctactccagttcatctctcccagcagaaagatggagtcatttacacagtaaggttccatgcatggtccaatgcataaaaatgcttatcactatttaacttttgctggtgttgggcaattgtctccaaggaccggggaaataggtgagggcaattgtcataaaaatgcaagtcacaagtcgatgttacaactgaaatatgtgagaggagggaacatcaacaacaggtaggcacggtgtaaagcattgaagactgaagcggaggaggatggatggtgcgcagcgcaatgcaaaactgcagatgcatgcaggtaggcgattcagcagttgattctggagctgagaaaataaataaatactctaattgcaagcaaccaacgtcccaacccaaccaacagttgtaataatgagcaacttccgtccatccgcaactactgtatactcctgtatactctactatccatcatcgccgttgtgcaca

SEQ ID NO: 30775 - DNA, 585 bp, Oryza sativa
  unsure (1)..(585): unsure at all n locations
nnnnnnnnnnnnnnnnnnnnnnnnnnnnnnnaggccgcacctattgccctccgaccccgaggctaactctgtgccgactcggcccgggagagagcagggagaagaggcccccgagccgaacggtggcctaaggcccctgacgaccggagttggtccttttcccgcttgtccgacgacgccaggagcccccgacccccaggacggccccgaggccactgtggtaaggccgcccctgtcgtcctccgaccccgaggtcatcggcacagaagacgagtgcgccccacgtggccacttggacgaagagcgccccaaggacgcgacccctagcaaagaggatcggccccaccgaaaggtgcagcggcccgtctactttgttagtgaggccctccgggacgccaagacccgataccctcaggcccagaagatgctttacgctattctgatggcttcaaggaaactgcgccattatttccaggcgcatcgggtcacggtggttacgtcttaccccctcggccaaannnnnnnnnnnnnnnnnnnnnnnnnnnnnnnnnnnnnnnnnnnnnnnnnnnnnnnnnnnnnnnnnnn

SEQ ID NO: 30776 - DNA, 700 bp, Oryza sativa
  unsure (1)..(700): unsure at all n locations
nnnnnnnnnnnnnnnnnnnnnnnnnnnnnnnnnnnnnnnnnnnnnnnnnnnnnnncaatcacgagagcaaaagttgtggtaagacgctttaaatttaaattcttgaagcattcagaacataagtacataaccattatatatttaggttgcaggagctctttcatcactaatgttagtagaaaaaagtatattagtatctgcatgatgatttgaaggaactagtttaacgatttccatcctttgaaatattgcatgcgaccatttggatgactggtaaactgggtctgtgatgtcattggtttcacagttagtcctatgccttttcatctagacatttgtgacaaacatttatattcacattttttttgcatagttaagttagttaatttttgttttgttgagattatcaatatcgagctgcttattacaggttagtgtccctgaaggaaagaagagggacaggagaaatgacttgctactcatacgagatggaggggaatcattcagaataattgacaaggtactatatgcttttttcatgaatactatctactattgttgttgtagtaggaggcttcaagggctaatgtgggctgtttgtatcagaccaaacgggatgatgcgaccactgtgatccaaagagaggagtgggcaaagtcgaggcaagatgtggagaagcactttaggaagctccgcgact

SEQ ID NO: 30777 - DNA, 438 bp, Oryza sativa
catattgttcggtcaccgacattgggcttatatccctttcaagcatatgtggcttgcagaacatgaccattgtgcatttagcgggtgttacgcctaatggactgatagctgctcttatggtctgtggtttgagaaaagtgaagcttcatgaagcattcaaatccatggtgccatcacatatgctcaaagttgttgaagcccgtggttgtcttttccagtggattaataaaccctaccaggtattctactatatttcttttctgggtatacaaagtaagatgctaggcggtttacttgtgtagaagaattgaagtgcaaaatagttcacccttgcgttttggccatgttcattaactggtatgcacgttattagaaagcagtgtctaataacaggggtggtcttggcaggttgcggttgaaccgtgtgatgtatggaag

SEQ ID NO: 30778 - DNA, 206 bp, Oryza sativa
tgatgctccggaataactagattggctagcaaaaggttaactcgaaagaggaaagaaaaacaatagtataacgaaaggtagaaaaacatgtgaaaaatgcatttgtaatgagaagatcgttaaatatgtaagaaatggaaaagagagagagagagagagagagagagagagagagagagagagagagagagagagagagagaggta

SEQ ID NO: 30779 - DNA, 30255 bp, Oryza sativa
  unsure (1)..(30255): unsure at all n locations
attatcggtctgtgacagtcacagccggtcagatccgggttaggtgcggccaggcggtctacgcacgccttgccccatccggcaaggtgtaagttttaagcacttcccccccccaattgaagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagctccgtcagacatgtataccgcaaggacaacatcgaaccggatgatctagcacggcgtgcgtccagatgagagccactcgaacctagcacctttctggacgtcctgacaaggccatcagtgaaagacgcaagcggcaaagatagcccggtctccctcaacaatagctcaggggctacaaaggcagagcgcgtcgttgccgacattgagaccacagacgactggcacaccccactcatcaaattcataggcagcgaagagttgcccgaggacgacgcaaaagcagagaaaatatcccgtaaagcaaaagtctactgtatgataggcaacgatctatacaagaaggcgccaaacggggtacttctaaaatgcgtctcgtccgacgacggcagacatctcctcctcgatatacatgaaaggatctgtgggtcacatgccgccggtcggacattagtcggaaaggcttttcgacaagggttcttgtaacgccccgattttcgttcgggtttaaaaatcaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaacaaaataaacttccccttcctccctttcgggctcggcccaaaatcctctctccttcccctcccgcggcccggcttgcctcccctttttggcgcaagtcttcttttcctccctcccggcctcccctctcactcaggccgacaggtgggacccgtggaccccacctgtcatccccaacctccggccagctccaaccgccgcccacgccggccactccctccgccgatcccgcacctcccctcgtcccaaccggcgtggacccgagaccccttccacctcgcgaccacatcccgccccactccccctctctccccgcgggaatcaacgccacgccgagccggcacacccccacgacgccggcccactttccctcgaaatccggcgctccccggccctctcctcgcccccttgagctataaaatcaatccccgtggactcctcttcctttttccccgttttcccgagtcccccacgccctctaccgagctctccacgccgatccccttcgccgccgctcgccggcgatgtccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgctgcgttagtcgtcgccgcacctcgccgcttgcgccgtcggcaacgccgtgccaagctctaccccggcctccgctccgtttccccattccaccaccgcaaccacccttccaccgtgcatcccgagccacctccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccggtgagctggctcccgctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcatgcgtggactcggtccacggtgcgcccgccacccgtgagtcaccgtcaggtggggcccgcttgccggcgccacctctcccccgtcggatgacgtcataattgatttaaattgcgcaataaatcggtaataattctagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcgttttgcgtgccagcgtgtagtttccgtcgtttcggaagtccgcggtcgcgaggaaaagagttcagaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgcgccatgtttacttgatatctgttctttgtcaaccttgggtaataaattgactagcttgtgttacttatgtgacctagctagaactatatgcttagccatgcttaattaccactagctcagtcgatgggataattgcagtattagacattctagtatcttgttgagctgcgtgctcgagacatctggccatgttttatggtcgtaattatccaactaaaatgcgactgaatggtgggctgtggatgcatggttttgcgagtcgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtaaaggtgggttggttgggcctgttcaacgtggtgtagcgttgatcagtggagatttaatattactttaattactcaacagttttactgttttgctcaataaaatgttttacaactgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacagttcttctggccaaccgccctcaaagatgcttgcgacatggtttagcggtgtgaagctgtcaattccacagtaaacacacaaggctaccagcgcaagcactccagaccatccctctcacttggccgttctcgtactgggggctagatatactcggcccattcccacgaggacagggcggctacaagttcctattcgtggcgattgataaattcactaagtggattgaagcgacacccacgggggaaatcaaggccgacaacgccatcaaattcatcaaagggatattctgtagatttggattgccccaccgtatcataacggacaacggctcccagttcatcagtgtcgatttccaggactactgcatcaggctgggagtcaagatctgcttcgctcggtttctcaccctcagagcaatggacaagtcgagagggcaaacggcatagtactacaaggaatcaagacccgcgtctacgacaggctcatgtcacatgacaagaagtgggtcgaagaacttccatcagtactatgggccgtgcgtaccacaccgacaacgtctaacaaggagacacccttcttcctcgtgtacggctcagaggctatgctccccaccaagctacgataccaaagtacacgagcacataagtactccgatgagaatcaggaggagcagcgaaatgacgatgtgaatctactcgaagaacatcgcgaacgagttgtcgttcgagcagccagctaccaacaggcccttcaccgctactacgagaaacgcatccgagcacgcacactttcgatcggggactacgtcctccgacgggttcaaagtcaagcagggcgaaacaagctctcacccaaatgggaaggaccgtacacgatcacacaagttctgcagccaggcgcattcaaaattgcagacggcgatggtcgcgagttggcaaattcctggaacattaatcaattacgtaaattctatgtataaatcaatagtatccatacttgtaagacatcttacagcttcaataaagcctattttcaggtacaaactacaatcaaagtgttccttcccgatgatcccttacccagatgacacctagcgttgaaacctatcctcatgtccctttacgccgtcttgacaaggcctccaaggaacctaagggaacttcggctggggacgcccagagccgataaggccttgtcggatcctgtagagatgaaagaccatgtaagatctagtcgtgtaagagttctcgccgtgcgtattaaccaagccgtgtaatcggaaattaactttccaacttcacggctgggggctaggatcagtgcttgttcaaccgaggcaggtcaaaggtctaagagccttatcttccgagacgaattctccgatgataaggctgggggctagggagagtgtataactcaaacgactgatcgaagtcacgaagtgagaagacactcatacacgctacatccagagtaagaaagcttagttagatagatttcttttctatttcacaagtacttcttacaattccacaaaaatccaaaattatattacactttttcctaagacatttgtcacaggacacggagactaccaggaaggccaacgccagtccatggactggaagaccttctccgccagcggtgccatcgacctcgccaggccatctatctccgtaggagttcttcgagaacgagaatacccttcgtagaggaactcgaggtgcagctgcgggcgatgatgtcgtatgcaagccaacacatgccccccggcatatcggctcgatcgacgacactcctgcttcagggcctcgtcgatacgctggtcgatgccttcgagctgggcacaggccccattcagccacgagatgtatccagccgccgattcctcgggatccccacggggtactcggagctctctacatactcttgacatggaggtgcagcaactcttcagatacgagttgaaccacacagcgcgaccccggagtgtctccacggcctggtccttcttcacttccagcatagtcctctcgagtttcgcgacctcaaacttcgtcctctaatactggatgcgacgatcctggtcagcaagcacactctcgaggtctgctcagtatggaaacgactaagtcaaactgctcttctcttccgagaatacagcagatcaagtcgatccagacggaagagtaaaggagatgaaaacaaagacaaccaacctaagggagtcgtcgccatacccgtttccacaggtgaattttgagctacgtcgccatccagcacatgtggctcgaacgcaagtatcggaacgatcactggcagctcaggctgcccgcgctgctggacatcctcgacatcaacatctctacatacgacaacaaagtactcaagatcaaaatgctgaagaaagccaaggtgataactgcacacacaaaggcagttggaaccaatgagagttttacaaagcatgactaaagagtacaaaagagccaaaatcctactcttcaaaaagcgggaggacagactcccccagatcgccgacttctttcatcacatccttgcgcgcgtcgctagccgccccctgatccaagatcttccgcagatcgagttcagggtgcaccagcctcacacacgcaaggacatggcacgccccggtatagatctcgttgggcgtctcctctctgatcatggccgcgtgcttggaggggatcgcctccatcgccatcgccagctccgcaagcgaagtcgtcagcgagaactcatcgggattcaccggaatgatggacttgataccacactccccggtgagttggtgcagactagtgtaggtgacccgcaacgagccacgtatttccgacaagttgttctcgagctccgacatgcggtgctcgagcccctgccgttgtcgctcgttgccggccaccagttccctcatcttctggaggtcctcgtgaacctccgccagatcacgcgccagccggtcggtgcgctcattcgccgacgatgccgtcgtcgccctcgcctccacgatctcgcggctaacaccgcgagcaccagcctcgaggaggtgccccatctcgacctggagctcctcccatgtgaggacggcagtcggcggaccccgaccagccgcgagatcgctggctgggccactcggcgtcacctcgcggctcctgggtacgaccacgacatctgtcgaggccatagtaggggacgcgctggaagtccctccggacccatcttgcgccgctttcacccgcgccgccctgtgaaaggctacaattgagacatgctgcaagagctcgatgaagtgataaaacctcaaagttcacccacttacttctcaccaagcgtcacaagccgctgccgtcgtggaggtgggggggacgcatccgaggcctggagtataacgggcatgatatgaggaggaagtttcccgactacgcgatgaaggacaaggagaacttaccgagagggtgggtgtctttcgacgatgtccgatcacagaggagaatttcctcccctttttcggagcgttgccgccactcgttgtggcagcagcggcagcagtgtcagacgcctccttggcgattttctccttcagcgacgccgccacctgatggtccacgagcggcctgatgatatcagtcagagggagagcctacgcttcataaagtcacaatgcgatcccggaagaaaaatgcaaaagggccgctgagtacacttacattgatggcagcttcacgttcggctgcccctctctcgcaacgggggacggggacgtcgctcgccgttgtcgggccgctgaccatcaattggccgacgcggtgctccacggttgtgctgttcaagcctgtagatcgagaccagaatccgataagtcaggaggaacacgcacataagggagtcaatttaactacaagaaaaataccccgaggagaaacccgggtcgcatcctctagcccagaatagtcaaaggctgggtgggctcgagcctggagcggctgaatccgcctaccaatgaagtcggcagcgacttcataccccgacaacccccgtactcggaggtcatcaatgggatcgataaaaattggagggacggggtcaaggcgggtttggcggtccaaggtgaaatcttgtctggttgctccgttggaacaatgaagaccggatccgaatcttctatctgaagatagaaccacctcccccgccatttgctgtgagataaggggcactggaaggggatgtatcgcgacttcaggccatcccgaaaccggaaaccgacacacccggacacctttttaggttccatccagcgcaactcatagtaaaagcggaagaggtcaagaaacggctctaccccaatgtaggcctcacaaagatgcgaaaagatactgaggaaggcgatggaattggggttcaaatggagcaaggaaaggccgtagaaattcaagaccaagagaagaaattcagaaggcggaggaagaaaatcacaaagaatatagtcctcgatctcaaccatgcgacccaggacatgttggggttcagtacctcctgcttctctctccatggtcccacgaccgggaagggcgccatcctcctgtagcttcttcagcgatgcgctggtggaggtagacttgtcaaggtccattgccgccggggatcgccggagaaaggaccgagatgagctagctagggtttttgctgaagcagagaagacgaggaacgcttggaggctggagagttttttcacaaccagcggacttcaaattggatccccaaaactcccttaaatagtcgcatttccgacggtgcaaattccaaggaaaggagagagattgccgccggaaatttctgggtccgttacgcgtggcagtttttcggacttcaatttaaattcactcatgaccgttgagcttcactgggcgttgtcaatcacttcttatccctcggtcctcacaccgagaacgacaacaacctcgacatcagaagtcacgatcgattacacgagttcatttaagcagaagtcgggggctactgtcagggttacgggtaaggtataccctctacccttcgatatacgtcatacatacgcgtatacggacgttttcggcatacgttaaggaaattcatcatggagttcacagatggaaggagtcctactcggacagaactgggtcatcattttatcgtgccgagtccgatgtctccgagtcctacttggagaccagttaacctgcgatataaaagggacccccgggaggacctaagggatcaaatctcatagtcagcacatccaccacagcctacggagttgaagccaagtcgccaggtgatctagtcgaatcaactcgactacgatctcattggtatcatcgagttctgcttctccttctgtaatctgtggtttccattatataatcccatatcaactggtttagggctattacctatcaaggggcctgaaccagtataatctttgttttctgtctgcttgatgtcgtattacgtagatcctcataccagcgtaccccactaccctctatatccggtctacgggtatcccccgtcgacagtggcgtgccaggtagggggacttggtgctcaaggttctactactatgacatccagcttcgtcgacaacagcgtcaacaccaacctcaaccaaggagttcctacttcaacaatgctggtgtggactcaagtcggcgaaatcgtcttcccggtttacaccacggtgtcgatctcggctgtccatcaatgaccgaagcgagaacacagtggctacaacccagnatgactccatgtcgaaggatcctcccgccgaagcgaagaacggaacgtcgatgacatctgagccgagaaaggatcntagtacgtccnaaccttgtctttccgacaagaatcactagccgacgaggatgatttccgaggtgacaaggtcctggtgtcctatccacaaaaccagaaaacacaacttgcaagcctgctgggtttttctcaacgtccacgcagaaattcgtgcctgcaaagagtgcggaattcagcgtacttctcaaactcgtgatgtatattgtcctattcacaagacaaagaatcacgacctctcaggctgcaaggtctttctcagcgccatgaagacgtcacctcctaaggtccaacagtcacgcatccccctcagggatgaggacaaggaacaaggagcgacggtgatttcagatcgattcgttggggtagtcgatatctatcctcacgaaccatcagtcttgcatctgctcgaagactatggctcatcgtcaacaagtatgccgcgcgaggtattggctatcgacgagaccggcacgtcagcgcgcgctaatgtggaagcggagaatcaagtgactacaccggcccagcacatcagggccgtcaacgcaatactgagggaaaccccttacgatcccgttctgaacgacgatctcgcacgatggacagaacagttgcgggaatcagtgaccaacctcagcaacgcgttcgaggaggccgctactgcagcgcacccggaacagccaccaactggcggtgctaatggtgaaaaccctaaacagcgggaattgcctcatcgagccacccctccacctcgcggcatcaacgatctccgcgatcacctgaatggccgccgagaggcgcgatgtgcacgagacaacgagaacagtttccgacatcgcgtctcttcacggcgtcacgataacgaagaacgaggaggccgtaaaaaagaagaccgagaccgtgataaccgccacaaccgctacgatcacgacgatcgcgaacggcgggtgctggncgatactggtcgagaacgccgccatancgacgacgacgacgaagatcggcgccgagacaccaacggaagacgacgacaggattctcgagaacccgaccgacgtcctcgtaatcgtacaccggaaccaagtgacccatcgtcatcgtcgtcatcttcctcatcctcatcatcagataggtatccacgaaggacgtacgaccgccgacaacccatcgcccccagcgctggttgaagagctttcagtcgttcactgcgtgatgtctgatggcctgagagatttcgaccaggagcaatagagaagtacgatggagtaccgacccagaagaattccttcaggtttactccatggtactctacgctgccggagcggacgacaacgcgttggcgaattacttgccaaccacattgaaagtctctgcgcgttcatggctgatgcatcttcccccctactcgatttcttcgtgggcagacctgtggcagcagttcatcgccaacttccaaggaacttacaagcgccacgcgatcgaagacgacctacatgcgttgacacagaatccgggtgaatccttgagggattatgttcggcgctttaatgagtgcagaaatacgatccccgaaatcaccgatgcttctgtaatccgcgctttcaagtccggtgtcagagatcgctatactacctaggagttggcaacgaggcgcgtcacgactactcggagattatttgaaattgtcgatcgttgcgctcatgcggacgacgcactgagacgcaagaacgacaaaccaaagaccggaggagagaagaaaccagccaaggacgcacccgagtcaagcaagaagaaaaattgcaagagtgggaaaaggaaagctcaagcggaagttatcgcaacagaatacgcggaccctcctaagcgccctgacccacaaggcagcgacgcgaagaaaacatggtgccctatacacaagtcagacagacactctctagaagattgcctcgtcttcaaaaagtcgctcgcaaaacacatgccattggaaaaaggcaagcgagtacgcgtggtcgagaaggacgctgaggcggctactcaggaatcgggctcagcatacccagactctgatctccatgtctcgcacatcttcggaggttccacgacatactcctcaaagcgagaatacaagaaagtggaacgtgaagtctgttcgacgtggcagggagctgcgcccaagatgaagtggtctgagcagaagatagaattctcagaagaggaccaccccaagactgctgtcatcccagggcgatatccgatcgtggtcgaacccactgttcggaatatcaaggtcgcacgagttatgatcgacgacggcagctcaatcaaccttctcttcgctagcaccttggacgcgatggggatcccacgaagcgagttgacacccaccgatcaacccttcatggaatcactactcagtcatcgtccaaaccattgggcaaaattacgttgcttgtgactttcggccaagcaaataacttccgaacggagcagatcacctttgatgtcgctgaattcgatacagcatacaatgctatcattgggagaactgcactcgcgaagttcgtggccgcatctaactacgtgtatcaagtgctcaagatgccgggaccgaagggaacaatcactattcaagggaattctaagctggcagtgcaatgcgacaagcggagcctcgacatggtcgagcacacgcccagcccacccgccacagctgagccacccaagaaagtgagcaaaacaaacaagacgccgaaaccggacggtgcaatcaagatcgttccactctctagtgccaaccccgacaagacagtcaaaatcggggcatcactaggcgggaaataggaactcgcgctcatcaccttcctccgcgaaaatgctaacgtgttcgcttggcggccgtccgacatgccgggggtacccagggaggtgattgatcacaaaatcatggtgcgacccaacgccaaaccagtaaagtaaaaactgcggagatttacaccagatcgaaaacaagccatacgagaagagctcgacaagcttctcaaagctggtttcatcagagaggtactccatccagagtggctagccaacccagtcatggtgcggaaggccaacgggaaatggagaatgtgtgtcgatttcaccgacctcaacaaggcgtgtcccaaggatcacttccctcttcctcgaatagaccaactggtggactcaacagccggttgtgagttgttgagctttctcgacgcttactccggctaccaccaaatcaacatggcgaaagaggacgaggagaagacagcattcttcacgccgttcggggtattctgctacgttaagatgccgatcggactaataaccgcaggaaacactttccaacgcacggtctagggcgcacttagcggccaactcggaaacaatgtcgaggcctacgtcgacaacattgttgttaagaccaagacaagcgactcattgattgacagtctgcgggaaacgttcgacaacctccgacgatatcgcctcatgctcaatccagagaagtgcacgttcggagtaccatcgggaaagctgcttggtttcctcgtctctagcagaggaatagaagcaaatcccgagaagatcaacgcaatcgaaaacataaagtcgcctacaagactcaaggaagtacagaagctaaccagatgcatggcggcactaagcaggttcgtcactaggatgggagagcgaggacaacccttcttcactctgctgaagaagcaagacaaatttgtatggacacaggaagccgaagaggcattcattgcactcaagcgctacctatcaaatccacctgtacttgttgccccccaacctaatgaagaattatttctctatattgccgccacgccatattccgttagcactgtcattgttgtcgagagagagaaagtgcaacgaccagtctactacgtagacaagatatccacagatccaaaaactgctctacgtggtaatcatgacatcaagaaagctacgccactacttccaagcccacagggtcaaagttgtatcctccttccctctcggtgaagtagtgagaaacaaagacgttgtcggccgcattgcgaaatgggtagtcgagctaagccaatttaatgtccgctttgtgccacgaacaaccatcaagtccaggtacttgccgacttcgtagccgattggactatgactgataacaggtcaggcaaccaaattgacaacgaaacgtggacaatggtgttcgacggcgcactcaacagccaaggagcaggggcatgattcatcttgacatcacctttgggagatcagttcaagcatgcaattcacctcaacttcagggcgaccaacaacagccgagtacgaaggactactcgccgggataagagcagcagctgcactcggagttaggtgactgatcatgaaaggggattccgaactagtcgcgaaccagatgcataaagattacaaatgctctagccccgagttatctaagtatctcgcagaagtcaggaagctggaaaaaaggttcgatgggatcgagatccgacattgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgcacctgccccgaccccgagggccgaggtgccccgaccccctgaggggtttgcactatgtacatgggttgggtgagcacagcagggctcacctaaccgcatttattgcgcatcggctaagcgtgtcacgccgcacgaagtgcagtgcagtgcactcgattatccggtctgtgaccagtcacagaccggtcagatcgcgggttaggtggcggcaggcggtctgacgcacgccttgccccatcccgtcaaggtgtgagcttctaagcacttccccccccccaactggagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagctccgtcatctggcgcgccaggtagggggctcagtgtgtgttttctgagctctcagactcttccgcgtgcgccaagtctttcttgttcagcataatggctgagcaaggaaaagcgcacgacctctctccgagtgtgagcggcgacgacggggagccgaatccacgccgtcgagctcgtactcccccacctcctccgcgccaaagccctaagcagggggaggcgcttgagagggttgataaatccgcagcatcaccgatcgcgggtgatgcaggagaacggcgagatggggagcggcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggcggctgcacggcattcggctgccactccctcgtcgacaccctcgactcgggaggatcagcatggggagccggatgcccgcctcgacatcgagcgccggcgtaatagccggcgtactccccgtgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccattaccgagaagtacgatgggagcgtcaatcccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtgcagcgaggcgatgatgaatcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgctccggcgacgagggtcatgtcctcgccgtcgagggcgctccgcgggccacccgaaaggggaggcctgtgagcgacaagaagaaagaggctggtactcccagcagggagcgccccgccggcaggtggtgctccgtccacaacacctccctccacgatctcgcggactgtcgcgcagtcaaaaacctggctgagcgaacgaggaagtgggaggaggacaggaggcaggaacgccatgagggcaagtccccggcggttccttccggcaaacggcgaagtgaggccaagcagaaggcccccgccgttgacatcgatgatggtgatgatgacctaggtttccaagaacctggggccaccatcgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttctcccaccatctgcaacgtgaagttgggacgtgtcctcatagatggaggagcggctctcaacatcctttcccccgcggcctttgatgctatcaaggccccggggatggtgctccgaccgtcccagccgattatcggtgtgacgccggggcacacgtggccattaggtcacatcgacctaccggtcaccttcggtggacccgccaacttccgcacagagcgggtgagcttcgatgtggcggacctcagtctgccctacaacgcggtcctagggaggcccgcgttggtgaagttcatggcggcggtccactacgcctacctccagatgaagatgccgggccctggtggccccatctctgtccgtggcgaccttaaagtcgcgctcgcttgcatggagcaacgcgcggaccacctcgctgccgcgaccaagcccgagggtggtgacgagaggcttggcgcctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccggcagaaagtacggcggcaagccccggagcgtcaagccttcatccgcgaggaggtggcgagacttctagaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaaaacgcgcaaccaagaaactttactttcagatctagcggaaacttttgggaacctccgctccgcccgcataaaactgaaccccgataagtgtgtgtttggtgtacctgcgggcaagcttctcgggtttttgatctctgcccgaggcattgaggccaatcccgagaagatacgagctatagagcggatccgcccccccagcaaacttagggatgtgcagtgcgtcactggttgcatggccgccctaagtcgtttcatatcgaggctgggagagaaggcgctgcccttgtttaagctcctcaagcgctcagggccgtttacttggacggaggaagctgaaaatgcccttgcccagttgaaggcgtatctcagctctcctccagttctggtcgccccggagccaaatgagtccctgctactttacttagcggcgaccccccaagtggttagtgcggcgttagttgtggagcgcgatgaggacaatcctcatcctgcgcacccctactccgtgccgacttggcccgggagcaagcagggaggagaggcccccgagtcaaacggtggcctaaggcccctgacgaccggagacggccctctacccgcttgtcagacggtgctgggtgcccccgaccctcaggaaggccccgaggccactgcgggaaggccgcacttaacgccctctgaccccgaggctaaccctgtgctgactcgacccgggaaagagcaggaagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaaaaacgccccgggggtacggcccctagcgaagaggatcggccccgccgaaaggtgcagcggcctgtctactttgttagtgaggccctccgggacgccaagacccgatacccgcaggcccagaagatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctctcagctgcctcacaccgcccactgggtgatgcagttcgacggttctctgtctctccagggcgccggtgcgggggtcacgttgacctccccaaacggagacgtcctcagatacctggtccgtctcgactttcgagcgaccaataatatggcagagtacgagggactccttgccggactcagggtggcagctgggctggggatccgccgcctcctggtgttaggcgactctcagctggttgttaaccaagtctgtaaggagtaccggtgctctgacccgcagatggacgcctacgtacgccaagtgcggcgtatggagcgccattttgatgggatagagcttcggcatgtacccagacgggataacatggttgccgacgaactctcacggctcgcgtcctcgcgagcccagaccccaccgggcgcctttgaagaaaggcttacccagtcgtcggcgcgacccgaccccttaggggagacggatgcgcctgaccggcccccgaggcccgtcggagtccaggcctcgggacccgaagagagcgctccaagctcccttagattgattgcttggatctctgagatccaaacatacctcacagataagactctacctgaggaccgcgaagggagtgaacgcgtacaacgcatttccaaacgctatgtgctgatagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacggctctcaatgacgcggtcgatctggtccggcgatgcagagcgtgtcagttccacgccaagcaaatccatcagccggcccaggccctgcagatcataccgctgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaatcgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcacccccctcgggtgtgcagggttagccgggggctaccacacatgcacatatattcctttcagcatttcaataaaagcagtttcaaattcctaaaggttgtgtctgtgccgtttttccttctgaaaaaatcttaacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgcctttcgaagactgggacttgggcacgggcccttaaatcaggctaagacacaaaaagaggatcacggcacagatcatcctcaactcattgcatagcaaaataaaactaacacaaaaattttttcatcatttctgattgcagattaagttaatttgtacaaaagagaggcatgaaggccttagaagaaagaaaaagaaaaaagataagattggcgggggcctgggggctcattccgatgcgcccgggtcgccggcctcgtcgccaccgtcgtcctcaccgctggcgtcgccctcctcgtcggagtcaggggcgaacgcgagccgaggggccgagccctcgaagctgttgacgatgtggtcggcagcatccccgacccgcgcgcgcgcgtcgtcctcggtcccgggagggaactcctccagcgccatccagggagagaagctggggtcccgggcctggtaactcgccagcacgagttcgaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggccggcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgaggcgggcggctaagtcgctttcgcccgcggccgccccgccgacaggcgtcctcgcgtccagctccttttcccgtgcctcgaggtcagcagcccgctgctccagtgcggctctctcggtgcggacgcactcaagattgcggcgcgcctgctcctcctgcgccgcctcgcgaagggacaggctgtccgccagccgtctggtcgtggcctcagcatcctcgagagctcgctcccgctcagcgagtgcgtcctcgcggaggcggagcgcgcaatcctcctcggcgcaggcggcctcgtgcgccgccagcgtcgcctcccggagagcagcggcgacctcgcggtccgtcaagcccctctccacggcgccggcgtgttcttctagcgccatggcacgggcctcaagggtctcctcgcgccgccgagacgccgcttcagtctccgttacccgccgctctcgggcagcggcggagtcaaggaccccttgggcggcgttgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgccttgcgggcttcaagctccgagatgtggcggcggtgggccttacggcccacctccaccatggcgtccaccgagcgccgcccctcctcgacacgcgcccatgcggcctcgagctccgctcgttccgcccgcagggcctccacttgggtgttgaacccatccagcactgcggtgtttgcggcggccagggcctgcagaaggggctcggcgctcagcggggcgacagaagaagaggagaagagccgccttggggaaaaggcgacgcggcttggccccccggaggatgcgctgggctcggggatgtcccccgggcccgtttggtcctgggcgtcgcccggtgaggtaggcccaggcgatgcgccagcagcctcgtcgcgagccgcctcggaggatgtcgcttgagggccgcccgagggagtgggcccaagtgatgcgccagcggcagctgtcgcctcagcctggcgagcccgggcggcctcctcccgagcagcttcttcggcttggcgagcccgggcggcctcctcccgagcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgcgacgggacatcgctgaagcagaagaaaaaaccaaaagacgaacaaaatgagcaagaaaaaacttctttttggagaaagatggttgcaatgagagtgagacgaacctgcgagggggacgggtgaatgaccaccttggaggggaaatcaggtttccccggcatggctccgtctcccccgtcttgcggagccgcttctttttgcgctccccctcgggctgcgacgtcggcgcggccccctccgggcgccgactgctggcacgtgtcgccccgccccctcggggaggagatgggggaggtgttcctcccagcttcctcttccccggggcgtcggcagggcggctgctccccgagaccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaaggttcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcggcggaggtaatcgccgtacaccattgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaacagttgtagtaattaatcaatattaaccaaacactgtccaacgctaccccacgttgcaacaggcccaaccaaccacctgaactacaccagttcattaagctaaactaggaatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaatcatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtatttcatgacttgccttgctctcgcactgacgagacctcagcaacgtcttcgagaaaccgtggatcgacaaaacggccgaaacctacgcgacaaacaaagcacacaagcaaaacaggctataagactactgaaacagggaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtggcgccgacaggcgggccccactgatcagcggcactaagggggggagagggggcggctggcaagcgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacggggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgtcggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggcactagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagcgcgcgcgcgggccgggagatgcgggggaagaggcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggaaaggggaacgggccggcccacaaggggaggccgagcgcgggcgacgggtggactgggccgacggcccaagaagaggaaaaaggaggaaacaggaaaaagaaaaagaaaagaaaggattttcctgggatttaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaatttttaaagcaagcaaaaggggggaaacttcagggcgtgacaaccatggccccggtgagcccctgggatcgcaggcccaccaggcggtcgaggacggcgtcgtactcctcccccagatctaccggcgcccgccagctggagacctgcgccgggggctggcttggaagtcggaggcgcgcttcgttggcgagggaggtgtagaaccagtcgctcttccagtcgtcccacttcttgcggaggacgcaggggatgtagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgccccttgcccagcatcactatctcccgaccggtggcggactccggcatgaagcggcgcggcagtccggcgtgcctctcattcacaatgcgggaaggcggtagcacgctgccgtcgagcagagcagagccccgtgccatggcggcggaggatgagatgattgagaacgagcgcgtgtggcgaaagtggggcgtagcagagaaagggttagagctcaggtggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgcgcccacgcttccactaatcccattcgcccgcttacggcgcatgaagtggatatgcggttgtggcattcgaaatggatcgtatcgtgcgcgcgttaattacgctcgccgaccgaagcggcgttaccgtatctccgggcgagacaaatctgctcacccagattcgcgcgccgctcaagtggtgtggcagtcttgaatagccgcccattatggacaaccaaagttatcaataccaatgtgcatggattgagaccgttgggtattttgcccaactacggagaccggtcccacctgtcaccaggctttaggggtggcgtcacacctgaccgcttcccttgggaaggaaaattgctctggcataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggg

SEQ ID NO: 30780 - DNA, 2093 bp, Oryza sativa
catagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaagctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacatgattcttgatagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccaaccctcatgttctttttgagctctgctatttcaggatcacttgcctgagctatgcgaacctgctccaccagcgtgggctgtgcctctagggcagccacgaatccgtgctcaactataccaaggttcagatgttccaaatcgcgttgaacctcaccacatagttgctctacccatgcaacattgcagtagctcttcctgctcaaggcatccgcaaccacattagccttgccgggatgataatgtattcccatatcataatctttaattagctccaaccatcttcgctgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaacgtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaa

SEQ ID NO: 30781 - DNA, 2199 bp, Oryza sativa
  unsure (1)..(2199): unsure at all n locations
atactggtacttgtgaaaatttgtgatttgagcgatgctatttgatttgtaattaagctagctatctcttttttcttggaccgcaatgtaacatcgtgttgctaacttttaaactataaaagtaagataaagaagtaacaaaagtgtgtgcttgctatgtaggtctattattcggagcaacaaagggaaggaatggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgtgtaggttagtcgatcaacctttcacatatcgcccgccctaccaacatcagctgccactgtttgcttctacatatactccagccatccctattactcctagtttaatgccaccaatttctcactatataccgntccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttacaaatcaagcaagtcttgctccctctgaacattttaaccctgctatccttcaagagtcctcatgtgcttcgttcttatataataacaacaatgacacgattgttggtgtaccggagggtgtagatattagtggcaccagggatgttgctggtttacttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcctaggtgacgtgattttagcaaacccaagtagtagcaatgccaatataagtaattgagttggcaagttttgtttatgtcttttgtaagaatgaggttgtaactctttttcttgttgaatataatgttgtttgtttggagagaagaaagttagtcggagtaaaaaaaaaaagaagaagcatatgactatgtagggtgatcggtacttgcgcatgtgtggtccaatcacgagttcattatctgtaattgggacgaagtaaacgcagtggtgatgagaatggcacacgcgtacgtggcgtgggaggggagcagggaggccagcccaccaaccacatcctcctcctgtgtgtgagtcgtctggatggatgttaccaaaataaccaagcaagataggaagggaagaggaagtttccagaagaagggaagggcaagaaaggaaatactactactacacctgtagtgggtgtgggtgggtggcaggcagaggaggagccaagaagcaacggtcacatttcctttgcttaccgtgttgtgttggtctcatcgtctgtctcgctcggcgctcgtctttctcccctccattccatttttccttctcctcttcaaccaaacgaaaccctagccgcctcctatagctaagctaagctccctcccctcctccctctcatccatcaatgggcaagctcctctgcgactcctcctccgccgccgtcgccgtcgccgaggcaccttcccctgcccctgcgcc

SEQ ID NO: 30782 - DNA, 3138 bp, Oryza sativa
  unsure (1)..(3138): unsure at all n locations
gcgcgcgacctcaggcaccgcatcgtccgccgcttctcccacctctacgccgccgcccaagcccccgacagagacgccatcgatgcggccgtgcgccacctctacgcgccggatctcaaggccggctggggcgtccacgtcgtgcaggagctcaagttgctcgcgcccaagaccctgcgccaccacctcgacgctgccatcaacgacctcgtcgacctcggcatccaaaggttggttcttatcatcaatccacaccctcccggatcgatcccctctctcttttcttttcttgcaccctctccaatcgcgcggaatttctttcatgccacctcttgctcctgtttttttccccattgattaataaatctcctccttttgcacatatccctactactattagctttacaattacgacttcaattactactgcgcctaggtcctgcctaaatgaaatggtcaaagacaacgaatttctttctcttaaaaaaaaagtgtcacctacgcgtatgcacatgtagtgggaatcaacttggatatccaaaacttccatgcatgtattagatgctgcctgacctattagttttagtatcgtcatgttgaccaccctgtacagttgtacatcttcatcacacaagaatcccaagttgctatgcatgttaaacaacaatttatgcttcctgctgcaactgtacagttgtaacaacccatggattggagcttgctcaccaaatcaacctgtttcctactatccacctctgtatactagtcttgacgttcactgccttgcagggaaatggcagctgaaaccatatacagggagagatgcatagctgtaacaaatgnagatagttgggccaagtacatgtctgtctctggttcgcaagagnacgagcacaacatatccactctgcagtacacagaggaaggcttactgaccatcgatgaganccggnnatggccatgctgcagcttttggtgatgatattgctatcgagtgcctgccaaccgagttcaagagagaagtttatgtggtaaagcccgtgtgaatgttctgcatgatagtttgctagtcaccatagatctggcacttttatcttgcatctctgtttcatagttttctcagcacttttatctgcaatctaacaggcccttttgtttgtaggtgcaagcacatggagcggatgcaatggttgatgaggacaactgtgtgttcttcctaccacaccgccctagaggagaaatttgcgagccgccgatttttcttttcatgaagggaacaggtaactttgggaatcatttgcccagcaacctagtacgaactgaaaattggtgtctcaacaaaatttagttgctgtctatgctgtcagttgcaatgtgtctggacttaaggtagatgtccaattctttttcttgcagcatggtgtggtgctggtgccgaccattatgagcctttgatagccactgtcctccagaatgttactccagacaaggcagctgttgtactttgaggatgacttccttctttttcgctcccccagttctagtcactgatggagtcgagccaattttgtaatctgagctagattgctttattgaggagcaacgtctatgcccaagaggatctaactgtgcgccgcagggtcttgcctgcttctgaagttgtgtactatgattcgttttgtatgctgatttgattagtgtgtgttttgataggttctgactgttgaggaggagattcagagtgtggtagaatatcggatctagtttatgctgtgaattgttgtgcggcattgtaaaccggcattttggtattgcctcatgcctattgtgaggttttttttttttttggttgcttgcgttctagggacatgattggacatttgagaatgaggatcattcttttcagttttgggctacccgttgttccagtccttgctgttgccacaatctgactggagcggggatgaattgatttgcaaaagagatgtaatacttgttttctcatgcaaattgtaccaacattgcagagggatatggctgctgtaaaagtctcttctttcctttgcaaaaataggatcatccttcgttgtatttatagctttgaactcatttcatgcatgaggaaaccatgaaagaacgctacttaagctcgtgaatctgtcccaaagatcactgtgatttccgagggatgaccggattgacatttttcacttaccatcaatttaacgatgactgattgatctaatcttactcagtaattgctcactccatttgttctgtaaatggcttggtgttgggtaaattatctacccatcccaccatcatggagatgaatgaatcagtagtcatgttgagtggagatgactgatgagtaatcagtcatgttaagtcgattacttatcgtcatcatgaattactggcatcttgtaacggatcccctcgtcaaaataaaagagaattaaaacggggatggagaaacaagagatgttgggtgaaggaaataagagcttgaatggtcagaaatctcatgtggaattagtgtatcatcgcagcggtcagctggctcacaacagttaatattaacgtttcatcactccattcaagcatccaaagcagcactcggaataatcagagggaaagaaaacaggggggaaacaagaatgatcagaaatctcgtgtggaattcgatggttatgcacatggcatcacggatgctgctgcaacctaacgagctcatcatatcatttttcatgcattgaaacagccattcatcctccaatccaatccaacgccataaccataaaacagtatgataagcgagaaacaacaacaattaaaaaggaacaaaattcagaagaaaagacggcagaagaacattgggcgatgggtgaaatcaagacaaaacccatccaatctagtgatccactgtctgttgtgagaaaacatgggaggggctaagaatggcggcggcggcggaggaagatgaaccctagaattggagggagcaaggagggagggagtgagtgagttttataaggggaaggaagaggagtctggcacgtggggcccgcatcccatcgcacaccgtccatttacacagcaggggcggagatattattttaggtgggacccacaatt

SEQ ID NO: 30783 - DNA, 3079 bp, Oryza sativa
gctacctctgcagtgaagagctgctggaggatgttcttggaggcaaagatgccctcaatgctttccgggaatccgacctcaacggctacctcgaagtcgaggtacccttatttcttcgtgtccaacttactttatcttccaagttccaaccaatctagacatagatacatcccttgatttaacacttgtcttctcttgtaaatgatggcagactgaaggcctgaaacagctcacctccatgggcagcctcgtgctttgctgtggggatggtgctgtcatgaactcaaccaatctgtatgctgccttcacccaccattctctcatatctcacatccgccttctcatcaactcttcttatgctaattctcttagagggctactgaggcatggagtctccatttggattgatattcctctggaattggtggtgaatgatatgttgaagacacaagctacttcagaccctgattccttttctgaggttcatctgtcctcctcttgcacaatcctctttaagactgcaaccttcatagtttctcggtttttacacataatacatataactctggctacactatgtccagcaaccctttatttgttaaacaacaatcgactccagcatttgttaacaacagcctgtgaatatgtattcaagtatactcccttaataatcttttcctatgtaaaacacactgcctcccaaaatccacatcctgttgcttgatgcgttgcgagtctaggttgactccatggctggctatatttctgactttgtcgttgcattaaaatgactttattaagagccaactttgttgtcacttgactgcttaatatctgccggtcacatctgaaatgtcatgtttgcaggcaatgagcagagtccgacagcgacacgatgaactaaaagagcgctatggagtttctgatataactggttcagtacaaagtaaacagagagatgcataaacatcattttctttcataaaagtggaaaagaaaaggaaaagaaagcaaattgtgaattatatatatgggtgtggtattattgacttggtggtgaatacctttcagatgtggcatctcaactgggctacagtagcatcgactcagtgaccctagaggacatggtccttgaggtacccccaatcagttagatagataaaagtagtaaaaaagatgttgtagagctggggaagaaagaaagaaagaaatgggttttgcgaaagaaagaaatgttgacagcattatttttgtgtgtattttgaacaacagattgtgaggcaaatagagaggctgatccgagcgaagtcgatgatggaagctgctgggaagcccttctaaaagaaggaaggatccattgatgtatagactgttggtcatgtatgtacctcctgatccctgaggaattgccttagatgttccaggaccaggaagcaaaaagtgccgccacagctactgattgattaattttgtaccgaatgatcaatcattcgattgatatttttacattcccttgtgacttgtgagggagacatatgtagcagaatgaaaaagaagtcgaatttattttcaaaaaaagaagctgtgagtgtggctagaatctacacttgttcatatctatgcttgttcgtcagttgtgtttgtgtcaaatgagcaagtttgtaactgtggacaggatgacaagtgggaactcgatggacaatgcatttgctttggtgcggaggcccatcaaatgcagcccagcccagggaggtccctatcgagtagtaagtgagtagaagaaaagtctgatctccacccacgggcggagttgacatactagtagtagtagtactagtacacgaggagaagaagcaagaggaagggcatccagaatcagatccacaaggcagcagctgcagcagcatcgaccatggcgatggcgcgatccatcctcctcctcctcctcctcgccgccgccgcctccgcctccgccgacgcgcccttcctcgtcgcgcacaagaaggtttcgctctcccgccccaagcctggcgtcgagcgcctcgccgtctccctcgacctctacaaccagggatccgcgtaactactctcctctcctcctcctcctcctcctccgatctctcctctcctctcctcgttgttgcaagggaacttcacttgtctttttcttctcggatctgcatctgaggatccgtcctctatttctatagatagatccagaccccttccatgtcgtaattgccaactaatcaaccattactctgctactgctttcttttctacgcttaaaacaaacaagcaattaactagaaagccaaaagattcactgcatatgctagtatctttaaattgcatgggcttgtgctccatctcatcatctactgttatgtctttcttgccagattatgttatgctaataggattctacttgtaataaaccacacatggtttagcctatttacaatggtttcactctctgttatattcgccttattttgctgaaattacatactaggtgacttgccagcttattcaccctatgccttttttgttccctccatatgttcttacaatgcctgctatcaacatttctctctctcaagtccaaacttttccatgctgcccaaagcaccagctttgcccaaaactaacaacttaactttcttccccgagaagtaataacaatttcaagctaaagttggtagttcggacacaacaacataactgactctttttatgtacagaaatatggattattgctaaattttagcttggaattatttactggatcttggtggaaattctgttaaagattagcttagcagcccatggagaatgagaatgttttaaatattatttttgccagtgtttacctggacaccaacacaggcctcaaactctgccttgattcgcgtgtctgattcggcagaaaagaattgtacatgcaacgggtgcccgaatcctactcagactcaggatgtcagactcgacaaaaaaacatctgccattctgatatgatgtcaaagggtgttctggtttatctattcttttccctgaaagtgcattacctatagactac

SEQ ID NO: 30784 - DNA, 2059 bp, Oryza sativa
acttgatgttcttgctgagaggcctccagaaaagaagtttgaatgggtaagtaattgtgccattgcatgtacattctagtctgtttcgctctatgatcctaatgtgctgatgctgtttatgtttctggcatgcgccgtgtatgaattcttgatgttctctccttgttggtccaggctaaggtaaatttactctttgttttattctacaaagagcaccttttttagtgcatctatggtagaagaaattactgagaaattatccatttgcagaggcttgtgcgaaagtacgggtcgctggtgtccgttgttggcttggttggagtgtttatctacctggttgcaagcccgtcaaaatccagcggtgcaaaagcaagcaagaagaggcgttgatatacttgcctaccatatataaggcagtgtttgttcttttttattaaaaagaggaagagatggtggcaggttttttagattgatagcgcgagagctttaaggctgccgcatccttgaactgtatgaattttctctgtttgtgtttttggaagttgaaaacctaacccagagaattggagagtagattttgtaacagatgaaatctcaatgcatcattttgaagttgcctgatacagatacctattcattgcatttggtaacagatgaaatctcaatgcatcattttgaagttgcctgatacagatacctattcattgcattgtatgttgttgagaatggcgggtgaggcttcacatttatgttgtatgtgccaatgggattgatgttggtagatctcgcttagtaaatcgagaagctaagcttatggatgcgtggtgaacttgtttctgacatgtgagacgaaatatgatgcgttcgatacaacaatctattatgttttcaagtggcgaaaattggagaagaaatatttgagctattagatcatctataaattacaatgttttatattgacaacatagtttgtgttcaacatagcgaaaccgttggtaaaccggtaaaaactggtaagatttggaaagtttgattattttttttttaaaaaaagttgggtaattgtggggtttgttttttctccgagcggccccgttgagacttgagactgtgagctatatatgtttatttattttaattgtacttttgatatttatttttgatacaattgtatactatatggaagcagaatgtaagagtatagatgttatgaaaatctatgctcgcacaaaattatgtgattggggtgcgacatagggaatcaatatatacttcatttacatagggaagtattccatacgtaataaatgaaaaaagaaagcgcgggaaattctaaatgtaacacttgaaagacgctcaataggtatttagtgaggcattttcataacaagaggtaagcaaataaatatagtatagtagtaagatatatgagaaatactttgaagtaagttatcgtgtcatggaagaaaaagagaaataccgaaagtcgtcagatattaaaaatgaaatactccaatgggttaacttagggtcgggaaggggagaggcggtggcgggcggctgaggctttttgttctcctcctgtgagaagagaggaagaggcggatcggattgggattggggatccatccatcgatcgattttgccttgccagttttcatccggctccgattccgcttctcatcctctttccttcccttgattcctctcctctcctctcccctctgagtcgggtcggggtcggggggagtagggtttctctttcgacttgccgcggggcgtgggcgaatcggcgcacaccacagcatctatgccctaagactcagaggtgagccccttgccccgcggacgaaccctcctactcttcttcttcttcttgtgttgctgctaacccatggatcgatggagtttttttctctcttttcaggtgactagctccatggaggacgatgacgatgaccaacgcttgcttcacagccttggtgtcacgtccgcagacatccacgatattgaaaggagaatcatatcacaggtacgctacgcaatgcaatgcactctt

SEQ ID NO: 30785 - DNA, 3198 bp, Oryza sativa
  unsure (1)..(3198): unsure at all n locations
agccgacgaggagacggcgtacgggcactacatccaggcggaggtcgacggcggcgcaagccgcgacgtgatggagttcctcctcaaggaatcccagtcccagtcccaggaggtggtggccgcgtaccgatgcgtcgccaccaaggtcatcttcgtctaccccttcaccactgccgtcggcgattcaagagggcagagccagaggatcaccgccgtcgcccaggagctcggatggtacgccccggacctactcaacgccgccaccaccgacgaccactctatcctcgactattaaccaaggccatacatatgcttgcttcattatctctagtctgtacaagtacaactcgtccaaattcattcatccatccatccatccacgacacatatacaaatactaatctattattactactaagtagtactagtagccaccgatatatatacacaacaaatgtattaatcaaaatgctaatttatttctacgccggccgacgtccttgcacttttggatgatattgggccttaattntcatcgtaggtcaccgagttagcccatgcactcgttactgtgtcatgaaataagcatgtgggcctcacaggtatttttaatttttttaactaacaccagctgacagacatgtagggtgcttttgaattttttgtcccatgtaaacatcatatgggaccaggctggatccagaaaaaaaaattgaggggcttaattacacagttttttcaccttcagccatttagggacctttagtttatcattcatggtgaaaaaaataaaggggtgctctgggggtatccatgggtcttgtgggtgtaggggggactcgagtccccacgcatccacgttggatccgcccctgtatgggactaatatcaactaaacaagccacatatagattaggactatgcttgtatcttcatatctctatttggtttattaggccactttgttccatgtattttatacttccgagacctcacagatcaaaacatggactcatccaaggcccatatgatttcgcctccccatctaattagatgtatagggctagatgtccctcttctttgtagttgtagggccctgtcctgttgacaagaaaatcgaacacatcggcctaggagatctgcttagctccagtgcaggtccaaatatgatgagatgcaggcgtgccagccagtttgatcctacaactgacaagatatgcaaatagtagatcaaattagccgatcggctaacaagccgatggagtagttccagccgatagccgataatagccgatgtcgataccagccgatagcgatagggtttaagcaatcggctatatgtcaaatatagataatgatataaaggcaatcggctgatgatgatgtaatatagcaatataatccagtagaaaccaatcggctcacaaatatgatatagtagaacaagtattgatccgaaggttaaagcacccatcggctggaggtctgatgtcatgaaatccacaagattagattaaacaatgaaacctttgttgtcatcggttaaatccaacttatatgtatatgcaatccttatgagccgatgcaacgttcagataactcaccggctgaaaccccgatgaaacccttattggcaatcaagaagcaggctagacattatggttctaagcatgacttagtagatcaaacttaactgatgcagcactaagtatgaaaagaaacataatatctagacaatcaagctgttgactgattttcagggtggtagatgcctaggctaatttaatctagcaacgcgatttagccgataccggcagaaacactaaagcgagagacagccgatagagctaaattgatatgctaagactagattaacagagacatgataaataggtaggcaaatatatcatccaaaccagagcaatccaagaggtcaaatgtactgatgcagccttgaacgacgccgacgtaaatgatacaattgcttgggccgacggaacttacccattcgctggagatcgaacactgatgcagccccgcgtcaggtgccaagtcccgccggacgataaaataaagtagaaaaggtaaaaggtggcgatgtgccgaattgtattgattgtgaggataaattacataaaccccgggtgtacatatttatacccatgggttgatacaagtccttgtcggacaagaaagaaactttcctaaagataaaaggaaaagataaagtccttataggacactaaatacactttcctaaagataaaaggaaactaacaaactattcctaattaatagataacttgccaagccgcattctctttgaactcggtctcttctagataagcttcctctagtagatcaattttcttaccgaatatagcaagaatccgacaactgacgacttgataactctcattggctaatctcaggacttcgaagccgatgctgactctaagccgatgactactccgggcttaccaaatttcactgttaacatgtcccaaatggggacatttccatcgttggcaaccacacaagtattgagatgattatatatgcaagtaaagaaatatattggagataaaatgatcgtgtatccacacttcactacctcaaaaaacttaataaaacctatggataggtgatcggtaaggaagacgttcctcattaaattatagtagagaagctatctgatttatgcacgaaaataggaaaaatagtaaatttatgtgcatacttatattcgcaaacgattgaaataaaatatgctttgaaaatgaaacaggcggagcacatgacaactggcatatcgtgccaaaccgaaccctccagaaagatgaagtcccaaagcatagaaagcactataaaagtcgacccacaatatgcactaggagcaatcgatggattgagtagcttctctagccttgacctcctagcgctcagttgttatacttaccctctaagggctactaggcctcactcatctcttcgtgtatatttagccttttatgctacccgtggatctctttcgtcattgatgggtataccgtttgtggttgataccagttttataattatctacgggcaaagatgataaatgccatatatcgaaatgacaaggtaattttatcttctccttatgagtttttcaactcaaagttttttttgcaaccaataattagtctctaatattaa

SEQ ID NO: 30786 - DNA, 2758 bp, Oryza sativa
actactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaagaattgcctgtgaagtgaagtcgcccgctgctgaagtcaagcttcccggtttagctcgcttttatcttttccgctgcatttgtaatattttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgtgactcgaacaacgctagtggcagtgaaaagccgatcaatggagcacgtgccaacagtgcatttgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctacaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaagg

SEQ ID NO: 30787 - DNA, 685 bp, Oryza sativa
gttaaggaaattcatcatggagttcacagatggaaggagtcctactcgaacagagctgggtcatcattttatcgtgcaacgtccgatgtctcggagtcctacttggagaccagttaacgtgcgatataaaagggacctccgggaggacctaagggatcaaatttcatagtcagcacatccaccacagcctacggagttgaagccaagtcgccaggtgatctagtcgaatcaactcgactacgatctcattggtatcatcgagttctgcttctccttctgtaatctgtggtttccattatataatcccatatcaactggtttagggctattacctatcaaggggcctgaaccagtataatctttgttttctgtctgcttgatgtcgtattacgtagatcctcgtaacagcataccccactaccctctatatccggtctacgggtatcccccgtcgacaatattgattcttataattaattaatgtaaaactatatatgtgggtttatagaaactaatggtgaaagattaaaatgtttggcttataacatctagaatgacaaattaactcgaaatagagggagtatatagtttagaaatattagctacatgttttacaattagccacactaattattttttaaagtaccatcgtccgtataattatttttaaagtactattgtaaaa

SEQ ID NO: 30788 - DNA, 3928 bp, Oryza sativa
aggccttgttcggttagataaggattcaatctgggtcataaatgataattgtagtaaaaaaattatgatagatagaacaagggaccgagatttatttcagaccggaaattaatttactcataataggaataataagaggtgtggaactaatctaaatatttttgttgtacctaatatgagtaaattggttcccgagccaaaataaatctcgatctctagttatacttattataaatttattgttatacctatcattttcagcctggaacgaattcttcgtaaccgaacaaggccttaattggaattgatgaatcatccatcactccatggctccatgcaactagctaggagctgctgttgtggtggtatactcctgcaaccaacacgtacttgtacaagttggttggtgtagtggaggagccactaccactcgtagtgctagtgcctgcaccaccactcaaaatgccaccaaatggactcgatatgaatgagttgaccaatacacctgtctctctttctctgacctcgattaagaattcttgctgtttgctttcgcttcttggctgctaaaaactgtgataatcctctcctaccatatttacttcgataacgaaccatcccactattttctagccagtaacaaatcaaaatattacacattgattataaatacttatgtgtataaatacatacatcaatatcaacttacttcaatacacaaataacaaatatatttaataaataaatataaatataatgatcatttaaaaataaccttaaaaaaattatatgatcatcattttgtaacggagagagtactatgtgtgtgtgtcaatccatcacatatatgagtaatacattcacgtacgactgttctttgatagctagtaaaaaaaataattcacgactgatacagctaccggtctccttaattgctgatgctgctgctctctcctagtccctagtacattcctcttgtgagggagggaataattaatattttttaggctttgacttatttagagcaagtatagtgaagcacagttagccggggaaataactgaccacgtcacccaaatctgaggtggaagagagagaaatcctaatagagaataggacgagcgattggtgagacgctcgcttgaagcagcagaaccgagataaaaagcttcttctcagcctgctgcatgcgactaagccagcagctccttctctcccatttgctactagtacatgcaagcattaactcttatagccaacctctacgccagttcactatctgcaatgaccttctcaaatgcttaaagtgacatggccaccctattgcgccagctgccgacgaaaccattaaccatgctcttataagttaaacattttaaaaaataataattaaatttataggaaaacatcattgtcggagcgagaatcctcacactccatcgatggctcggggcaccacgggagcaaagtgggagttgacggacaaaggtgacccgaggacaacagtagccttaagacaagctttcattacctcggaacccctacggccgctgcatatgggccatggccccaaggatagcgccaggaggtctctctgaacgaatttgcttcgttaaggagatttgatatccggtcctacgtgtactcccttagcctgtcattctgcattaattgtcgggtaatacagtttctatgaacatatcactggcgatgtgggggatatggccgtgcatgcttcgccttgcttgcccacgtcaccccggagtaaaagatgtgtgacgcgcatttgctccgtattcacctgatggacccctctttttaccaacgtcgtgggctgataggtggacccttcacatccggtcaccctgcttggagggacagcaataagaccaagcatatcaacccctatgggttggggcccttttttttatgcatgcatgggactacggactccccttgacgtataaaaggagcatccgtgccacatagaaagggatcggactcaagcaaagttagtttctagccacattacaatgaacaagggttcatcctctatcacttagacaacgaagaagagtcaatgctctctcacttaagacaaaccaaacatcctcttgtaaagttcattatccatagcaatatcacatgagtatgtgtattatgttttcgagcggcatctgtataaaccacttgtctccaacccacacgcaaaccgagtacgagctcggaacctgcacactaacagaattctcaagggagggtactttgccttcccactagaagagcttattgctttgacaatagcaatatttttaacagaaaacaaacatactatcaaaatgtattttatgctacatttaataaaaataatttgatgtcatagatagtgtttagtttttctataaatttgatcaagctaaaaaattaactaagaaaaaataagtcaaatatggaagggagggagtatgactaaggaggagaaagggaatgaaatcaaatccgattaatggtatgccggatagggccttccctggcccaatccacagcagaattcagcatggagcccaacctcccgtcccccattccccttctccatctcatctcactcccaacactctctctcctcgctgccgctgccgccgccgccgccgccgccgccgcacacacgcgccggaaatgaagaagatctttggagccaagaagagcaaggacccgcccccatccatccaggacgctaccgaacgagtattctcctcgtctaggccatttgctcgcacgccatctctcttagtttgaacatttcctctctatgtgtatgtgattgaagatcaacaagaggggggagagcgtggacgacaagatcaagaagctggacgaagagctcggccgttacaaggagcagatcaggaagacacgccctggaccctcccaggacgccattaaggcccgcgccatcaggcttctcaagcacaagcgcatgtactctactctactcttactcactattctactactagtagagtatttgctactactccactatgcaactctgatgaatgtacgttgcctgtttcaaggtacgaagaacagcgcaacatgctctacaaccagacctataatctcgaccaagtcgctttcgctgccgatggcctcaaagacgctcagcagaccgtacgtactactccacatatatagcccgccttgtttgttcctactgtctccatgtctatgaattattgccgaaccattcttttgtttgttaatttatcgattcctcagatgaatgccatgaaggccgccaataaagagctcaagggaatgatgaagacagtcaagattgaggacatcgatgtatgcttctctttctctttagttgctacttactacagctaccttaccaagatattccttcctcatgtgcatttctttatcaggtgctaccatttgagctgtccccatcctgtgttttgtatcatgcccattccttgaaaaaaacttgctgtcaaatcttttcttttttatatattgaaagggaaaaacctgcttatagatttttcataaccatgcaaacagaccaattgttctctcaaggacaattgctccagtgcagatattttattgggcattgcattcctagtttcagacgctatccttcattacatttcaagctaatctgcaggatttgcctattgtttagatcatcaacacattttacaccagtatatccattgatttacaagaaaaccatacaaaaaccacaattgtcaatcttttttaagtgcggttatcaaccgcccttgaaattgcttgttggactatcttgagtattatcatcttttttcgcgtaaaacgaatgccctgatccacctgtagaatatgcaagatgaaatgactgacctgatggatgtgagcaacgaaatacaagaat

SEQ ID NO: 30789 - DNA, 842 bp, Oryza sativa
agttttgaaaatgctttgggagaaatattgaaacaatttgcagaattaaagaaaaatatagagactggcagtacaatactcttacataaacagtacctgcatgtcagttgaaggattccagtcaggatcatatataataatccggtttgcaccagtcaaattcgtacccagtccaccaactttcgtggtcagaatgaaaataaaaatttcatctgtgttattgaattcatcaataagtgccattctttgctttgcaggtgtaagtccatccattcttcggtattggtattcgcaagctgtcaagaagttctccataatgtcaagcatttgttgtgtctgagtgaaaagaagaacacgatgaccttgttctttccatactttaagaacttgctcaaccactttcatctttccacttctttcaggattcccatagtcaggattctgagcagcatgttctctctcaagtagatcaggatgattgcatatcttccttagaacatctatcccataaagggaatttctgttaccatcaaagatttgttccacctccgaactagcaagaaatgcacgataagtagcacgttgctcagtagttagactacagaaaagaacatgctctgttttcttgggaagctgtgcattgacatcagctttcattcttctaagaaggtacggcatgaccaggtcacgtaggacaacagcacatcgatacgccgtggacacttgcaatggtgttgcattagcgtacccaccaacagtaattggaacagaaaactcagcctcaaacacaggcaggacacctagttttccagggaacacaaaatcaaagagagaccaaagct

SEQ ID NO: 30790 - DNA, 6554 bp, Oryza sativa
aattatttgccattcttacggatggctaaatgatttgttactggatccatatgtctatgtcatagacatatgagaatccacatgtcataaacagcgagtgataaataattaattgtcacatcttaaaattggcatggagttaaatgtcccttcggttgagcacgcatgtcgcactggattatcttagatccttccttcaatataatcgcccgtacttactactccctccgtcccataatataaggtattttgagtttttgcttataacatttaaccacttatcttattcaaaattttttaaaattattatttattttatttgtgacttcctttatcatctacagtattttaagcacaacttttcgttttttatatttgtaaaaaaaaaattaaataagacgaatggtcaaacgttacaaacaaaaactcaaaatcccttatattattaaacggagggagtactacagctaatatatatatatacgtgtgtgtagtacgtgcatcgtatcaatcgccactagctagcaaaactagaggtgtagctagtaatttcttgttgaacatcacaacatgcatgtattgccttcaacttgttgtgcatcatcgcatgcctttcttcttgtcatgccgtgcgtacctaccactatgatgcataaacatcgatcggcagatgttccctctattaatactcctatttcctccctcctaaaatgtttaacgccgttaatttttttaaaaatatttgaccgttcgtcttattaaaaaaatcaagtaattattatttcttttcctatcatttgatttattgttaaatatatttttatatatacatatagttttacatatttcacaaaaaattttaaataagacaaacggtcaaacatgttttaaaaagtcaacgccgtccacgagcgagtattaatcgattcatccatcggcggctggctaccgacaaatcaataactgatgtaagatctatagacatgcatcctccgtatgcagtactagtacgtaggaccaaattaaattgctttgctgcccttgccctgcccggactgtcctatgaacggaaccaaccttaatctcccgattacagtacaaatggagtatcccaatgtggccgtgttcagtttcaaactttttttttcttcgaactttttaacatttccatcacatcaaatatttgaagcctaattacgccatgatttaacaatgtggtgtaacagtaaacatatgctaatgacagattaattaggtttaatagatttgtttcgcagtttacaggtggaatctgtaatttgttttgttattagtctacgtttaatatttcaaatatgtgtccgtatacttaaaatttttttttgacacacgacctaaacacacagcctacattattaatgtcctttcccgtgttgcaaaccccattccatttcattcatcgactaattgatggaacttacttactctctccgtcttatattataacaacctataattagatagaatatttacatgttacaaagattttgattagaaaatttattcatattcattgtaccatctaatatcatatttgatcatagattattatattatgggacagccgaagtagtactccctccctccgtttcaaaatgtttgacaccgttgattttttagcatatgtttgaccgttcgtcttattcaaaaacttttgtgaaatatgtaaaattatatgcctacatcaaaatatatttaacaatgaatcaaatgataggaaaagaattaataattacttaaattttttgaataagacgaacggtcaaacatgtgctaaaaagtcaatggcgtcaaacattggagtacttatttttgttttgttttgcagcttagctgttgttttagtagagcatttgttggttggtcgttcccagcatttgtgcattgcaggtagcacaagtagtacaacctccgtctcaaaataagtgcagtcttgagtttccgcgctcaactttaataatccgtcttatttgaattttttttataattagcatttttgttactatgagataataaaatatgaatagtactgtactcatgacttatatttttaatttttttaaaaaattttcaaataagatgaacgattaaaattggacgcggaaaatcatggctgcacttatttttgttacggagggagcagtagagtacaggcagggcagggaagggcgttggtggttcatctcctctcctctgcttgtggcgcgctcattgaatattgatgctgctgcatgctacctgtatttctgtactactatctacgactacccccattaacaaactaaaatgacagctccgcactgccccaacatcattttcttgtactccatacgtctcataatataattttgagtttttactttgtaatgtttgaccactcgtcttattcaaatttttctttataaatataaaaaacgaaaagttgtgcttaaagtacgtagatgacaaattaagtcacaaataaaataaataataattttaaaattttttgaataagacgagtggtcaaatgttataagcaaaaactcaaaatctcttatattatggaacggagggagtagtattcaattcagatcagttgatttgagccgccgtcgacgatccggccggccgcttgcttcttccatattgatcgaggagacatcacatggatcatcatccaattccagcagatgagaatgagatgactagtactagtccccagatgcagatgaggagaaacaagctctcctcccacttccaaggagatatcgatgatgatggtggtgttggtgttgtggacatccgggggtcgccgatggggtcggcggagctggcgcgcaccggcgggtgggtggcggcggtcttcatcttcgggaacgagatggcggagaggatggcctactacggcctgtccctcaacatggtcatcttcatgttcaacgtcatgcaccgccccttcgccgcctccgccaacgccgtgaacaacttcctcggcatctcccaggcctcctccctcctcggcggcttcctcgccgacgcctacctcgggcgctactggaccatcgccgccttcaccaccctctatctcctgggcctcgtggccctcaccctctgcgccaccatgcccgccctccaggccccgggccaggacgagtgcgacggcttcgccaagctgctgggcaagtgccagcagccgcacccctggcagatggcctacctctacgccgcgctctacaccaccgccttgggcgccgccgggatccgcccctgcgtctcctccttcggggcggaccagttcgaggagcggagcccggtgctggaccgcttcttcaacctcttctacctggccgtcaccgtgggcgccatcgcggccttcacgctgctggtgtacgtgcagaggaaccacgggtgggcggcggcgttcggggcgctggcgctggccatggccgcatccaacgcgctcttcttcatggggacgccgctgtaccgccaccgcgtgccggggggaagcccgctgacgagggtggcgcaggtgctagtggcggcctacaggaagcgtcacatcaagcacaccacggaactgttgtacgaggtgggcggggccaagtcggcggtgcgcgggagcggcaagatcgagcacacggaggagctgaggtggctggacaaggcggcggtgagggtggagggccaagaagaaatcaataacccatggcgtctttgcactgtgacccaggtggaggaggtgaagatcctggtgcggctggcgccggtgtcggcgtgcacggtgatgctgagcgtggtgctgacggagttcctgacgctgtcggtgcagcaggcgtacaccctcaacaccaggggcctccccgtggcgtgcatgcccgtcttcccctgcctcgccatcctcctcctcctcgccctctactacagggccttcgccccgctcgcccgccgactcaccggccacccgcacggcgcctcccagctgcagcgcctcggccttggcctcctcctctccaccctctccgtcgcttgggctggcctcttcgagcgctaccgccgcgcctacgccatccgcaatggcttcctcccgctcttcctcactcccatgccgggcctcagcgcctactggctcctcatccagtactgcctcatcggtctcgccgaggtcttctgcctcgtcgccctcctcgagttcctctaccaggaggcccccgacgccatgcgcagcctcgcctccgcctacgccgccctcgccggcggccttggctgcttcttagccaccgccatcaacaccgccgtcgactccatcaccggcgacatcgacgccggacgcccctcctggctcgcgcagaacatcaacgtcggcaagttcgactacttctactggctcctcgccgtgctcagcaccatcaacctcatcgtcttcatctacttcgccaaagcctacaagtacaggatcaagccccccaccaccccacataactagttcatagtatttctacaccactacagtctagtactagtagtatctgctaagtgacattatattgatcaatcaaacaaattaagggcatccaatatcttcttttttattgatctactcctacatagtgctacctaaactattggagtacgccgatgagttttgcagcatatggcacacgctagcttcaagcgtggtaatgatatatttatcaaccctgctatacgtacgactcctccgtccgaccagtgtgtacgactggaacggctgagcacgtcgctacgcgcagcttctgcctgaatttcgtcaagctaaatccaaagcttgctatcttaatattctgtttttcgcgcatatacacacacaaaaaaaagtacagtgacatcaaaaaccataaagcacgaagtatactgtactgtccaatcattgcataaaaataaacatgctaatgtcttgtttaatctgtcgattgaaattagacttagcatttcgaagcgaagggccaacaagtttgtaggttctgcacgcctacagcccacgaagatcgacgttccgcacgttaacgttgctgcgtactccgtagtcggacaaaagtcggacgatccagtcgtgtgtgtagcattttcgtatatttatgctatatcaactttgcaattgcagttcctcataattgcattattacttgtaaagataataatgaggaggcacttttccacaaatcaggtaagctaattaaaaagtaatccagacttagacattttttgatttttttatcttgcaactgtaactgcggcaattcgtagatacttgatgtataaattattctgagtatactctgttcagcgattcctagttattattagctgtatattgtcagtgggaggctagctcttgcccttttattatgatgggaatatatatccgttaatcagctaaagtcattagcagaaggttctggcgctttaggtcttgctgttacagaacgtacggacacttggctgctgatcgaagcatgtcgatcgtgatgttgcgtagtatccgatcgatcaggtataaggaaatttattgtgtttattccgaattttagttagttttaaattcatatatggactctatacgctacttctaatattccttattttttaatttcgaatttctattttttttcttaattgtatctctatatggactctatactctacttctaatactccttacttttaattccgaatttcagttatttcctaattgtatttctatatggactctagtctcctattctaatattccttattttttaattccgaattttagttatttctaaattgtatttctatatgaactctgccttttctttttctctgattaatgtgagaatttctaggccatgagggcgaacgtggaggctctttttctatttctttaataatataatagatagatagatttctatacttaatttcaagatgaaaaataaaccatggcataaaagtcttgaccacaaaaaacactagagatcgagatggtcgactagcaccatgaatatgcaccgaatcccgtcttaaaccgtccctctttcaccaattaattagtactaaatatgcggccaggaaagttgagatggccgagttggtccaaggcgccagattaaggttctggtccgaaagggcgtgggttcaaatcccactcttaacatcccctttttttgggttttctagtagtctactaggtcaagtatcacaataataataatgtacttactactttacttaattagataaagagttcatcgtatttcaccaagtggtcgtgccggagtggttatcgggcatgactagaaatcatgtgggctctgcccgcgcaggttcgaatcctgccgaccacgttttcctttttcggttcctccaatctcagactgtagattgaacttggggaccccagctgatttagttgcattttgcccttctatttgaaattggcatgcttcattaatcacaaaaaaacttcaactcaaatacctgttgatctgtgtgtgtgggggggggggggg

SEQ ID NO: 30791 - DNA, 4380 bp, Oryza sativa
tgagtccgagatcccaggcacattcctctcagtttcaatctataccgtgatatcccatacatcttggtgaaaaaaattgatgagccagattgaagatcattctatttttatatgattttaatttttgggtttgtacttttctatctaagtccctataatttttatatttacatttgagtccctataatcttgcaataagatacttgaggtctttttttaagaaaaaataataaaagggagagaacaagggtataaaggtgcataaaaagaaaaagaaaaactacaaaaaagaaagggaaaaaagaaaaaaaaagaaaaacaataacaataaaattttgtttcccttaagtggcgaaaaaaaaccgtagatccgattcctataaaaggcaaaaaaaaaagtggtgaaaaataaaggccagatccgattcctttaaaaacggaaaaataaagtctgattcctataaaggcgaaaaaatctgaaaaaacatctaaaaaaattctccctaagaaagtggagaaaaaaatggttcgtaaaaaaatgcacgcgagaaaaaaatggaaagggcgaaacagatttcgatttctaatcagtatatatctcttctctatctctaatctaatctaactatttaaaaaaagaaaatgcacgagaaaaataaaaacggttcaaaaaaatacgtgagaaaaaagcgcaaaaaaatgctaaaaaggttttccatcttccattaaaaaaacgtgcaagaaatattatttccatcgtcggtaaattttttaaaaaaacatgcaaggaaaaaaatgtaagaaaaaatgcgccatttctaaaaaattattgggttaaagtctcacatgctaaccatatttgttactgcacaaaagtagaagtgttaccacataataggtgcatgttaccacttccaagtagttatgttactgcacgataatcgtagttttactatgtcagttttacgagatgaaaatcgaataggtgggctataggtaaaggctgtaggtggcttttagtgaggtctgattgatgtacgagtgttttgaacaattttatacatttggtaaaaccatgttactgcatgtatatacccatgttactgcaaattacatattctgttactgcatatggagtgctaaagttcaaaatgccaatatttgaaaagcaatatctcacaagatatgtattatttttaaaaccgttttcacaatgatgctatagtgttactgcatgtggaggatatatgggttaatgtctcacatgctaaatatatttgttacaacacaaaagtggagtgttactgcaaatgtaagtacacattaccacatgtttatgcagtaacactatccaaaaaaaaaacaataaaacacaattactgcactcttacagtaacaatgcggtgggattgtagtaacgtgcaactgacagtagtaacaagtaatgctatagcattactacttgtgaagagtcaaattctaaaaaagccaagatttgaagaacaatatctctcacgtgatgtactattttttaaaatagtttgcaccatgatgctagaaaaaaagcgcttatcaaaagtagatccatcatgactatattttaacattatttaagtgctgttactacacataaaacgtaatgttactgcacgttgactgtcgcgttactgcaccgttccgcgagacaaagcttaaaagaggtgggtggtgagaggagttaacaagtggtttgaccgcgtttgactgacgtgagatgcctttgaccgacctttgactgatgtgggagatgggtttagccctcgagagagggggtatagaatagctattctatgagtaaatcccttgtatacccatgaaaacttgcccaatctcctctatacccctcaattttactcgatcctctctgtacccctgaattttcgctttgatcccttccatgcccctcccgttaggttttcttcatttcccagttatgtgtaattgcaaatgtcgataatacccttgtagatggaggagcaacagcaggtactaggtagattgaaaaaaaattaaaaaatgttgactgcacagtatgtgtatttatgagactaataatgagtttagaacttttattgtggtattggaaaaaatgcaatacatgaaacttttcgttttgaaaaaaataatagggttggaaaatcaaaaaaattcctcagtacaaaattttggtacagtcaacaggaagcggaacttattgcggacaaaggagaaaatccattgcaaaaaatttggagcatctatacaaaaatattagcaccattaatagcaggaaggaaatgaaaagagtatccatatagaaatttgtgaaacaaaataatccggatcagtaagagcatcaagagcatacatcatcaatcaaaacagtagcaaccatacaaagcactttatcaattttattttcatcatccatacagagcacttcatatcaatctcatttccatcatccatacaggacagttcatatcatactcaatagtgtaggaaccaaaccaactttgcactccatacacaaatgttgcaaatgacaaatcaagttaactgggcagtacatcatgattataatgtcataagatccataacagtacatcactgcatcatgagaaggggatggtggcctcaactgtttcgcttaccgacaccaatgaacaacccactcctctgaacaagaaatcaatcactcatcaactgcaaatgttaaatacgcaagaagaaatttacattgctgctactcgtacgcggtgttgggtcgcgcaacgatgatagggtggtggactttggctgcacgacggcaggacgttggacagcggcgcccgcgacgggagggcggccggcggtggcctactgcgcgacgggacgggtggtggccggtggcgccccaccgcgcgactggagggcgggggccggcggtgcccctaccgcgcgacgggaggatgggggccggcggcgccccaccgcgcgacgggagagccttggacgccggtgcacgcgatgggaggccggtggccggcggcgcgctcaacgggagggcggtggccggcggcgtgcgcgacaggagggcggtggctggcggcggcgctcgcgattggagaccggcggcgcggcctgcgcgtggagaggataggggagaagagaaggtactggatctatttagctagggttcacactgccaggggtattttggtattttttgaaaatactgacaatgtaacacacaggttacgttacaaatcaaacggaaacctaacgggaggggtatagaagggatcaaagcgaaaatttgggggtacagaggggatcgagtaaaattgggaggtatagaggagattagggaagttttcataggtacacaagggatttactcctattctatacaagaccatcagggcaaaaccagctaattcgcacataccagagaacacaaggaaacagacacatatccgcacggcaatttgcaattaacagtctttcttcacttgtctgcacaaagagaaattggttttgtctttaaaagggaaaaactgaattaacctgcaggcttttcaaaatggcaactccctgcccttttatttcttcaagggtaaagaagagcgagcttgaatgatagaggataaacaaaacccaatttcttttgcagcaatacataatagctgcataaagtcacatccaattaacactgatgttccctccaagggtacaatgcaatttttcagtaacacaagggtttcaattgcaggaacaatgatgttgttcatagcacaaatgtctattaatttccaaccaaactgtgactaaggtgcaccctttgcctatttagtcttcaccttttcaccttgaaatgctgcacaaatcttcttccagctccttatggcgatcatagttggtataacaacccacgagctgtttgcaccaatgaaataagcccagaagtagaacgggctagtccagaagttgaagccatccaagtaggctgtaataaagtacaccaggcatccatagagctgaccaagacagacagtgaactggaggatatggctgtaggacttgcccgatgcgatggcatagctgcaagcagcaaactttttgtcaggtcaggtggaaactataaaccacaaaaggctatattatactcatatcaactgtctagggggcaaaagaaactcctatcaactagtacatggaatgcaggatgtacaatagtgaatagtctggcttaataaccagttacatattgatattgacgcttgcagacaggtcaatccaatgtgtaaactaacaaaaaggagaacacaaatattctgaggatagattttataggcatcaaacacatacaattcctatagc

SEQ ID NO: 30792 - DNA, 1970 bp, Oryza sativa
aacattggattctgctgtccacgacgatttatgtcttgtggcaaatgcaacatgcgattggcatgatgtaaaaaaaatgcattcacttggagcatgtatgatggatgcagatacatctaaataaatgaaagatgaatcctttcttgcaaagttaacgcatccacgtcatcaacaaaacttcaaccattcgatattttcatgagccaataagaaccatcagattccccaaatggataaagaacataaacatccttcatgaaacttataccaaaactagatccttccatacccttagaatcgattcttttatatttaccccctcctccctccccatctaccaaagcacgacccctcctctcctttgcgtgctgcgccacaccaccgcctccactccaaaccccctcgtcatcccagctgccgcatcttcctcctatcccccaccgcctccgaagttggctcctcatccccaccgtggccaaatcgaggccgccgctccatccaggccgcaccgcgttcctcatcagattcaagcaccccgcactgagctcgggggcaagccaccgcaagctcaggaatcgctggatccaaaccataccgacggtgaagatgggtggcggcgaggctgaggtaccacatgcatcctctttcactggctgagcagctcaacaattttcctctgggagcaacagagtgggatgatgcgacgccgccatcttccacttcttcctccctatccctgcacttttgcctgctcccacgcatcaggtatgggagtggagaaggtggcagcggcagggagacacccctggaatcgtggatgccaataaaaaattgcttctttccagtttagattgaaatgagcaaatagcaaaatggcatgcccgttacggtaccatcagctcatgagatagagaccctgtgaggtcataagcacatgacttcattgcaaggttagtgctgcctccttcaatgtgttacagtaaaaagttgctcaattgactcacggtgactgaacaatttggaatgaatatgcaactgtccaagtaagatgttgacctatagggatatggtgactcactgtgactgaacaatttggaatgaatatgcaactgtcaattgagatgttgacctatagggatgaattggaaagaagtacagcaagatgactgaatttactgcaaaactatgactgaattatagaagttcataaattaaggttgagtccatgggggcttagataggaggcatgattcgttttggcttgactatattttttatgctctgttaatgattctaactttcctttcgatttaccatctctttctgtttccagcaaacaaagttcctatttaagccttaatgttttgtttgcatatatgcagatccagcaaatgcttcagttaatacttggtttggtggaattcaattttgcatatatttgctgaaaggagttttagttctttattatcgattccccagttttttttcctatgaaagtaactcattttcaattagtacacgacaggagaactatatgcagaactatatgcacatgtggctttgtatgatttctggaaaccttcaacaaagaaagacactgaaacaagatgtacttagggcagtaaaacagtatgctgcggttggatatgctaataccagctttagtaatcttgaaaacactttcctggacaagcacgtcagctcatgaagttctaatatgagcctagcttgccaacatatttttttttctaattccagattgagttgcatttagataggagtatttgggctgtaaatactatttccacaattcccttctaatcatggctgttgccttcctttactaattacaagtccaaaacacagaatttaatctgtctggcaccaaaatacttttccattgcctattattccatttccgcttatgatatgaatttaaagtcagctctgtatgcgaacaaattttcagt

SEQ ID NO: 30793 - DNA, 1509 bp, Oryza sativa
  unsure (1)..(1509): unsure at all n locations
agtctctctctctctctgccaaggacctaggtaggtcaatgcctcagccagatcccatagccataaacccttgttttgttaaagggcattcacaatgggccgacgtggcattcagcctcaacccaaaaaagcgaagactagtattcctttgcctcgtcgtccaaccgcgcgccctcctcagctcagtgggacccacaccaccgctagaggagagaggagagggggcgaagcagccgaactccaggggaggagggcgccgaccgccgcctcgcatccgcccgtcgccgtctcccgctccaagtcgtctgcccgccgccgacatgccgccgccgccctgctgctccgagcagccccgccgctcgggggggagaggagggggtggtgcgccggcgagcgcatcccgccgctcggcgctgtcgccccgccgtcgctccaccactgcttggtccggcgccgtcgccgtctccgcgcgccaggctctctgcggtgggggaaaggaagagaggggggagagagaggggaaagtgaaagagaagtgaaaatgtggtagtccaccatacctacttgtatcgtggtcttgtagattttgcactgtggaacatatggcttaacatagttgttggtctaggtgacataccaggaacaccaaagtgtggagagtggcttgtgggggtgggggcccaccaccttcattccattacacggtcgaatcgaggccccactgtaagtagaaagaaacacaagaagaagaagaagggttaccggcgggcggcggcggccatggccatgcaatggagcatcgacctcgacagggctctccgctcccgccaccccaccccggtcagtactggtacagctacccctcagcaatctcagtcaatctaatctccctagcatgcagccacgccatcgacgctagctattgcccctcgtctccgggacctcggacctagcttcttcgccccccgccttgggcctccgaaccgcgcctgttcgcccacaccatcctcgtccgcctcctcgccacccacttcaccaccgcccacaacgcccgcatcctccgcgccctcctcctccttcgccgcagcatgtgtgcaggaacccaggccgcctaccacgctgcctgcccccaggccagggcactcgcgctgcggatgttcgcccaccaaagccctgcatatccgctctctcattctctccaccttctcttcctccaatgcacggcgccactggtctatttctttctttaccatttaccactacaccagcgcaaagtttagacaccactaattattatgcttatcatttcgcaggtcaacgcggcattgtttgcggctggctgtttttaggctatcagtggatttctcttacattacacttgaagcacttccaaggttaataattgcttcaccaacaacacaagctcaaattatcatggcagcaattaagattttcccnnnnnnnnnnnnnnnnnnnnnnnnnnnnnnnnnnnnnnnnnnnnnnnnnnnn

SEQ ID NO: 30794 - DNA, 3045 bp, Oryza sativa
  unsure (1)..(3045): unsure at all n locations
cgagtaataagcttaattctttttatcaatgattcagccaaaccattttgtgtgtggacatatggaacaaagtgttgaacctgaattcccaatgccatacaataatcatcgaaagcatgggatgtaaattcggcagcattgtccatacggattgattgaatcctatgttcagggtaatttgccttcagccttataatttgagacattaatttggcaaaggcatggtttcgtgtcgatagaagacacacatgagaccatctagtagatgcatcaatcagaaccataaagtacctaaacggtccagatcttggcacaatagggccatagatatctccttgatggcgtacaagaaataaaggggttcgcttttaatttgagaaaaaaaagggtctaaaaagattttcccgggtcacatacgaggagactacaaattgggggattggggaatttggcagtgaccaaatgatgaccaatagagttgccaataatttttctatcatcccgatactagggtgcccaagtcgatcatgccaagtgtgaantgcatcaacattttgaaaaaatactttgtacgtaacatgtgcaatgggcttaatgtatgtatagtacaatcccgatgtgagagatggaattttctcgcaaatgcattngccatatctgttttgttggnntaagagaagaaattcttctcgattatccatatgggtttcaatgtgaaacccattttgacggatatctctataacttagtagggtacgggttgaatcaagatacaataaagcatccttgattgtaatttgtgtacccattgggagtgtaataattgctcatcctgagccaactatcacagtatcgcgcccagtgatagtcaaaactttgccttctctctttttgagagtttgaaagtatttgatctccctaagtatagagtttgtggtaccactgtccacaagacataattcctctccaatcggagtgatatccttagacatctataatgaaagaagaattgcttgattaagaattctttatccaatatatatacatacataaaataattaaaacatcagatacatagtatgacgtttacaaatgttaatagtacatactctaatgactagcaagtcttataaccttataatataagggagtttgtactcatcgacttattacaaccattattgttttaacaaactataggatatcaatatactgtctcaaacacactgagattaaagcagctttatctctaagtgggacgcactgagattacagtaaatctccaagtgggtccgttgagcagtattcgatgagcatgtcatccattgcagaaaatgcagcggtatcctctgggagaagagcgaggttgttctctggttcaataggagcctagtgagaactttcaacatccggtctttcttttgtaagatgaagtgagcttcaaatcttagttcctcagaagactttttcgcctttagggatttctgatacaggagaacaagatgtttttgggatgtggcaatctttagtgacatgatagtcagatccacacctgttgcaatgcctgttgctattgcaacgaggttgtggtgccttacccttctcttttcctttctatcgaccattggatttgcaccttgttgttatgttgcgttttccagtcagattcttagggttattcgaggaatttcccttgaatcctttaagtgcgatactgttggtttagtatcttgtcctccggaaacatagttgatagagttttctctatctttctgctttcgttggctcttatcgcaaaatatcaacttggagcaaatgttgtgaacagcatgattgtattctgccacagtttaaaatcctgtaggcgtaaatgaatccagccataattagcctcatgccaaatgtgttccttttgctgatcataacgctctattagagctttccattggttgagagggatcgtctccaacatgtactcatgtttgagatctttatagatgtagagcctcagaaggaaaaaaggcaatatatagctttctgttctcaactggtggatcccaatcattgggttcctcaattgcatttgaaatcccgcaagaagaaagaaaaaaatattttgatatcggaagcccaaattgggtagttactcccatcgagggcgagttcgtcgaactctatagttgccatgtccctataatcatgattatcattattaattacagaggtaaattaataaaaacatgatattgtggttgtaatctcaatgcgtaatgtaagacttcatattttgtaatgtttcgaaaagatgtaggctatagacctgacaatttgagttagagatcgaaattagatggcacaatgtggataatctccaagtaattaaacagtggagtagatctcttaatagtgggcaagttatacttgctgcctaaaacacggtctccaggcaaatatattctggtgaatataccgcagccaatgtttaggactccactaccttgtgctcaaccaaatttcaaataatctcatttttcaaaacatattctcggaaaataacacatgtgggtaatcattgtgagatgtagacctctgtgagatgggcgggttactcgctgccaaagttatggtcgatatgaccaaagtataggactccatctacatgtgattaatttccgagtcaaagtttgtagtcgaacatgcattaaatcctccattaatcatgttgtacatagttgagagaatttgctaaatcaaaatacaaaatttatagaattttgtaaattaatgaagcgagaaagtagagtgtgtcttgaaatagtatgcaaaaggtatgttattaagacaacaaataaatttagtgaagcagggtatttaaataaacacctatgctaagtaacatataacatcagtggtttacaggaccagtacatagtaatttgtacaactgaactgcttgtactaaattatcaaagatatagggactaataagaaaatgctgctaaattagaaaataaaaactaaaaaaaataaagggtaaatgggtgg

SEQ ID NO: 30795 - DNA, 3489 bp, Oryza sativa
ccaccgctattgtgcggccggcccatcggcccgagggaaaagggcgcagggggcgagggggtgttacggttagaaccctaaccgttcccctcgcggtgtgcgccgccgccgccaccgattggccgcgcgtcctccacctcttctgccgccgccgccatttcgcggcctcctcctccaccactttggccgccgtttccaccgccgcctttctcatccaccgccgatcccatttccgccgccaccttctccccctgaaacgccgccaccgctgcctccatttccgccgccgcccaccaccgcctgcatccaccgccgtctctaccgcccgccgccgccatccaccgtccgccgccgccgcatcccccatgtcggccggcggtttgccggctagagttaggccgacggccccaactcctcatcggagtcggagaccggtcgagcccttacaccgttccccatcccgccatttgagagcgtgcgggagccatggggaacggcgagccatgtggagcggaggccgggacggcgagcagtggcttcaccggcatgacggcgagacgacgatgggttgaagtaggccggctcccccgtgcgcgctgccatggtttcgttccggccggactccggtgccacgggagtgggggagcggcgttggcgtggcgtcggcgacgtcgtggcgcgggtgatggcggggttggagtagcagcaatggtgatgcggcgccgagggttgtggcggcggccactaaccctaggcccgcgcctggcatggtgatggtggcagtggtggcgactcctcgttgtacgatggaggaggtggtgcagatggcgggctcggtcatggcgaggaataccaagaacggcgtcgatcggccaagaacggcgtcgataagtaactgaaggtagacatctcgtacctttcctgttgattctttcgcttttccttgagatcaaaagcgatgtagtttcttctttcacttcgcgatctccttcgcgagagcgaaagtgctgataacatgttgaaagtgaataagattgattgagcgagagggattgagcgagagagaattgcacacaagaatgtagggaatgaatgagcggtatctttattgatcgatgcggtataatatatagatagggaaggggtggcaaccggagacgcgatggttgggaaccatcacgtccgttgccaaggagcgcctagggaaggcgcggttgccttcggttgcgatccatccttttatatggatgagatcaccctgttgtttcataacatgatcaatggatctgacaggaaccgaaaaggagaggatggtcatctggtcaagcgatgcaacaaaatttataactccgtatttttgttactgttctggtatggttcacagttggcagcgttaccggaagcttttgttggtggctatcctcgtggatccacatttggcttcaggatcagcgtctaaagtttaataaatattagtattaggatcgttacatattaaatttgtgaatatgaaccttaaggttaaccaattttgtggtttttatcttcggtataatttcatgagctattatagccttcgacgaaaattgatgagtattgaccatttgaaaaaaaaacattaaagctgagttcttatctccacttctctaacccacatctctcgttttccgcgcgcacgcttttcaaactgctaaacagtgtattttttacaaaaaaaatttatatatgaaagttactttaaaaaattatattaatccattttccaaatttattttagctaatacattgaacacagcctaatagtgttctcctgcccaacattttgtgagtactagtattgggatcattgcacaagaaattcatgaatattaacattaggaaaacagaattcataacttttataaaaaacatgaatatttttctcatgcacaaaatttggtgagcattaaaattggaatcgccatgcacaaaattcatgaatattaacgttatggaaaaaaactcatgatttttattctttagcctgtaatttcgtgagttatagcctttggccaaaatttataagtaataaactttggaaaaaaaacatgtgtggttatttatttctcacccaaaattttacgactatttgccttgggcccatacgaaacaaaattcatgaataataaccttagggcaaagaaatacatgatttttagccccctgcgtattatttcatgagttatagctcatgaattataaaaatcatcgatcatatttttaatgctcgtgaaaattttaatattaaccttttaaaaaacacggaattattttaggcctatggaaaataatattaacgctacaacatcaaattttatgatttttttatccttcaccttataatttcatgagttatatccctcaagcaaaatttattagtataaacctttgaaaaaaaatacatgaatatttatttatgacccaaaatttcttgatatttatctcaggcccatttcttgaatattaaccttattataaaaaaaattccatgaattttagtcggcctataatttcgtgaattatagaatttagcaaaaattgacgagtattaaccttttgggaaaaaagaaacgcatgaatattgctctctgttccaaaatttcacaagtattatcattagggtcgtcgcactaaggagtaaaattttcatgatttctagcctttgcactataactttgtgagttatagccttctactcaaattaaagagtattaaccttttggggaaaccatacgcatatttatctccagcgcaaaatttcatgagtatttgccttgggtcagttcaaaaaagtttcattaatatgaacgtcatgacaaaaaaatcaagatttttatccatcggcatatagttttatgagttatagccttgggagaatatatggcacggatatttattcccggccaaaaatttcttgagtatttgccttgggcccaatcgaaacaaaaaaattcatgaatactaacatttatcccgaactgacccaaggcaaatactcatgaaattttgggctggagataaataccggaggttatagcctccagtatataatttcggtagttatagcctttagctaagactgatgggtattatccttgggggggaggggggatgaatcaattttttttccaaccaaaattttcatggtattagcattgtagtcactgcacacaaaattcgtgaacattaaccttttgagcaaaaggtttgtgatttttagcggtcatccaataattttgtgagttatagccgaaatagtttcgaagaaaaatatgtgagtattattaaccttttggaaaataaatgcatgaatatttttttctcaatccaaaattttatcagtacaactattgggatcgttcgacacaaaattcatgaatattattgttaggaccaaacatttcatgattttcatcgttcgatctataatttcatgacttatagccttcg

SEQ ID NO: 30796 - DNA, 1636 bp, Oryza sativa
aacctttggccaacatttatgaatattaaccttttgaaaacaaaatgcatgaataatgttctacagcctaaaattttagcactattagcattcacaaaaatcgtgaatattagacgtaggagttttttttttccttcggtctataactttcgtgagttcttgccttgggggaaattgatgagtattcaaattttggaaaataaaatgcatgaatattgttctcttgcccaaaatttcaaggatattagctttgggattgttacacacaaaaattcgtgaatatagttattgcgttcggaaagacatgcataaatatttatctccagcctatataatgtcacgagttatagtgttggcgtcacacttcaatttctttgtcatatagtactcactagtgtatgcactatgcagcaggtatcgacatatattgtgctccggcccgttgctgattgattccaggtaagtttggcaaagcgtccatgactcatattgtcatattgcctccatgacaacaagcgaggggaaatgctttaggtgaataaccggaggaagtatccggatgatgtatttgctcctggtctaggtgaatagccttctctggacactgttgtctgccctggaggtaggtttgataacattgacaggtatctggattggcaggtcccaagtacgacggagaggcccgcgcagattagagctgatctataggtaatcacatatgtccataatatatggtttttttaatataaatgtttccgcacaacaaaatttgttcagtgctccctcagtttctggcgccaactttcaatagttgtgagataattaattcatatactgtacctgttgctatataagagcaagttcaatagtatagccaactactagctccaattcatctatagtcaatctaatagcccattcatacaatagttacatactacactattaatatctagtcccacctgtcatagacacactgcgtcttggagtccgtgctacagctggctacaaatctgtagcccgttgctcttctctctcttgatttatcttcgtaaaatatgtttgtagctggcttatagcctgccattgtacctgctctaacgcagcaaagtgtgatgaatgttggtgttgatgatgggatcatgggaagtaaccatgagataacagaggtattgttcgatggagtaagtgtattatatgtatgtaaatattatattattgtaaatcattttgaggagctagactagcgtgccttattaacaaggagatatgtaccattacatgatgattaacatataaatctgtagctacatggaattaaggtagtggagcagaggaggaaggatgatagaagactccaattctccatggatgggaatgggatcaggtggccttgcagaactctccgcccagatcgtcgcacgcctcctcggggaacaccctgcgtgcaattttgtgttttccgatttcagttccagttagttacactagatttcatcagttgggtagtatagtagtagagcttaattaattacgtggtgggctcgtcgtaggataggtagtccctgtcgacttcctccgccgccgcacgagaaacagcaacagcagccgatgatgagagcttggcctctgggta

SEQ ID NO: 30797 - DNA, 1212 bp, Oryza sativa
agggccccatccccaatgccccgcatctttgtactcttgtaaagatatttctaccctatctcttcatacttatcttacctcaattcttacaaaattgcaaaacaggcacagccaaaaaaggacagcatgcagttgatgttgcagtaagaaaacaacctacctccgagatatttcttcttccctccctgttcaccttctcttttctttgcacaatccactagaaagaatactttgtacaatttttaggtggcaagcaagcagaagcaggcaacctattgatgttgtacttgcaaccaagcacgcttccaatgacactaggacagtattccaaattgaaagaaccaccaccaccgacaaagcatcatatgatgcatctaatcaacctcaacccatcacaactcgaaatccccttttctaaaaggcagagtggaagatataagactgcaagctcggtttaacaaatcaaggcgactcatgaagagaaacacatacacagattaattgttcaactgcaattgcatagcaatgggttctcacgtcaatgccaatcacaagcaaaggtacatgaattactgttctaactgcggattgatgctcgagggactgctggcaatcctagctcatccacctgcaccagatagcaccaggcaacattcagtacaagcttaaaacaggtaaactacggaccaatctaattggttcatacaaaacatggttgttttagctgttgatcaacaatgcacctagtctatgcaagaatatttgaacttgggatagtgaacaacagacactgctaactcatgaataacaacttcttaagaaaaaaggaaaggaaaattcatcattcattcctctagtacatacatgggactagatagttctcgaatcatcatgacaaagcaagcatctgaataaaaataacaataatataaactaacctgctgcctgcttactgggactgctgcaggagcggtaggtgcagctggcaaattaagctctgcatcgaaatcggattccttgtctggttgaagatacgatgggactgcacttgactcaaactccatatcagcctccaaagcatccagttctgcaatgttcaagaaacaacgacagtagatagattattatctccagccctgcaatggtcccaggaagaatgaaggcatggcaacaagctaggcaatttatggcatgaatctatgttattacttc

SEQ ID NO: 30798 - DNA, 238 bp, Oryza sativa
tatttgcaggatatgaagaaacatgaaaaactgagtgctgatcgaagtgttcatctgatctataaaaatgtactcattaactcttcagatggagattttttctgtggagtaaacttctagatgtaacgctggagcttgtgaggtgatttagtactgtgaggtcaaaccaaccatatatttgtcgttgcaggcttgtggttccatgaagagttggagctcattctggggtgtcaattga

SEQ ID NO: 30799 - DNA, 15833 bp, Oryza sativa
ttcggttttgatcttgatttggggttgtgcttctgtggatgtaatacactcgtccactgtattgggttattgttagaatcttgatattagtttttacagcacaaactgtgtatatgcgtgttggcggtatgtcagcatttcttttcctttttgtgcttgggtttttttctttcttttttttctgtgtttggttgtcttgatttaggagggctgttgggtattggtcggtcactcgatggagatgtcgtgttggaggctgctggatcggtaccagggtgccgctgaatcggcagattcagtagtagaataagagttgatgttaagctttttgtttggagtgtatgtttggatttaactgaaaccattgcaaaaggacctgccttgggacttggaggagatgcttggagttgtagctggttgatcataggttagtaaaaaacattaattattggatctagttttcctgaactgccattttgtctttttgatgactgtaggtcagtgtactagaatttggccgcgaacggcaaaagagtgtgcgtgcatgattatatttgtaagcaatccaacagttcagttgtgtgcgatgcatacgtgctgctgttggatcttaacagaaatccgtgactgccaaaaaaggcgaaaaccaacgcaggaatgaggagaacaaagtatccggtgttcggtttcattagcaatagtagcttgctgtcgcgggatcatttcatgttgccattttgctggtataaattagccattttgctggtataaattagcaaggcgcaaaggcgtcggagacagcgataacaatcacttgttttaataattttatttttactctgctcttgttttaatacgtcgagatccggtcgttcgttcgttgttatatcagtttttggctccattcagaacagcgtgggtaataagtactcccttccctccatcccctaatataaagtattttgacattttatttgcactgtttgaccactcgtcttattaaaaaaatttgtacaaatataaaaaacgaaagttgtgcttaaaatactttggatattaaagtaaatcaaaataataataatatttttttaataagacaaatgatcaaacaatataagtaaaattgtaagtaaaatgttaaaatctcttatattagagacggatggagtataataatactgtctccagctgactctgcttgcattcatgcagagccacatcactacagcagaggcggctcttcattcttgctaaaaggttttatgatgaggaaacttgctgcaaaggcatactcgttcaaggggaggctacctacaaattctgacctaacccgtactgattgtaactatgatctatatattaatagtaagttaatatcagatctacaccttaaaatataaattgatatgatgagtggagagaacaaagcagcaacatatactaaatatcgatgactttgcatgtcgacaccttattgggtccttttatatttgattgatgatgatgtttcatctattccatgccatgccatagaagtactaactagagtactcaactatttagagaaggaacattgagtttcttttgatatcatcatggcttgtgtagcttggtcttaaatcagccatgacatgaataacgaaaatataataatactattgaggtagctctcttccctctcttggtgaaaatctcttgggcgggagatggcggtgtccttagtgtcgtaacctttatggaaatgttgtttacgaagagttcgctatgtggttttggaggctcgccagcgatcggccacacatagcggcgaccatgctatgtggttttggaggctcgccagcgatcggccacacatagcggcgaccaatttaatttagtgctgggcttcctcctcaaggtcatacgtttgtgtttttagcgcgtgttttgggtgcgcttttttttcctcaatcttaacggtatttggatgacctcctgggaaaaagtaaaaagtaatactaatacaatatggtgttgtagaaatgtactacacaatccacaacactacaaaagatccacgacactacaaaagagtaaataacacattaggaaaagttattgtcggagtacatgactcctacaatggggaagcgtgaacccgccatgaaagattcggtcaaggggcgagtcaagcctgagtcaccctcaggaatcaaatgggcacaaaaaaaatatacaggttcgagcatatacaaattcgggttgtgcggatgcgtaacatcttacgcctgtgtgtatatggaccatacgtgatcaaaacaagattacaatgagatatggatcttgtgtgagctctaatctccaaggagtcaaaccatttatccgttaacatggatcctccttttatagactaaggaaagtccatagcgccaacaaaaatatagaagcggtttccgtgccaaagagttgggtatgcttggacttgttgatgtcccctacgacaagctggttggatgttacaactttgctctccagttgacacttagcgtaggagccaggtgatctctacccattcaccatggggcccaccagtcggcccttgcgaggtggcaaggttgaatgtgctagagtgatgtgggcacgacacgtcatgccccttctattcctctagcagacgtgggcatgcgggaggctgcatgcagcgttacgtcactgagatgtaggtggatgagctgttctccaaacggctcccttctacaacagaaatcatgatgttggattggagttaagcccctaggtccatctagagaggcggagaaaaccccaaagtgagcttagggcagtggggtgtgcttggagcccagcttggagcccctaaaccctatactgcaccccagggtaaccctcgctcctcggggcagtcgtctatccggaacttatttccatgcccagggaacttagtttccttgggccctcggtgacctctctccatgtttcttcataggtttccattgtactttggatgagtttcttgaagatgtcggtgatgaatgagtttatagtgatcacctacgtcagagtggctcgaagcagttgtctgccgcctcagcacattgaaaatgtagatcttgacgttcttcttgagatcttggatgtgtagatcttatacacctcttgaagatgttgatcttgtacttcttgaatatgtagatcttgtacatctcatgttataacatatatctttgggtgccctgacgactccggaggacggggacccctattctcattcctccaatggttttaaactagactaagactaacttaatatattcacttaacactacaaagtcttgtggtgtatgcatactatcaatcttctcctttgcacgggtatatgtgccttggccaccaccactactgcccttgatggtatccatactagcccaagggtgccttcatcaacacctgtttctagggttagggtgaaacctgcatttcatggcacaatatgcgtgttgcttcttgatatttctctcgtcagagtgtcgagattagggggtggaattgtcaagttagaagtgatatcttcttgttattgtttcccttagttgtctgagatagccacaaggataatcatgaaataattgatcaggttttgtggcaatagatagttcgtatcaatctgcgaagcaccgcatggtaaagaactagtcattgtgagaagagagcagcttgtcgacatcctccctactccatactccctccgtttcaaaatgtttgacaccgttgactttttagcacatgtttgaccgctcatcttattaaaaaaattgtgaaatatgtaaaactatatgtgtacatgaaagtatatttaacaatgaatcaaatgatatgaagaggataaataattatttaaattttttaaataagacgaatggtcaaacacgcattaaaaagtcaacggtgtcaaatattttgaaacggagggagtattatctcaatctcacatgtgagctatcgatccaaattgatgaagtttacagcagcagcagtaacagtttgtttttattcagggtatagtctatttatttattttcttttcgtatttttttgcagccagcaatgggtgcgccattggcagagctgttgcaaaagaagaacaaacccaacaagaacccaaaaaaaaggagagagagagagagagagaggaagaagcaaagcacgggcaccggtggaagcgaagcgaaagtgaaagcatagagagaagagaagagccatgccccatctcgccgcctcccccacctccgccgccgccgccgcccctgcctccgcccgcgttgccttcctgcgccctggccgcgtcccccgcccgccgctgcagacagcgcgtggccttcgcccggacttgggcaccctgcgcacggcggagcagcccacgttgtacgacctactcgggatctcctcggagggcaccctcgacgaggtccgcgcggcctacaggcggatggcgcgcaagtaccatccggacgtctcgccgcccgacgccgccgccgagaacacccgccgcttcatcgaggtgcaggaggcctacgagacgctctccgaccccagccgccgggccacctacgaccgcgccctcgcgcgcggcgtctgccggcttgccttctcctcctcccgccgcgtcgccccctactactaccaggtacgtttcgtctcctctcctctcctctctagtgattttgatttgaatttgtccccaaccttcaacacaagcccattcagtttctaacacacaagccccagccttacatgatgtttgatccagcagcctgacttaatatgtctgctccatcttctcccccattcaattcaatacttgattgcaattccttctatctttcttgtatcaccgtcgtctgcagcacataactcaatattgcgcctgcatgtgcttgtgtatttgtacagattttggcttcatatatatatatatatatatattattgctcaagttcgctggatcaattcatcataactctatgtaggatgcgagtagagatttaccttttgttcaggcactagcagtgccatacatacaaataaggaaatactacatacataggcattatctcttgcgtgatgcatatagggatgcaaaattcaccctgatgcaaattatatgcatgtaggtgatgaatagtgaatgaacaattatacttacaaacaaaattgaaaaaaagaagtctttttcgtgtgcctcatagttaaacttatccaggacataagttagagaggtcgtgtcttccgtgtaaggttgaaactgggagaagctttgcttgtttggctattctgttagctgatttctactttcactcggttcatgatgttgatccgcaagttggtaatttccatttggattgtcaaaccattgtttcatatgctgttttttccatgctaacttgccacccgtgtgactcaaaaccataggatcaggaagacaagtctggctggaggagaacttggggagaccaaattgaggagctgaagaggaggagcatgacgaaggattcagaggagaacctctcctggggagctcggatgcgaagaagaaccgaaacatcatcctctgagtaactgtgatcgtaatgcttccaaagtgtaaccctagtggtatatcttttgcatcagctaaattatcataagctgttaacaagtgcaaggttagaagggtgtgctgtgctggtattaagctgtgcattttgtatttactcctacaaaagatgatgcggcaaccctatgcacaaggaatgctaagcactcctctactatagatattagtggccattctagtggtggcatagttagaagcccgtatgggggtatttgtgtcagtatactgtatacccaacccaagctatgaatgaacgatgaagtgaccaagtatgatgtgtatatttgcgtaggaggctctgcgtttccttgtgtgctctagtgtaaatatgggatatgatatcatatgagcaacttgtcaaaataagcaaagctaaggtgtatcttcaattttgaccatctactatttgtgtgttgtgccttgagtatcagggattggactagactgaacgatgaattggtgacaaaatcgtagtaataacaaaagatagttgatgtcattttcacttagcaatgaaaggctgggagggactgggagactgcctgcctctagtagttgtgaatgaatcaaggggtggtccactcaatagttggagttgagtaaataatgtgcaccagtctacatctgctagtctatactagaatccattctgacacttgtggctggtggtaaccggtgagaatgtggttttcacagttggtattttcttaaaaaaatgagtgaacattttacaagtggtcactgattaaactttttcacaaatctggtatcatttttatataaactaaatgataccctgcttttgtgatggaaaagcagacggaatatatggatgaatatatattgagtattatacaaacaatgaatagatatgttgaaatattgtggaaataatgtgaggtgtgatgattagatatatttgcatgttgatttgttgaatttaataaattataggtgttgttacaagcttggatatatagaaggtatagatggcatcacgaaatttggtcagtgtttttatacttcttaaaaagaagggagtggtggttttggtgaatctgtcaccgcccccactcgcattgtaaattttgcaagttaacccctaaacttcttataatattaaaggagattaaatctaaatggatagtcacataaaaaattagaataatatgaatatttcctatagcaaaagaatgggtaacacattaatacattttcttttatctgtagcaaaaacggaaagccaaatgtcatagctggtctgggctggactaggctttgtgatggaacggcccatataaaagcctcagtcagctcgtgggcggcttttgggcgcgacccttgcttgttttggcgccaagcgaaccagatttggcgccaaaatccccccgcccgcgccgcttcttctccctccctcccgcccgcgaatccattcagactgcaaactctgagagagagagagagagagagagaggccatgcccacacagcacctgacctctcgccgccacgctgagctactccgccatctcctcctagatggcggcgccgccgtgaaggacctccgtctccgccgtgtcgtcccgctcacctccgcgccccttgacgactcctcccccgacccggccggccctgctgccaaatctggatctgcagagacgacgccgccggaggcccaagacggccgggagcgaaagccggtaagtcttcccgactcccttcatcttcatcttcatctcagacgcacaataaaattcgttctagcttagcttggtgttggtggccatctcatctcatctcatctcatatgtgttttatccgggcggggcggattaggtcgtccagcggtcgaagctcgtgcacgccccggcctccttcggctaccgccgcttactgcctttcctcaaccaactgaccaacaccaaccaaggtagtactacaacaaacaccattctcctcctcccaactaaattaaatggcccttgtttcttcttaccccattcccttcccttcccttgcgttcgtgtggttcagaatcagaatgccctagtggcaaggacaactccaagattgatgcatatgccgaatctgaatctgaagctcaacctgatcctgtgcattgctctatcagcaccaccaaggaagaaatcaacatttcctcttctcatctttcaagcaccaagatggtgagtactgtctttgatgtctccttttggtctcccttgttatgctatattcagccagatctattcccatctcctcttctcttcaaaataaccttgtattaaaaatgtatgcatgtatgtttcagtgcctttcccggtgtcagaggtccaggtttgttcaccaccccagctcatttagctacaagaggatgctgccatttgttacggagaacggtacgatcagatgcattctcacatgacgcaactgtctacttagttcagggtatcacatcgccaatttatctcatcatgtgctactgtctactttctcagagatcacttctcaggaaggtcacaggaccaaaattccaagactcgtacaagaaaagcaatcttcaacggatgagaatcttatcttgaccactggacagcatcactttgttatgtcaggagactctgctgaggaatgcaaaacagctcaagtcgaaagattagtagaagaaaacgaatcaaaatcagacaggattcatcctcttggtggaaggctgcttcagcctgctgtttctgaagccgctcatctagaactacaagtcagtacagttgaagggcaaaatctcacacaggaaagagtgctagcttcagatgcacaccttctatcttcagacaagggtgagtgcacattgaaatggaatgatgtcctgcctgctggacagcatcagcctgctgcctcagaagacttctctgaagaaagcaacaaagcaggagttgaagcagtattagaagagaggaaatcagttccagacggaaattctgtttttgatggcagacagcttcagacttttgtttcaaaagcttctcctccagaaggcacagctgaaatgcagaaggccacacaaaaacaagcagtgacttcagatggtgatgacgaccctctagactcctgcaagggtggatctcttgccaaagagcagcctctactgcatgctacagagttgtcagtaaaagataatgctgaaggtgatgaggtacatcaatgccaaagcccagagttgggaacttctgatgtttgttttggtggtcctaccaaggttgtaataccatcagtgaattcccacaatgcactagagcaatgtgattctatggcttctctagatgaaccgttgcttgatgtggagatgacatgcattcctttggacccttgtgctactggtgtgccctactcagtgaaggaaacgcctgctggtgttctgtgcacgtctgatcattgttccactggcacacccttaacagtggaagaaacctccagttccgtttctgttgtgcacattgagccaatgtcaagcaaagtcagcccagtacggcaaagaggttccccttgtttggaaaaacgaggcctttcccctaagaaactatctccaaagaaaggaatacttaagagacatacaagggggtgcaagggaatctgcatgtgcttggactgcagcacattccgtttacgtgctgaccgagcttttgagttctctaggaagcagatgcaagaggcagatgatataatagataacttactaaaggaggtgtcaagtcttaggaatctcatggagaaatctgctggccaagtaagtgtgatcactggcacttcacttttattttcttgtccttacaatgatcaaattttatagtacccttttccaagggaatgaaatgctatcatcttattttcctgcttgtcttttacattaatcgtgcaaattcatcaaatttaagcacttgagagtcaagatcaggctctgtacatatcaatacatggggtggtagaatgtgataaacttttagcaatcctttttgagagaacacaaacaaaatggggatatcttctcgtacatacgtggaatttcttgtttagatcgatgatgccttgtattactatcttgtccaaatatataagtagaagaagttggtagggattgctttgtgcagtgaacgtatatgtatcagaatacatgcatatgttcagtagacatgaatggcagaacgcgtttgatgccataatttatcatttctcaccaggaccaaaatttatgctatcgtaattaggttgtctctggctctgtcagttcttcctgcatattactgatggacactttcactgcttgaagtatgttgattgaaatatgaaattgagagaatcctgaaattgacaaaaaaacactttggttgagttgcagcaggagacaaagcaaacagcctgccagcgggcgtcacaggtggaggtggtggccagagagcgtcgtaggcagatgttgatggagctgaactcacattgcaggatccctgtgagtactgtagctacctgctctaccgataatcagcaatattcgctttaactaaaagtagtagcagtgggaattcatttgtttgactgtgactgactcagggaccaagggtgaaatttgcacaatatgttgaagagaggatggcgtcgtctccatcacctgattcacctagcaggagaagataaacaggggaggatgtgtcctgtctgatctatccagcttacctggttaatttttgtgtagtgcagtgcaatactcctacttggttaatgtgttgtagagggtgggtggtctgtttttggaggaacagcatgtcatgtgcatcctttgtttgacagaaaatggaaggaccatgtgcgtggcgtactagatatattaaatatttattattaccaccagtccagtgaaatagtagaatgatactatctatatacacagttttgagggaattccgctgtttttttttgtttctttttgtagaagtacaatataactagtaagtagtagtagcagcaaacatgcaaagcgtaatatatagaggagtgaatatgtatgaatgaatgaaagagaaagaagggagggctaggctagccggcgtagaggtggaggccgacggcgaccatgaagatggcgcagaaggcgaagaagaggagggcgtggacgaagatggaggcgacgctggtgcgcatgctgtggaactcggcgacgcggccgttgctcccggggatctggcacagcaaccccggcgtcagcagcacgaacaagaccaacgcgatcagcactggaccccaatcaccagaccccatcttcttcttcttctcaggcttactaattccttgtaggctactagctgttgctgagcagtgtgcactgcactttcacttcacttcactctggtatatatgctgtgctggctgctacaagtacaggtgcaagaagaacaaatcatctacaagtatatgcttattgctggacctggacgatcgatagatgcatgaatcaaatggccggcctgccctgacaagtacgcctgctagtactaaatcgtggagtaagaaattgttgaggccggcgctggacggcatatccaattgcaacttaggtacgtatggtatagggacaacaatctcaaggacagcttcgtatcctccaaggcaccagatagcaggcccagacataaaatataagggatgtgtagtattcattaagtaatctttcataaaaaagaaacatgagcaaaggccacccatccctcggtccctctctgggctgaaaatctgtgtgatatatatatgatcatcgatatacagtaattaaactaatggagtactccagtagtaagtatatgggtaggggattggattagctaaggtaggtaattaattaaattaataaagagactagtttagtgtactacagtaggtaactaagggcagcaggtggttgcagtagtgagggatggtctcatggttacaatggcggagtcgtttgcacctaagcgtttggcccgcttgctggcctccaggaaacttttgacggctcgcctcacatacgcatccgcctgcttcaccgtcatcgtcattctcgactcgtactcctgtgcgaagcttgacagcatgtagtcgccgttgaggaaggccgccagctgcaccagctcgcgctggaagttcgacagccatcctccgtcttctttctggtcgacgacgacgaggaagatggcggcgggatctccggcaatgtctccgggcaatccgtccttggctcgtccaggtccgtgaagaggtgctcgaaggtgcccgcccacgcattcctcctggtgaggaagtcggagctgaggttgaatatcttcttgatggtggccgggatggaggagtgctcgtactcggacgtgggcgttggccctcccggcggcctccccaccaccgtccctttcctgatccacggcgacaccatgatggtgggcaccctgacgccgaggcggtcgaacctgaagaagaagggcagcgggccacggatggcgtcggggctggggacgccgacattgggcggcgggacgtggtcgtagaagccgccgtgctcgtcgtaggtgatgatgagcagtgtgtggttccactgcgggcccgcccgcagcgcctcgtagacgtccttgaccagcctctggccgttggcgacgtcgtgcgccgggtggtcgtcgtcggcgggcgtgccggtgaggtcgaagtagcgtggctcgatgacggagagcgccgggaggaggcccctgcgggcgtggtcgcggaaggcggcgtcgtagcggcggaaggtgccgcgggcggcgttggcgacggtgcggaggcggcggtagaagagggtggtggggatggtcttgaagtagacccggtagtcgagggcgtcggcggcgagggagtcaaagatggtgcgctgcgggtagccgcggaggaggttccacttgtcgtgggcgacggcgccgtgggaggtggcggagtagaggaacagccggttgggctgcgtgggccccgggatggaggagaaccagcggtcgaacaccgcgaaggaggaggccagcgcggagaaggccgggagccgcgacggggtgaacccccgcatgacggcgtcggtcaggagcgcgctcacggagacggcgctgcggacgaagcccgacatgtctgagggggaggcggcggcgccagtagagtcattgggtcggaaccccagcagctgctcgaggacgtcctcgaaggcgtgggcggggtcgtcggggacgacgaggtcggcgtcgggggagacgcagtggaggagggagtcggctggacctggtcctggagccgggttgcactctgcgccggtgaggccgtcgatggggaggcccagcagccgctgcatccaccccagcatgtggtcgaacgaccggttctccagcgccaacaccaccacgttctttatcttggaatccccattggaattgggtgcctgtgccagcattaggaagagcagcaacagccgccgacccatggcgccggaatgcccgtgctgctggagatgccgtcggtgaggagagagcggccacattactagctagtggtgtggagtaccaagtacaacaagctagagaaaaagaaaataaaagatggcggtggatcgatcacttcactagtacagctgcatgcgctggcttcatttggcgccactcaccacctgctcgtgtcacccactgccaagtgctactgtcgatgtttctaccttctcgcttaataacaatcacgatttctgtattaagtaaatactctctctatcccatagtataagggatttcatatagatatgacgcattctaatagaatagatagagtgatgtatttctaatagaatagatctgtatagataaactattatagagtgatgtattttatgttattaattctagtacaatatatcttatttattctttatactccatctgtcccaaaatataaggaattttgagtggatgagacgtattctagtactataaatctggacatatttactgtctagatttgaaatattaaaatgcgccataatcaactaaaactccttatatttatagacagagagagtaactatttaaatggtacgtaagaaacaacacgagatgaactcataaaaatacttccccactgccgcttcctttagggagcaatgttgttctagccttgcatatggatgtggtggcgacagccgaatcgattatgtatgtactccggcgaagtttgttgtgttgtgccgtttgaagatgcagtggccctgtagttacgctgcatgtgacaggtacaaacaaactggccgacctacatatgtcaaacagattgcccgccgttgttggttcacgggcttattgagatgggattggaacagctgcccacccgttctctcgttaattgttgctcctattatgtacaagtattagctatctgcctatctctatctcagagactcagactgagttcctgcttctgttctttgtttcagagctggtacttagaaacctgagttttattctcagcccctgtttggatcccctcaaatttttcatcctgtcatatcgaacgtttgaacactgtatgaagtattaaatataggctaaaaaataactaattaccaaattacgactaatttatgagacaaatcttttaatcctaattgctccatgatttgataatgtggctacagtaaatatttgctaatgatggattaattaggcttaataaattcatctcacggtttacttacggattctgtaattagtttttttatcagtgtccgaacaccccatacgacaccctatataatattcgatgtgacacgccaaaactttacactcctgatctaaacaccctctgaatgtctgagacagtgcccactctgtgctataaactttgtgagtgagtttttacccagcgctccccccgtttgggctttcaatataagctgggtctctgacctctctaaaaaaaggtatgtattacaacttaattgataaaacaattacattacttatacaagtagttgtagaaaatactacatccatctaaaaatgacgaacgtcataaaaaagcaaagggaggatcatgtgttgtcattgataaaaaaaagtagattaaaaatgttcaatccgatttaccccatcaactatcgtaaaaagatagatataccctcctcaactatggtatgtacagggatgcacgtgggccgggttaacccatgtacccagcgacccagcccacgatacatggggtcaaaacctcgtgggcttatccatgaaatttcatgggtcatcatgggctgacccttctgttaggttacacatcacagtaccaggcaccagctgcgccgctgccgcctcacactccgcccgtccgctccagcgctctacccctccaccgcgtcgcccaatctttgttcaatattgagtgatataaatagctgtaattctaaaagagtgtcaaaatctaccaaattattaacttattttgtttgaataataagtacgttaatgatgcatgttttctagctgctcatttgatgcatcatgcttgctgatgatttagatgtgttgatggatagagttttctgtgcctggagaatcgttaatgggttgacccatagtggctccgtgggtcagcaagtcaggactcagcgtgggtcgcgagtgacccatggcctgtaattcattaccctgggtaacatgggttagaccgtgggttgacccagaaaggcccacgtgcatccctaaattattgatatgagatgactttacaccccttatatttttaaacatgacaaaataaccctttagccgaatgcaagaaagtttcacctcctatctggtgacgatcagtccacatggtagcggcgtggcagtcagttagctgtttcactcttctctcccccttcccctcttgctcttcacatgtcgcattacttccccacggttgggtgcaagttgtttcgctgccagatcgatcagtgccagcccagggcccgggcagggcgagcagtgcggctgcgccgaggtgccccatctcagtatgtatgtgtattgttgtttccatcactaacttaatcgctattatttccttgaaaacatatactacctcagtcccagaacataaaaagttttagagttggacacgattattaagaaaat

SEQ ID NO: 30800 - DNA, 794 bp, Oryza sativa
caaaatcgtctatttatgcagttgatggacgtagtgacagcatatctttatgggtcacttgattatgatatttacatgaaggttcttgacggaatcgacatcccgaatcagaaggtaaatcgtaacatgtattgtgttaagttgcagaagtcactttatggcttaaaacaatcgggcaggatgtggtacaaccgattaagtgaattcctttcgctaaagggatacactaaaaatgatgattgcccgtgcgtctttatcaaaaagtcccccacaggattttgtattatctcggtatatgtcgatgatctcaacatcattggcaatacacaagatattaatgaagcacgtcatcatttaaagacggaatttgagatgaaggatttgggtcaaaccaaattttgcttaggtctacaacttgagcatttaccttcaggaatccttgtgcaccaaagtgcatatatccagaaaattttggagaaatttaatatggacaagtcatatccttccaaaacccctatggtggttcgatctctagatgtggagaaagatccatttagaccaaaggaagatggtgaggatgtacttggacctgattttccatatcttagtgctattggcgcacttatgtaccttgcaaatagtacgaggccagatattgctttctcggtaaatatattagcaagatacagcgctgctcctaccaacgccattggactggagttaagaatgtctttcgatatcttaatagcacaagagatcttggacttttctttaaaaagaaccaggattcgact

SEQ ID NO: 30801 - DNA, 3778 bp, Oryza sativa
  unsure (1)..(3778): unsure at all n locations
gatcggtcgctctctcttctcccagacctgccatacttgtctctatcatcccgataagatcgatcactaccatactttgagtggtaagatcttgatggtgatcgtgatctacgccctcgtgtgtgtctaaccggcggagagtatgatctagaccgcctgctccggcggtacttgataggtgatcttgaccgagatttcgatctacgggcagaaggtgatggcgacctataaaataggcatactagtcagtgtccatcttgcaatatgtataaagtaaaaaattgaagtattttttcttttttctttttgttcaaagtaggggcatgtctaaggttaaaaatgtgacaggtgaaaatttcatgctcccatgcagttaatgagtcatgttgctcatcgcaaaaaaaaaagtcatgttgctgaaagttgacatgccgagacatctcccattctcttatgaatgcttcactttgaatattgatacaagaaaaccacacatacatatatacaaaaaaaatgtgaaatatatatggaataacagaaccacattgttgaaaactaaagccaccacttcaaaataaagcacaactttctaatcgcatgtgccccatcaatcacctctagtacgaaaaaaaaaacatagcaagattttctgcacataagtaaatatattatctaatttcatttcctacaattgaagctgataagaaccatgagggatgagaacacagtctctgtcacctaaatcttacgagcaaatgaccataatttgttacaatatgaggagaaaaaaaaaatctaatcaacaaatactaaaagcataccgtagcagttcaggtaaaattaaagaagaatcaagcactaccttgacttccctctggcatccttctcttcgacagtttccccaccaaagccctccgctttcaacttcctgcttatctcagcagcccttgcagctgctgcttcagtggcggatttcatggtggctgcgcgcgcagcagcctgttgagctgctattgtctgctgcattatcagagcctgctggaattgcatctgttgcaactgaacagcttgctgcatcatcatgggcagattgctatttgccaaattagttttgggagggagggatttggccatctcaacattcaaggggcgaccaccaacatccatgttgttgagtgccagcgctgcagttgcttcttcttgtttggagtattctacataggcaatatgttttgagtctgtgatggtgcaatcaaccactttgccacagtatccaaatagctgcttaatatgatccaccgtaagaagtgggcttaggttgctaatctgaaccattttcttcagaacatcacctttatcagttttatctgttgaacctacaacaatggaacgtgcaacgtaagcaatgtatcctttggcaaaaaagaaacactgtttaagttcttcagtattacatattaggcccttcaaataccattgttttctcattttgtctcggctacaaatttaatgttttctagaaagatctaagatgactgaatagcgacaaatatgcacagtatcaaagctattttcagaagcactctcggtgacaaaagtatggagggtgtattaatgataaaaaaaactcagattcgtttaatctgctcagaaagtgtatgatttgttttcatccatagcaattatacaggcatttagctagcttcagcaaaacaacagaaatattgatgcaattaaactgaagttccatatagagtttgtagtagtaaagatgactaagatagtaaaaatcaagagcaacagcatagaaactgaaaccaatgcaaatatgcgaggcagactatacactcataaccctagagcatctagggacaagaaaacagcatcccttaaaggttgagggattacctgaagcctcccctcctgcagccttggaatcagcctgcatctgcgcagcatgtgcctgcagtgcctgtgcagccatgatggcctgagcagcagccatggcagcagcagatggtgccatgggcgcctggctgagcgcaccgacagatgtagtggcagccagcacggacatgagcagctgctgtggcgggtggttgagcttgctacagtctgtggccttggtgcacttgccgttgatgtgctcccggcaaatctccccaagcgaggcaccaacaccaggcagcacaaccccaccagaggcaccagtagacgcagcagggaggaggccgagaaggctggggaaggcagccgagagggcgccagcgtagtttggcatgttgggcatggtctggttgaccatgttggggtaggcggaggagacagccggaagcgtgggcgggaaggtggaggtgacgacggtggcggcagtgttggatgcgctgaagaagacggggaaggggctccccatgacgggcgacccgtcgaggtcgacgtggaccatgtagttaccgcgcttagggacgacgtaggtgacggcgtaggagccatcgccgttgtccttgactgcaccttcgaggtcgtcgccgccgacgccagctgccggggagacgcggacgcggacgcgcgcgccggcggttgggaccctgcgcgagtcccggtccttggagacgacggtgaaggtggcgggggcaccagcggaaccaccagcgatgccggggccggcggcggaggacttggaggggtcgactggaccgggaggggcatggggccggtcgtcgtcgtcgtcgtctgcgtcggagtaggcgtcccgagaggcttgggccggggaagaggggcggtggaggtcgtcgtcctggtcggggtcgtcggcggcggatgcggagagggccttgaaggtggcgtcgaaggcggccttggcggcggcggcggtctcggcctcggacttgagcttggcctcctcggcctggcgcacccagatgggcttgggagccgccatgcgaggagagggagatcgacggggctagggtttggtttcggcttggagcctggaggaggaggattcgattcgattcgattgtggggaggagaggggaggtgagcagcagcagcttctcaaatcccaaatctctcaacaagagggcaagggaaagggacttgtttctcgtgttgttgggccgtaccaggaccaggaccaggcccaggcctaagcctacgcccactattcgttgttggattaagtttaccaaatttatccttaaaccgaaataccatatataacgggaaccgcctgtgtatcactcgggtgatttttgagagattttttcttcccttggatttgcatccaacggactataaaataaacatatgtaattttagttatataggactgtaattttatattttagtttcaaatgtcttaatgttttaaccgttaaagaaatcaatttttatttagaaaagaaccgggcctaagcatccaacacacggccttatccatgcatgcagccccaccaattcttgcataaatcttggcccacatatggtgcgactaaaaaaacgtgaaatgcctaagaaaaaatcacacgatagacgtgtagcaaaatcatatataacgggtccctcaatatacaaaacaggatcgtccgaggttctaaggcagtattatgcccggttttagctaacatgtcaaagctgagtcaatgtgggactcatgggacccacatgtcagcggctaacgcccacaaatcaccacctaggaatagcaaatttccaagcgaccccatggtacaaggctannnnnnnnnnnnnnnnnnnnnnnnnnnnnnnnnnnnnn

SEQ ID NO: 30802 - DNA, 695 bp, Oryza sativa
catcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcgaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcacatactgatgtaaccttggatgtgcccgtgcccaatgaagaggaacaccgcaacattaaacgtaagtacaaaagtaccggacacccacccagatcccaataaaatccggcaaaatctgccggaaatttgtaatcccattcaccagctcctacatttaattaacaagagaactattgtatttatgtaacacctgaattatctccacctttcatttgatccctatttatagattacgct

SEQ ID NO: 30803 - DNA, 324 bp, Oryza sativa
ataaccctagagcatctagggacaagaaaacggcatcccttaaaggttgagggattacgtgaagcctcccctcctgcagccttggaatcagcctaggggcgcaccccaatgaacatctcgcacaggtgcgcgaagaatggccaatgtcatcaccgcattgggggtgagggcgccatctggagatcgtagaactccaggacatccatgaagaaatgagaaaatggcgggaccagcccagccatcgcgaaggggaggaagaagatggaccgccccgggtagtctggtgccgggcgccccttgcccatcatcactatctcccgaccg

SEQ ID NO: 30804 - DNA, 29162 bp, Oryza sativa
  unsure (1)..(29162): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtttatttcctgaattttgtaactgtaactttttaaatctaaacgaaatgttaaactgtttaaaaatcttaattctaaaaagaaattacagctatcacgagctcagctcagctcaaggaagaggaagaagaagaagcagcttcaccacctcagctcctcttgcacacacacacacacactctcttctcttgtctcgctgtggctcgctggacacaacacacacccacacccactcccccactctctctccggttcatgtcctgctgctccccatgtcgcccccactcgagctcgactacataggcctctcgccgccggtgcccgccgccgccgatgccgccgccgacaacgacctgaagggcaccgagctccgcctcggcctgcccggctcccactcgccggaccgctccccgcccgccgccacgcttgaccttctcccgctgccaagggcgccaagcgcgggttctccgacgaggcgcgttcgctgccggggtccgccgccgccgccgccggcgccgggaagggcaagaaggcggcggccggcgaggaggatgaggatgccgaggaggaggacaagaaggtcgccgccgcgccgcaggcgcctgctggcaagtatgttcggaattgcggattgtggctttgatttccttctttggggttcctctttttttcttgggaaaaaaaataaaagatggttttgtaaattgtgaagctctggcctctgggttgctataaggagaattttggtgaaaaattgtttttgtttggtatgatgaagcattttcagttttgtagaaatatttttttcccaggctgatatgtttgatatggtgttttttcttgagttttgggaaacaaaagtagggagttgagagagttgtgggcaaaggttgaatttttgtgtcaatagatcctttgtttcagttcaattttgcctctccttttttccctgtgaatttggcttctctgccgttaattagaggagggaaggaaaaggttttgagttattcttcctgaatttccacttttgctcttttcttcaaatttctcactttacaaagttgcctcctttttcttttaacttgagctttcttgcaactcttttttttttcctcaaatccttctattaccaagttttatcatctttaaggtgttcctttctgctgcattttcttggcagccttttgatctgacattactttgctcgaattcttttgctcttgagcctaattggtttctgtattccctccctgcacatgagtagagctagaacatgtagtgatctgactcctccttgtgcatgatgtgttgttgtgcagggctcaggtggttggatggccaccaattcgcagctaccgcaagaacacgatggctactaaccagctgaagagcagcaaggaggatgctgaagcgaagcagggccaggggttcctgtacgtcaaggtcagcatggatggtgccccctacctcaggaaggtggacctcaagacctacaagaactacaaggacctgtcaactgcgcttgagaagatgttcattggcttcacaactggtgagatgtctcgggttaccctgcttgcatttctctttgtaattgcatttccttttgatgtggatgctcttacaattacatcgtctaggatgcctgtgactaggaaccaatatatgcttgatctgtacaagtaacttttgccggtaacatggatttgttcctagtagttttaagatcacaaaaggcgggttatggttcatttagttgttttaagatcacaaacagcaatttatggttcactaatttttacaagaaagcgaaagaggccttatttattatgtgctgattgtatttgtactatacatcttccaaaaagattgtatttttaaagataaattaaaattggctctaattctaattttgtgatcatcgtacaggtctttttttagttctgaacattgctcaatgcagatcatctttatttctgaatattaatcatcgtcaattcggatggcatattgttttaattgccttttccgaatgtatttcaattatttcttgctgttttgattatttttatttcagattacgtaggaaatatactttcattatactaatagttataccgccttttctcgataattaatagacacattgcttagtaatattttttttgtaaaaatctagaaagtgagaacaagcgcgaatttttgcaatagaaattttagtacaaggagagattctcttctgtttgttttatttggccttacaggttagtgtggatgtattgccatatcaggcaaggatggcttatctgagagccgcaaggatggtgaatatgtgctgacttatgaagacaaggatggagactggatgcttgttggcgatgttccatgggagtaagtacactagttcttatctagttatcatcgcaaagaaagaagtaataacaccaatgagatcgaagaaataaaaatgctgttactgaagaacttttgatttaaattgcaggatgtttgccaactcttgtcgcagactcaggatcatgaaaggttcagatgcaattggacttggtaagtttgtatgtttattatgttgaattgcacgttcggctgatctcattttatttccctttaaattgcacttgtagacctatgtgtttttgacacagagtttaaatgcatcatgtgacatacttgctcagtttcaaaatataagcattcctggaatatatttggaacagagggagtatcagtttaggaatattggttttcttgtgctttctttcaaattcaacttagcaattcatacttcatgctgtagggcatgttgaaccagggctggtgacataactcaaaatactctaaaatcaaggaaaccataactcattatgctatatcgatatgttggatgcttgtatttaagaggtagatgtgcaattacggttgaaggtgtcatgcatgtatctaaccagcgctataaaaaagctaactgattgagatctgagtcttactattgatgttcttgttctaatgcattgtttcaccatgattcctttgtgcactaatcatggaatgaattattggatgtcaaacttataatgctttgaatggcattatgtggttgttagctgttatcattcaatggcttcaccttcttttagttgttagtttgcatttttacacatggctcggtaatttacttgtcttgtttctttctcatgcagctccaagggcagttgataagtccaaaaaccgcaactagaatggtttctgccccacagtcaaaagcaagatggagatcaaatgactgtagggaattttctgaaaaccaagaagtctaacagttttaagatggagtctgccttatggtctgtactacatggtttgctattgtgaaagttaaaaaaaaaggtgtcttgttatgttagcttcgccaaatctcctagggacataaactctatttgattgtgcccaagtctttgtacgtgtgttaatgctattcgtgtaaatggtttggacaccatgtgctactgctatgattgagcacccctacctactttgcaaaatgttgtcaatgaactgtttgttcgctacataaatgttcaatgaagcttgcaaatgtattgtccaccaaggcatcaactgttcatgctctgttccatacatctcatctgttttggagtctgatgaagcaaccttttttaaggcagtaactttctacagttgtgttctttcaatttcatgtccatgctttttcatggtgaaactgtgcttcctagccagctttagtgtgtagttgctgagtgggggcatgtagtgtatgcagttattatcttccaaggtaatgatggttgtctctctagtgtcattttaaaaggtttccatctcaaccatcattcaggttggatattatattatcatttctagagagatggcaatggcttatgatcccttagaatcaggcttttctttgccttggtgtgtatcttcctccttagaaatgatgctccactctgcttactttttgctgcctttttctccttactagtgtctgttagttggtatgcatgtggagtggtgtccatttgttccaatgaacacataaaaattctgattctgttcttgtttcaactcaaaaggcatctttcactaacccaaatgagccttcatctgcatttgtttatctcttgtagcttgcaggctgtcgcatctcgggcgctgaatttattcgactatgctgaggcgcgcatcggctgaaagtgactgatagagttcaccattcgtgctgattggcagtgcatgaagcaatcctggatcatctggtttagttttctaacacttcttcatcttcctttgttacctcctgttgttttccaactctgaacttgcaatatatatttaataccagcagcatccagtaccttataggctctggattcctttgttccctggtggtcctgccatgccaccaagttgctgatattttaattaaacctttgcttgatccctttaattaacagataaagtcactcattaggatggtagtttatttagcttctgtgtgtggctgtttgctccatatttcactgtgtttcatggcctgcagataattgtgaatgtctggactgcagcattgctttcactttcatcttttcaggaagcatgagtatgcatatgttccctctagcttattaggtatatcatgcattctgtcatttttatttaagagataaatcttgcatgtcaaggaaggaaggtgagcatcttcccacagtagcttctcctgtgaatgaaatcaaaattctgtttttctatcacaccctttcagtccttttagttcatgtcctatggattttgatggtgttgtgtacgaatggaatttcgacaaattgtcgcagatagtgatttgcacgacatgattgatcttctttttttattattattattaaaactaaaaccctggctcgtcggttgtttttttttttctcattttgtgaacaataattcgtgcaacttttacagatcgatgttaacttcgtactacattttacagacatattgatatttgctctcataattctgcatttctcattagcatatcatcaccaaaaacttcagcatttttgtctacatagttgacaaaaggaggccatggctggtaagagacactgtcagcctttctttgtcagctgtaaaagcaacatttgtgaagcaaatgctgagcatagctgctcatctcagtgaagcgtttatccccaaactgcctgcctttgtggtggctccagattttttttttagaataaaggaaactagttgcagctgcaaattgacagcactgttttgtcaactgaaaaattctgagccaaattccaacgacgtcacatgatctttgtctcatctagcagcataactcatctgtttgtctctgcgaagttggaaacattatctctttgttttaaccgagtgtgaactagacagtgtttccttagatgcaaatattattatagcccagataacaattgctatagcctaaacacaatatgttaaagttgtgtccaactttttggcaaacaagattcatatttatgaggaccattgggttcaagggaatttcagaggattttcctaggaactaaactatcttgcaaaaaattaccgcgttttaaaaattgcctcgaatttcacagggaattagtttaatttccataaaattcctgcaatatctctctgttcaaaagagggggtaaattcacaagattattacctagactctccgtccttaaaaaaaagtctagatttatagttaaaagttattttttttacagagtagtatttatctagaacagtatcctacactgcagatgttatatgtgcctcacttgcgacatctgaactgaactgaactttatatccatgattcatgcaccggaggagatcatcaaagtatgaagaaatcatgggcattaccaacactggtcgctcgctggccccattaattaggaaaaaaaaatgggaccatatattcttattaacataaagatcccaacaacacatttttttttctcttcagcatatggccattcccagcccaatgagaacaatgtccatagcattaaataatctgtcacgaaaattaaaaaaatgacgtggcaagtgaataaatgaggaaagagaagaaaatcagatcttacatgagatatagtttctacgcaacatccaagacatcatgtgagataaataacattaaatttaagtatgtaaaagttgtgtttgcattaaaataatagtgtacagtactagtttctttataattggagttaatggaaactactggcctaattaaataagccatctatttctgacggtcaaaaaaggcaaaacaaaaacaaaaaaaaaccgaaaaaagagtgcagaaattatgagaggtcgggcccaccattgggctggactgagagacacaattatgacgggcatggacgcccaaaaaaaatgagaaaaaaaaataatttgcaatgcgccccaacatccgctgccccacacgaaagcgacgtaaacacctcgctcaagccccaacacccagacgctgacagtgggcccggggatgtcaccggggcccacacgtcggtggaggtagggccgctacgtgggagtgggggtgcggggggagagacggtgcgggtgggccccacagtgaagtggagcgtggctgtgggtaggaggacagcctgggccccaccccctcccgtcgcgagcatcgtgggccccgcgcaaaaaaaaaatgaaaataatgcgccgcgcgcgtgcgggcccacacctgggatggatgacaggtgggccaacgaggtggtggggccggggtgtcattgagcgttgtgggtgaggttgcggggggaaaaaggaaaaaaggaggtgtgaggtggcagctgggtggggcaagtgaacatgggcgcgggtgtgtggagggcgacgcggttgggggggtgcaactgcaggaggcgatgggtacgcgggaacgaggtctctcgctgtcgggtgggcccacggacgtgacacgctggcaggaacaggcgtctgccgtgtacccctgtatccctgtcaagttcctgtcaaggttgacggtgtgtgttagctgtgttcagattagtaggattgcaacgtagtatcatgtttagcattagatttgtttttttatgacatgtactcgttgaattctagtatgttagaaaatgttatattttatattagatttatttattttgaaacagagattaaacagagtatggtttgtttaaggaaattgcttatgagtatcgttggtactatgggttggaaatactttgcttcgcaaagaaagcagtataactcattttaataagtgtggttaattaaatgttagttgaaaaacttaaaaataaattaagatgatttttttaacaacttttgtatgtaacttttttctttatgaaaaacacagtgttttactgttacggaaaacgagagtgaaagttgataaaggtgaggaatgaaatcagcctactcttagagtgtactttgtatatccatctatttcaaaatataagaattttcttatactaactccaattcacaaaaattcttatatttttagagaattagggcttaggaagggaatttaagtaatttaaaattttattaacactgaggtgacttaaaaaaatatttattcataaccaccaaactaaatgcttgctagttcaaattgctagtgaggagagtcgctatggtattctctaaagtaaattaatttcagtgacgattagtacgtagtactagtacattacgagtgaggtatacgaacgtaaattgtctctatcacacttattttcgtatcaggcatatacacattctccatccgtaaaaaagaaaaacccatttttaagtttgaatctaaatatacactatatcatttaaacctagaaatagtttttttatggagggagtttctttcgtgtcagctacagcagatgtacagtgctttctcattggtctttgcgttacacactacttttggatcacccatacggccatactccgtataaactgtgagtttatgttggcctactgttaattagggttgttgtatgagtccaccaatcagatattaataagtgtatctagttgaacaactctagagtgccaacattagtcaacctagccatttctttttcaaataattgtgaataaagggcgctaggagtgaagtgttcaaccgtctctaggctgcgcattcagagcaagaaaaaatagttactcctatttgactaacacagccttttaagtccctttttaattttagttattcaccagattgtttatcctacagtatgaaatatatgtttttgttaaaaacgtttttctatcgctttttagaccatttattttaagctatttaccaattctattttcttgaaatatttaattgattcttatagttaagtagataatccgtgacaataatctacttaaatttgtctgctgtgagatccttcccattgtggcaactggcaagccgagtaaaatttcattgctagtggtgcccattgcttagctttttaaaaagggcgaatcaattgttccttgttatcgcatctcatgcaaactgacggagtaataagctccatcatgcatgcctgctagctaggttgttgtttaccggtagcagcacaaattcatcaacgaaatgccaccactaagcaatttcgaaaattcctagttcaattttggtcggataaggcctatgtggttgttcaatttcctagtatatagaattgggactttgggagatacagatcaaaattaaatttaaagtacatgttcccatacttgtagtagccatctcatgggttttatatacggccccccgcctatttggattatgacatgcaaactgtcagtgtctatctttgtcctctccctttccctgttttcttcttttctttattccctacttatctaaatcacatcaacaaaaatctggctgtcaacacaggaaataacaatgttgtatcgtcgccaacaaaaccacaatgtagaactacattagtgttaatctgtttttgcatatttcaatctcagtacttgcatgattaagatatgcggctaagttgattaagtgggctttctttgaacggcctgaaatgttgttacaagtgctaccatatgtaattcgcataaagtgttgtagctcaacgcacaccaacacatttgtgcacccaggaattcagcatagttatcgcaagaaagtgcagtcgcgtgtaaacaaaatgtcccaaaaccatgcatacaattatacaaatctggatgaaagtacaactttgccaatattattgtcaataaaactaggtcaaactcaacttacactgacgctggtattcatagaatcttttgctatataatatgccttcatatgttaacagtgatgaacactgtcgccatctcgctccatgtcaaatgggcaccatatcaacgtaaaagatcacatgtaacctttctctcctttcttccagggcgcccatggataaagcacaaaagacttttcagttctcagcgtttgtgctcctcactcgctgattccatacttaccaccattcattcatattccatgacatagaatacaaatgacaagaagtcctacagcaggaatgctaactttcgaatgtaaaatggattgattaagaacaatagttctgacccggaaaacaaaatttgtacatatgatttgacttcgctaacaaaatggattgcgcatctacatcgcttggaatgttgtaatctaatgctctattaaactaccaactgtggaatggtagatttgcatggcctatctacaaacctcagttcgaggtggtgtggcttttacaagatttcaagggcgcaagatgtcaaatcaaggggaaaaacctctgaatcctgtaccaagatgagatcattggcaaaaactcattcttccaactccttgagaaaatctacattatcaacaaatacctgcaattatggtaattaatgtatcagacggaagaaactgcgggttcttcatgaaaatagaggcatggcacaaaatatgtaatgcaacagactaataatgcatatgcatatacttttttttctgacaaatgtacttaggagtattattattctgaagatcataaaatcgcacagaagacatgtacgactacttcacatacttgtttcaagatggggaatattcatggcaggtcagcagaacagttgacttggtctaattcatcattattgtacacagtacaataaaaaaaaactactactccctccgtttcacaatataagtcattctagcatttcctacattcatattgatgctaaggaatctagacatatatctagattcattagcatcaatatgaatgtgggaaatgctagaatgacttacattgtgaaacggaggaagtacaatttctgttctcaaattacacaaagaataatgttaattttcttaaatatgcctttactgtatacatggtaataaactaattggatatccttttttctagggcagtgagaatcactaaagattttatggtgcgtatgtattattcaagacacaccaacaaaatagcaacaaatttcttccaagtttagttatcatggaaagtttatcgccataaagtgtaaatggcccagaaaaagctcatatggagcagtcagaaacagccaagaacaaacaacctttagcaaaaattatgacccccttatctacacacacacacacacacacacatgcacgagagagctgtgattctcaaacaaaaagaaatagtacatactgttttccagccatctggatctgtgcaagcagttatcttcgtattaattccaggtaatgggccaggttcacgagttatttgtccaccattttgtctaatgacttccgcagtcttgtagacatcatctgtgctaatagcaatctggaagggtaaaaaaattaaactccacgactgtaatgtaaatacgagggatgaaccctcatgaaatgaaactcctattatactcatatttgacccaaaccctttcggatgcttctagtaaccaacgaatggcaagtgatccccgttgtttagatcatattcaatcagaaatttccacatagatccttttttattactaacacagtatagaagagaaacttccaaatccaatctaaacactcaaatataatatacctgtgcataagcatttcctttatcatattccttgacaccatagttgtaggtcaactccagtacagcatttttgtcttcaggaccatatcccatcattgcaatagtatactagagaaaagatacaattagatttctaatagttataaatcacataaggaaatcataggctatgaccaaaagggttaggtacatgcagatttggttgcaaaatattaacagacaaaattgtaagcatctagatataacaaaaataatacttcctccgtttcataatgcaagtctttctagcattgtccatattcatataaatgttaataaatctaagcatatacgtgtgtctagattcattaacatctatatgaatatgagcaatgctaaaaagtcttacattatgaaacggagggagtatatatcaagatcattcaagacagacaaaacctgttgtggtgaaaaccagtaacagaaaatactttgaggtctattttttatttgttatacgtgcatcaatttgacatgactaacgccaagcagctgtagcatattctctaaaaccctgtgtggactgtcatgaaaaaaaagtgaaaatattttttaacataggtttcgctatcatatatgcttctatgaaattgcaaggttatgttgtcatatatacttattatgaaattacaacttaacacatctatattgcttggtggtggtggtggtggctatggccccttactggtctcacagcctgacagcctgatgtatggggccaccaggctatgagaccagtacacaaatgagtgctatgctcactgtgttgtctctaatagtttgcttctttttcaccttgattcaagtgaaaaactcaaggacattttagttttattagtagttcactgcacaatttattattaatacgtgtttcattattcatgtcaaaatgcattgaaggttttatgtctcactttggaaaacaacaatcctataaacatgtacattttctttttgtttcttaaagatgaagcgttttgtttcaaccaaacagaagcaaacaagttctttttttcagaaaatggactcaatatttttatttctataatctgctgcaatgcacgggtatttgactattgttttgtataaggagaaacaaaatagagaaacattggtaaggagtaaagtaggtcgattttagtagttcaggaggtaaaatgagtaaaaaaaaatacttcagaggattaaatgctccggtgaaatagtttgagggagtaaaatggattttttttccttttttttgttaagtcttgcatcatttgtatctgtagttgcatatccagtgtaaattatgcatcagagtttctagattaaaagacaatcacttttacatttgtaagtttagaacttaagatatactcccttcctccacaatttgattttgccaagtttagcagaaattaaggtagaaacaaaaagacatgtgcccctaaaaaaggtgggggacaagtttggattggcaacatttcaggataataaaagtgcaaaaaggtaaggggattgaatgcaaggctgagtttgtctgctgtagttcactccccgggttctcaaaaccccttatatttgtggacaaacgaacagggccaaaatcccttatatttttagaaatttgatatttgttcaatgcatatagatgagtaatatagggaaaaaaaggtaatctgaaactttgtttcacgaatgagtggcataataactcatcagaagaaagttaacaagcatttggactgtaataatatcggatcacagggttctagtccttttgacagtgacccttatccatagcttggatagcaactgtgccagagaagtatattttgtttccagattcatgagtgaatacgaagaataagacaaacatgacacaagatatcctgacagagaacagacaaagtttgtgatcaaccctatgcacaaggtaccagaaaaccagatggcacaacatgcttgagactaagatttcaaaagaaaagaaaaaggcttgtcaacaccagaaaatgatgcctaaaaacaatgaagttcccatctctagaaagaaatataagaaacaatggcatgtataatgaaacaaccagtaaatgcacatgcggaacttgctatcacttcggttttatcaataccatgcctactacccaagtctgaagtctgaacccagtgtatgaatgtagcaaaaatcaggatacaaccataatagctacatttaacatgttctccgtaagtcaggataccactgtataagatatggaactaagcaaatagtttacaaacaaaaagtgcatttaacatgttctcatatttcgaggtagtagtgcatgtttttccttatctcacttaagcaaggatcagattagaaagcatcagggcaaacagaagccatgaggacaaacagaagtcatagcaatggaggtgatgaggtacattgatggaagctcttttgaatgtttttctagtactttgtagtagagcataacattagaaagcatcagggcaaacagaagccatgagtgtcacgaggtaaatccatgcaatggttttgaaaagtaccaaccttgtattggggattgtctcgtttccggagaagttccatgccaaatgccttatgatgaaaatatagtacagattagttgctgaatgaataattatgataaataccaaatactacaagttaaagacaataagtttaccttctcatagaaattgatagcatgatcaagatctcccactcgaagcattacctggcataaaggctcaggtgtaggacctctttctataagctcaaatttgtaaccatcaggatcttcaataaaagcaattacagactttccaccttttacaggtcctggttctcttgttaccgttcctcccttggctttaatgagatctactgtttttgcaacctacaagttttttgtaatgaaacttatcaatcaaccaagcacatatccatctttgcaaaggcaaaatattaaaacctataatcagatacattactaactgatggcatgtttaaaactctagtcttatccagtgcacaaaaatagattacattattcttggatgtttgcatgaccagagtaacattttttaccactattaatgaaaaagggaagattatccctcaatgtgtgaactgaaaacatgagtaagttattgttatgttatgaaaaaccttttatgccatctccatggaagaaaagaaggcattgtatggggtttggcatgatgagattaatcatgccaaaatctagcatcctaaaaaggctatttgttttcaactagttccctactacatggttcaatgaaaatttggacaaagcaatttaagccagatcacctggtttaaggttttatggcactcaagaatcacactaacccctacgtaactaagcaagccaattagttgtaggcatcaaaatataagaaaaaaagtgtattattaagtcacaacccctgagagaaatcttatctggatgatacatggataggtctggtaaaaaatttaagcctaaaaaccagtgggaactagcttgaaattctacaagcaaaagggactagtatctttttgagtagccaaaaagaaaaaaagcatgcccagttgaaggaagtggcagttatacacacagggctgaatgtcaaacaactcaactactcaacaaaaatactaagataagcagcagaatcttacgtcctcgacagcaatcccgaagtgaccgaaagcagtcccgatatcataactttccacaccataatctgccaatagatgtacatcaggggtcttgcacggatacaacagataacgcacactatgtgaggtataaacatatgataacagcatttggactgtagaagcttactgtaagtgagctccacaacaaaatgcgagtcctcaggcccgtacccgagaaaagcattggtatacctctcctccggaatgtcgcgcttgcgcaacagcttcatccccaagcactcggtgtaaaacctgcagaacagcaaatcaattcaaggctaacactatggtagacgccagagcaaattttagttgggagtaaatttcattttgggccaccttttattaccgaagtttcgctttgtataaccttctaaccaaagtaccccaaagtggcataaaggtaagattaccccatccaaagtgaaaacatcggttaaaagatgatccaaaacatcggtaataaaaggtgaccccaagtgaaatctactcttttaattaacaactatacgggttgtagttttttttttttttttttttcgttttctatacttgatcgtcttgtcgaggtcgccgacgcggtagacgacatggagcatgcgcctccggtccttcttgacccactccaccgcctcgtcctgcccgatcacctgcgctgccgcggcggccgacgacgacccgcccgcctccgccccggcgctcacccctctcctcgccagcctcaccggcgccctcgccgccgccaccctccccccgaagagcagcgcctcacgccgcgccactgcaaaccaatcaaaaaaaaaaacaaacaaacccaatgaaaacagaggccctcccacacgaacggggaacatggagagggggggatgataggaggtcggcgtaccggaggaggagaggacggggaggcggaggcgggaggcggcggcggcggcgatggggagggggaggaggaggcgagccatggcggtggcggaggaggagggggatttggggggcgagagaggtggggtggctaatctcctttttcctgtcgtgtccgcgattgctgcggtcgcgggtttggatctgtgcggggggatgtcagtgaggctggcaggtggggcccacgagatgggggggtgggccaaagcggaggctgtttgatttgatttcggaaggtttttttcttggccgtccgtgtgctgtcagagattttggaataataaaggaatgaatggaatttctctgtattttctctcatgttatgtcttccttttttttgtgtcttcaacttcttttgctttttggaataaactacaaatcagatcgaaaaacgagtagtcaaatatttcagctaatcaatgagtaaaatattaagctatggacgtgtctacgacgagacggtgcactggattatcataaccagctacctcaatctaatatcaagttgctaatagtacacccaaaagtacatacatttttgttcttttcatagaattttctcttaaattactcatccgatttacaatctaattacaccattgtgtttgtaataattaaatctttataacaaaattttacatgattatattttttataaaaaaatacaaattacttatataatatatctaaattacttttagatttcattaaattactttttagtcataaaagtaaatttaataaagtttgaaagtaatttacatatattatagatatattatagaagtaacttaaaacaaaagtaaagtaacttgttacggcattaaaagtaaatctattgtgggggtaaaaacatgtctatctagaaattagatttaatcaacatattatagttacccccataacggatttacttctaatgacaagttactttctttttccttttgttttaagttacttctataatatatgcaaattaattttaggctttatttaatttacttttatatgtctaaaatgtaatttagtgaaatcaaaaagtaatttagatataatctaaaagtaatttatattttttaatcaaaatataatcatgtgagatctaaactatagagttataaaatatgagtgagagcaataatcctgaaaatcatctaaaatcaaagttcactcctgtttctacccttaccactctcacccatctagcttacatcgacctaggcctacttggcagccacttgggcttgcccactccctgtccatctcttccaaccgaccagcagagagagagagagagagagatcgagggcgttggcagtgctcgacgcatgggagtgacgtgtcgacgccctcaaaatgccgagctccttctctacttctctcccagacgcatcgccattcttcactttccatcccagtgccgatccaaccgagaaaaaggatgccaccgatcgccaacgagccatctccttccctatctaactcacgttctattatcttctctccatgtcgatcaaaactcgttttgacaacctctcgattcgtgcagccaatcgacgggaatgctgccatgcccaccggagctctggagcgcgctctgtgcaccgccgttcccgcttttgtggaccaagccgggccaagctgtcgtgccaccaccatcgtctcatcaccacgaccaaaacccctcaagaaaccccaagattcatgccccatggacggtgatcggcattgtcttctccggctccggccaattgtcgccatcgccgattccttctccttcggtgagccattgtccgatactttgcacgtgaagcatccttgagacctcgctaacaacgtatgacctcatgcatgccagttagattggtagatcaagccgtcgacgtcatcccagagtgaagcaccgtcgccaagccatctatctagagcacagacgtctcccgtgaattagattaagtacagggattagttaaccaaattattccttttactcaactcaatcaaggagtaacatgttctggtcataaaactctcaagacatacacctgtaaaacactatatgcctacaacatgttataacttgtaaaaatcataagaaaatcattataactccaaaaatcttgaaaccaaatgtgttactcttagaaaacacaccaccacacctctgtaaagtcaaaactaataaaaatttctttgcaaaaatattttataacaccacctaggtaattactgcaatataccgacataacttataaattcataactcactaataaaatataataaaaatagaaattctttcacctaaattcatcttagaccagtgcctattcactgtgcacaaatcatgtattttatagcattttggatttttcgcatatttcggtgtttaattgcataacgtgtactttgtatagatgattgcttaagcggtgaagaagtgatttaggtggtgactttttctagttacaaggctagtcccacctccctctctctttgatcaagttgatcctatattttggaggttattgaggttattgaaaatgtttgcaaatcttgcatgtcgattgtacactattatacattaaaattttgtaaaacttgttagacaaacatctattacttgcattatcaccttaaccccacatatatccatatccctcattcctaaccttaggaacaatatgactataccactttatatatgagttttgatgtcactaggttacttataatgcttagtcatgcttggaatggtcttccttgtcattatgggctcattacaaacatgaaaattgtttttgaaataatctggatagaacttgaatacttgtgattttgacaactcacatcatgtgggtaaagtatacgaactctgaagagtaaaaactaatcgattagccgtgctcgcggtcatgagcagcgtgtggatatgcgttgagtatagacttgtgtttattctcctaaatgatgaattttatcttcaaattatgttgagatttgggaatgatctccttgctaccatggagggcaatgaagtgtatatttatatatgattaatgcctactttgatgccgatatgctaagtactagcttgctgaaatttatctgaaagcaaatctgatttgaaagtgttttatgcaaataaagcttgccttatgctaaaaagaaccatattatgctttctttggatatatgccatgcatgtagcgtgttaggattgcttcttgcttgccagtacattatttctaataatatactgactcttgctattggattaactatttgcttgcaggttgtagacttagtattttgagtgatgtgggtaatcgattgctttttttggacttgaacttaatgggggtatatccctaatcagtgtgcttgtgtttaggtagtcaagcttctgctattctctgatatatctatatttggccagtcggcccttgtaactataaagtaattgtaaattttagatcactttcatcttaaatgtattttgctatttatttccatgcttaagatgaaagtgtgaatctagttcacatcctgggaactagattcacatgagtataagttaagaatatttgagatgttgtagatctttagccattttttcaagtctcctgaatatgtaacacatctggtcaccgccttcgagtggtttgacaggcacatcccaggctaaagttgactgacaagctaaaggctcaacaatggtcttcaatattcttctctctaggagtcggatatttcattatatttgtttgatgacttgaataattcacttcatccttcaaatataatgagaggtccgaagagcctacgacaacgatacatactatttagcagtttgaaaagtgtgctaacgaaaatcgatgtagtatttgtattttaatcgaaaagaatggagccgtgcatgatgatcgaagtgcatgcacgcaaggctcctaacctgggaaatcaattgaagaaaattagaacttgcgagagttccattttgagttaatagaaaaaaaggatatagtatttctgtttaaattgacagtttccaagttgaacctataagctaaatgaggcagtagctaatgtttaacacttgattgaatgaaagatctgaatgacaatatcacacatgtaatgcctgctttaatgtatagttttgattgaatgaacgatctcactgtaaaaaaaaatgcacaacggagacatgaatatttacgtgaaaaactcttacattaaaaactatggatgccaaccagcaatgaccagtatagacgatttggttacaaatgtaagagatacattgggttatcgcacctactagaaaagactagaaggctaatagctaggataaggctagaagtcctactagaatactaatctaaccaattaaaaactaatacaaacatattacatgctgaaattcggataacatgtttgataatcttcatcttgagacgaatttcccttttagcataagcaccttcatcctccaaacaacctcatgcagacaaactattgtgcgccaattagtcacttggactataaaattgtaacacccttgattcagaagaggtagatcatatttcaaatttgccatcggcaataaatcctaaatctatggtatcaattggtgtgtgaaccaaaccgagatgcgaaacctggtgcacaaacttcaaactcgccatgggaataaaatcctgaatcttctatatgaaactcttgtactgaaaacgaaatttttatatctcctgatgaaacctcttggtatgctgggtgtgatgctagcaaaatccaccaaaaatttgattaccttgtaatctagacaggaacaatgctccatatcagcgacttgaatgtgatgcttcttttctgcctatcgggtgcatgacattattagtttctcctcctcagtagatgtgccatctcgtatcttcacttgctataacgataattttgtgtcaatccaatagtggtggatcaaacttcaaactcgccaggagcttcttttccttcatttgaagttgatgctgtcaggacgctcaattccgaatccaaaatgtgcaaaacttttttctcttgccttttatggaccaaaagtgacatagtgatatatgagtagacttgagaaatgttttggtttttgttcccaatcaacttcttagatcatccatgtatttcttacgctcggtctctttcccttcacctaagtaagtacctatgcaaatgagagcacacagaactcatgatgcagtaatgtttgttcaaatatataatatatagcacataatcttacatagaaataatgcatctttggttgattaagtagcggttgcggcggcgatggctcatggtggagatggtagtggcgatttggctagggaaagaggggaaaagatgtgacggtggcatctatttatataggaggcatgagagctatgatgttttttttccattataatgcaccggcacttaactaataacaataaaatagtatatgcattgagccctttggcacctaacgacatagcttaaaagagtggtatgagataaacttttattagacattggttatatagattcatagattaatttattttaaactgccgacccattaattgatgagttgttctattttccgcatagtcataataaatttcgcatagtcacctagctaacatttcttattatggggtaaatataattttttagggtaatggggtaaatataattcttcttaatattcctccttgaaactctagatactcttttatttatctcttatttattgtctaatactccctccattccaaattgatctacatataggttttttgaggttattcctaaatgatctacatatttgtgttcattcattaggtctattcgttatttgtgcattggagtaaatggacattgatgcatgcatccatgcacacaagtatttataacccacatgcaatatcttgatttgctattggctaggagatagtggggatggtgcatgcatctagtttgctgctagagtaaatatagtatgagagagttattagcttttcttggtcttggtgtacctatgaaatatgtagatcaatttggaatggagggagtataacatgtacatattcttttaagacaagtagatctagtcatctagaatccacatataagtagtcggtaaaactaaaatagcatggttagattgtctgtcagtaaaggttgtgtctatcagtatactattatcgatgagtttttctgtgacacaccctttctgtcaagaaagggtttcaatagacagaaagggtttcaatagacaatatgagctttgtcaatatatgcatcgcctgttcatttaggtcatgatgtggggatactttacatatatatatttgtactacaataaatggcttcttgtgattactcactaaaaagaagacataccttgtttgcgatgcaagatcattattttgcttgtttgcatgttttgatatgtagttgaggcactggtagctgaccttctaaatagcccaaaacttccttacttgatggccgcatgtgacgatcgaattggacgcagagaagcccaatgagtataacacgtttcatctgctcctcatcaaagtcaccgtttaggcgtcgatcgactgcatcaagcagtgaattgctgtaatacaatctcctaaacttctcaacgagaccattacccttgagacactgaggtatttcaccggaagcaatctccagaagcaccacaccgaagccgtaaatatcagacgccggactgatacagcctgtgctacaatattgagggtctatatatcttgaagacccaaatatggtcattgggcaagaagttttgtcaatggggacttgcctcaccagcccaaagtcaccaactttagcattgaattcttcatctagcatcacgttgccaggcttaatatccctgtgcaggacgcgcggatgattcccatgcatatagttgagagctgaggccatgccaagtgctatcttatacctacaattaatacatagaaaatcaaagttaattcagctgcaacattaaataatatcagttgacatgtggtcccatcgatcatgttttggggcatatattgcataccttctactccaacttagtattgtatttgcatagtgaagatgataatcaagggtgccattgtgtattagttcgtagacaaggagaagttccccattttcatcacacgaacccacaaagggaacaagattgggatggctcagtttgctgatcactttgatctcattatcataatctcgtgccgctcgttcatgatctgcaaccctcataatccttttcacagccacgggagttgtccaattcattagctgagccttgtagacagcaccaaatgcaccctgaccgatcttacggctgtccgagaagttctcggttgcagctaacaagtgtgcatatgagaatcgtcgtgtgttgtgcactgatacgaatacaattccattgtgagtttgtgacaataaatgatttatttgaatggactaacagtctattcatagtgtaagaacgacgaaatgatagcacctaccttcttcttccataggcatctcgattaatatctctgtttttctattgaggcggtggtggttgaacctggcccgcttacgcataaagcaaaccaataagacaaccacgccagccaccactgctattgctgcagtgatagatccagctactacctttgtactaaaacttttagtattgaagccagaaccttgttggttacccgcaggcacaaaactaaaaaaagttttagtaaattaagagtacgtgcaaaatgaattaaaaataatacaatgttttgttatgagtgggtatctttaccagtataatcattagtagaagtgaactacaccattgatttatgagttctaccgcaagttctatcagtagcagtagctgagatgatagcatatatagatacattccattaaattagaaaaagaaaatttttactcccaggagagaccataatttttactaccaatagagaccataaattaaagttctatttatatgtgattttcatcgaaatcttgtggtaactatacacttcataaatgtcaggaaaataagaaaacacgggtttatacacgtcatcaggactaatttagattttattattttgatataattacatgtataatttttagtgtgtaattagtataggctgggcatatttatatactccttctgtttttttaatatatgacatcattgaccttttaaaatacgtttaaccattcatcttattaaaaaaattatgtaattattatttattttattgtgatttgatttatcttcaaatgttctttaaacatgacttaaaagatcttatatttgcacaaaatttcttgaacaaaataaatagtcaaacgtttgtcaaaaaaatcaataacattaaaaaaacggaggtagtatgtagtttcttgatctagacaagtactccctccatccagttgaactacaaaggtagctatacttagatagatgaagtagtaaataaaaaagacgtgatgaggatgttgaattatagtcgaagaagtgaactacccaccatgaattaatttcgtcctacctattttgaaattttgaatggattttggattatgcatggaacctcatgtgcgtatatgcatgccatgcttacacaatacgagttaaaccaaacttagattgagatcctgatctgcaatcgagtctaccgcgcctttgtcactaacatgtgagctgttgtccacatgtcagtgataaaggcgtggtgcagtcgactgcagaggatcctcatccaactaactctcatttcaatcgaaggtgacactgttttgcaaccaagaagaacaagagtagcagcatctcaaacctataactacaatatactcacggtgcttggttgttcgacctcggcggcgacgaagacggcgaaggcgtttgataaacattattctgagatttccgtcttggatccacagtgaaagtactggagttgttgccagccgtagtcgagcaattcaagactgcatccgatgtcgcaaggaatagagtcagaacagaaagaagaacagctacatactggagatggagtgccattgcctctctcataatacacagctgcttaatttcagttagacacagccaatattaagcactagctagatctcatcaactgatgctgcaaaattggaaggatgcagatggggtttatgtacagctagtgcggttggcaaccaagacatactcactctgttacaaaatatagtaatctagaactggataagacatattctagctagtataacgaatctgaatctggatataccttaatctaaatttgttataatagaatgtgttttatccaattgtatatttctatattttaggatggagagagtacatcttgacgaggacattataattgatgaccaggttcagcgtacgtaattacgtatcataagttgtgtttaataattacaatcgtactagcaaaagatgagttaaaataggttttgttccgcaagtgcatgaattaatatcgattatatatacgcaagtgccaagtgcaactgaatattacattcataatctctctcctagtctcctatatttttttaacaacaaattaaagcaaggtttgacagtaagccacataggcaacgatctacagatcgttgtcacggaaagcctttagttttggaatcaaaccgtttacttttgaaccgtttacttttgtctacagagatcgtaagctttgcactttttttttgcaggtactatttattgggatagtgaaaatacaattggtctattgcagaaaaataaaatcatataggaaaatcatttgactcaacaaacgtgcccatggaaaaatattaccatttgatttgaatcgcaatatcaaatctgctaatctactatatacatctctatctctacttattaaaaatattgaatatgttcccgccgttcttatttgtacgtcacctgtcgagtctgattccttaaggcacgtcgtaacgtgtacgtcacttaatttcctatgtcatcacaccaaagcactctcatcagatagaaaaacatgactcttcccctctcgcaatcttttcatgaccgcttcggccagacacaacaccgagcccacagcgagaaggcgtgccgctgccataggaactatagtagaagctcgttgaacttatcttaactaggtgggttccactccagcaattgagcttatgaatacctttgccgatgtcaaaactatgatttatgatagcctgagggtacaggcaatcaaaacgactaacccgcacacacaactgctagccaaggcggctgttggggcggagaaggccagggtgaagaagctggtggcaccggtcgccagtaagctctactagaaaaaccatttttcttgataatggcattttttttcaggcaggtaggcctctcggagctaaatgactgcttgctaaagtgacaaccgcggggtgagatggttgtccgcatgcaaaaatctattttcgaaggcggacctcttatgtggtccgcctgcgaaaattgacgtggcatataaataggcgacacatcgctaaattttttttctaagtctcatctcctctcttctccctcagctctcctctccctcagcagccctcatctctcctctccctctcccttagtggccgtgggcattcgacggcaggggcggcgggatccggtgatggcgaagcgcagggtccgcgtcggcgaggcatgggaacggccacggcaacacgcggggtcggcgacgcgcacgtgggggcaacggcacctggcacggctcccctcccagatctggccggagggagggagtggggggcgggacggtggctcccccccaccaccagcatcggcggcggccgtgcttcccctcatctcccctttctctccctctccctcccaaaaccctaaccctagatcggccagaggtgggtaggagcacgggtaggggtggtgacaattcttttttgtttgtcaaaaagattttcacaggcgagtgactgggccatgcaggtgtttgtatataggcgcggggacggccacctgaaaaatgattttccctcgtctagaaaaatgatttttgacctcctgagaaaaaaatgatttttctattagtgaagggcgcttggccagatttttctattagtgaagggcgcttggccagccaccaccaagtttccgaccaagcggtgagggaattaagatgcatcagtgtatggtgttcgatttttggtatacgtctgtgatcaaacaaattcccaatgcttgtacgtactgctcggagtatcatgttccgtatgctctttgaattttgtctatccggccgtcaatcactgtgtcagtgctaatcaattaaacaagtaatactgttgcttttgatcagagtccccgcgacatgccagtcgaatttttttatgagagttgcttgttataaagtgtgtttcctactacgtaataggggagagggccgcgtcaccgcaccctcttcagccaccgctgcctcccccctcccctgaggtggacctggtagtgagggagggaagggccgcgctgccgcaacctcttccacggactgccgccacaccatccgggagaatctggccgggagagagagagaaagaggaagtggataggggagggccacgccaccacaccctcttccgccatggtggccacactccctatccacaatggtatctaggagggagaggaagaaaggggaaagggagggccatgccaccacacaccctcttccaccaccgccgcaacacttccccctcttgcgagatctaggggggctgcgccaccacaccctttttcaccatgaccctcccccctccgatgttgctgatgccgccttctgtcataggagaggagagaggctgagggagaaggagtgggggaggatgtggaggtcttgggacttagcggatttaataactatctccatatttcgcagtcggactacttaaggtcccaccagcaaaaaaaatattttttattttcgcaggaggacctcttaaggcttcgtctgaaaaaattcgattctcgcaggtggggctagatctaggggttttagctatttttgcaaatggtatttttgtagtctgcctaaaaaataaaagtcagtgttggtaaaaaataatttttctggtagtgtcagtgcatccaccaagttactcagctgattttttttttgcctcatcttgtttatgcactgttactgaaaattaatatatttggcaattggcaaagaaagtttgcatgaactgttaacgtaaatgtgtttttacaaatacatgtagctgatgaaaatataccacaagtagatttaatttattccataaatattgaacatgtaaactaagagaaccacatgatgatgcaatctagatgtgtaatacggtggacacataccgagggttcttgttcttttgtggatcaggttggcaaggagtagcgcacactacaggaacaacgcgtgatgttgggtgttgtcgtcggcgcgcaactatcgagcgtagaggaagacgagccgtcatgaaagatcagcaagcatacgcgtgaagtgcttcgaaaaatcttattgatgccttcttccggtgcaggacgtcgaaggcgaaggttttcagagacatgctctcctaatcgccggtgcatgcgataattttaataaataagtccacaacacatttatggttcaataaataagttcataacaagatcgccggtgcataaggtaattacataatattcaataaataagtccataacaagaaaatacaggaaatgctaactaatacagttatagggagaatttactatttgccactctctcaaaatgccagtgctcaaatgctactctcccaaattttcattccca

SEQ ID NO: 30805 - DNA, 4490 bp, Oryza sativa
tgggcctcggcccgagcgaggatgggagagggagacctcggctgccacgcagagggggaggaggaggtgggccgaggagaggaggaggcccgggagggagggagagaggaaggaaaaggccaagtgggtcgagggaggaaaaaagtactttggcccatattcggctcaaatagagggagatgattatttttaggttttaaactctgaaattggttgttgttgtattaaaattatttattgtgctctaaaaattcaagtaaaaaaaatgaggcgatatttcggagcatggagaatactccaagtcacaatccaatttttgttgttatttgagatttattttagacttttaattttttttatttcttttagaaaatgatttttttaaatttagaatggatttatcagatgtcacacattcttaccgatggtgtaatttcatttctcactgatacgttggactatttgagtcactggctgtgttccggaggtgatgttggaaactcagatcctgcgcacgtaaaacggagtgacttattttgttatgattaattaagtatttattatattttgaaaaatagattaatatgatttttttaaaagcaactttcgtatagaaatcttttaaaaaatcgcaccgtttagcaatttaaaaagcgtgcgtgcatatagcttcaatgcatttagcaaaaaaattagaccaaattactccatccctccacttcttccttcttccactttcctctaatttgtgtaatctcttccactagatctgacccccattgagcccactggcatcaacgctcccacaattctccgctctcatcggccgccggtcgtcgccccttccctgcccaaactagttgctcaccgaccatccccaacccactgagctaccactgctccatcacttgtcacccccatcgagctcaccagagcttatcgctaatctagccgtcctcttcctaggcaacagcggagctacccattttgttagagatagcataagcaaatatcgggcctagcgaaggtgaggtactggagagcaccagctaggctgcgataatcggtaggatctgccacaggtggtccatcagaagcagatagcttggcgcaagtgtcgaccggcgtggaacatggtttgcagtgtagcataccagctcgctcaaggagttacacactcctccgacacgggccaccttggtttattgtgacaatgttagtgcggtatatctctccaccaaccccgtacaacatcaacgaaccaagcacatcgagattgatttgcactttgttcgggataaggttgccctcggtacagttcgcgtactgcatgtacctacttcgtcacagtacgccgacatcttcaccaagggtcttccaagctcggtgttttctgagttccgttccagtttgaacgttcgctccgtccacgttccaactgcgggggtgttagagatattgtatttgtatccggttcggtttccctcaatcctatcccgattctatttctataagtcgggtatagagataaggatgtaccatccctatatgtactcgtgtccgtgatcaatctaattatcgcgttgactctatacgctttcacatttgagtccccaccaactgcgacgatctcactaaggagtaaggagtgatttgtggtggccccttcattgtggggcaacagcaaagcgcgtgcctccgtgaatcctataccaccaacccccccccccccaccccccggcatcacgctgccgccttgccctgcgcacatgagcatggcggccaagtcctcatcgcagtcatcggataggggcccagcatgggtgctagtgtagcgtcgagattccccatgggatttctgtgcgtatcctaggggatttggaacagaacatagatgggtttggtaactgaagcactgtacctaatttctggagaatactcccgatcgtgcggcgcacagccgctgtatgcttcatgtgatgttgttgccatgaatgttcttcgtggttcgctacaggaattttcgtcatacttcgaaattatgtaatatcaaaattacatttgttttattaaaattttcgctgaatttaaaggataggtgctcctatgccaaaatagaagaccacaaagtggaccatgcccatgggccccattctcttctcgctctcgagacgccaggtggtgggccacctgaattcatcgcgtacgtaccatgtgattcacgaacccatctgtgaattctactccactcctattagaccattcacagtgcacacacatggcgcgtggcaatgtttggccatagacaaatcgcttacgtggaggaaagaaggcagtggggaccgttctttccattgcttcgcgtgatcaagtttggccacgagaacctcctcgcactcggtcagaaaacctggtcatccatgcgagaaagagagagagagagggggggggaagaaaggtgatttgactgaagagaaactcgatctgcgccggtgaagttcgccggagaagggtgcggaggtggtgaagcggcgacggaggagacgaacccaaccccgacgaaggtgccctcgccggggacctcgctggcgcgccgcttcacgacgacgccgacgaaggtgccgcgccgccagatccgtcccgatgaaggcggaggagcagctcgacgccgtacggagcctccacccgagcgacgccgccgtcgaccacgagcacacactcagaagcagttggtaagaggagaggcacaagcacagtcgcccgacgccgtcaccgccgccgccgcgcagctgcccgacgtcgccgcccgccgcctcggatccacgacaccgagatccgagcatcggcgcgccggcttgggaagaatggccgcctctccgcctgagcgacgccgccgcggtggaaggctacggcgccgccgccgctgcgcgccccgacgagccaaagccaccagatctgggagctcggccaacgcctctccgctccaagccaacacccgcctccttgactcctctgcgcgccgtcccccaccaagctcccgagtgccgtccctcgccgagctcccgccgcaccgccagaatcctgtcgagcgtgatgccgaggccgctccggcaccttccactcgtcggagatgaaaaaggcagaagagagagagcgttgagatgaaaaggtgaaaaagtaaagagagagaagagagagtggagtaaagaagacatggtggaccccgttggatgcaacttgagctgtggcttgcactgtggagcatgtagcttatacaattcttggtctacgtggcatgcgaagaacgccaaaacttggtggcgcactgtgaatggccttagatgtcacaccctgaagttcttcccctaagcctaaatggaattaataattggcctcgagaaattacccgtgttaatgctaggggtgaaatcggagcggattcggatggatagtggtcgtaccatatcctaaaccatatttttaagcggattcggagcgggtgcggatagtatacggatgcggatgcagagcggattgtttcggatgtcggaaatggtgcggagtcggtgcggaatcggttcggaaacgtattaaatttatcggatgttacgtgtatatgcaatcaatgcaacatcgagttagcaatctaaggaacaataatacaataatcaataaatgacccgtcgtaataattatatgattaagtgctaaacaatatgaacacatgatgtccataatataaaaaatatagctatgtgagtgtgacatgatacgataaaagccttagactaaaaaatctttgttaattgatgaattagggcattggatgtaccaacttatgttatatgcaatagatagagtggttatatatgttgataatttcggattatccggcaaacggcttatcggataatccgacaaaattatcggataatctgcatccgctggattttagagataccatatccgcatccgcatccgcctcatactatccgcatccgcatccgtatctaccggatttctaaaaacccataccatatcctcgttttggacggattcggagcggatcggatcggatattatccgatccgttttcacccctagttaatgcaagagagaaaccctaagtgaattaatgcaagtaataatcggaagtggcatttggaatttttcttgagttctacatgtcaaaatatgctaacaagatttttagtggaatttttagagctctagaaataattttaaccaattaaaaataagcataagcattatttaaatccctggaaattcctttttcccttttttttctttttctttttccctccctcctcctaatgggccgccggcccatttcctcctccctcccgcgccttgctgggccggccaaaggccacagcccagctgagcccgcaccccttctctctctcccggggtcgccgacaggtggggcccacctgtcgggcccgtccccaacctctagccggaggagg

SEQ ID NO: 30806 - DNA, 3670 bp, Oryza sativa
ctttttcgctttgcaatcacccgctcccgtgccctctttcgctctcgcaccgtgcgcccgccaccgccgccgcttttccgctctccggccgccgctagccgccgcgccgagccgcgccgtcgacgtcgtcgcgttcgccgtcgtgcgggccacctcgtctacccctcctccgtcggaatccgccgccggaacccctccttcatcactcgccgatgagcatcgccatggccgccgccttcggccggcgtcctcgccctctcccaatttcctctctccctctaaccccctctcctcttgttcactaggtgattccggagaccgtccattgttcgccgtcgtctctcggccggtcctcgtcgcccctccgtgccggccgaacccccggtgagaaacccccgcaatctcctcccctctccctcctagcgccgacgccccttgccgctcggggtcgcgccgtcgtcactcgccgtgcggcgccactcgccgtcagtcgccgctgtttgccgccgccgcctcacggtagtgccgctgtgcgccatggccgccgggtcggcttgagccgtgcccgcgcgcgcccggccgcgagccgcctccgccgtccgatctaccgggcggtagatcggagccgcccgtcccgtcgcccgcgtggtcacccgcgtggctgccacgtcggtgccgcgtcggcaccacgtgtgcaccacgtggtgtgccgcctccttcccggtccgtggaccttgtccaccgcggactgccaccccgagccaatgacatgtggggtccgcatgtcggctccgccccctctctctccagggttttaattattgcgcaataaatcctttaaggattttctgtttattgtaaaaacacagtgaatcttctaaaattcatagaaaattcatccgtgctccgtttaaacccattcaagtctcagtaaatcaagaaaaatacaaagaatccattaaaaatggttttattctctgtttcagtagtcttatggcctatttgtcttgtttgctttgtatgttgcttagattccggttctcccgacgctccggtgtactttaaaatagtcgccgaggttcgtccagcagcagagcaaggcaagtcatgcttgtcacttgaacatattgaacctatattgcaaatgctctatcgtttccctaaaatactgcattgttttacaatgttaccatgggatggttacctactgtttgagccatgccatttgtaccatggtcctttgttagcttgggatataacatgactagatattggactaaggattgcttagccatgcttagttcaactagcacacaatgggggaatcacattaatgcatagacttcaggttctagtgttgatgttgaattagtgtcaccgtcctggtgttggtcaattaaaatgtactatatggtgggctgtgggtgtatggttttgatggtcgcgcccatggtacttaaggaccggtttgcgagatgccctggaagaacttatcgtacttaccacaaaccagcatgggcaacggctgggcttgtagtgtagctttcctctagctgacgcatccaggtaagggtgagcgtgatggagttcggatgggccccgcgacggcttatgcggctttcggattcacctaggcacgagaggggactgcccgctgccttgcgaggagtgggggtaaaacctgaggtgtggtgtacttggttagagggggttatgcgaagggtcctatcacggcctctttccgttatgtcgtggtggcatgttggcgcacggaaacgtgtcatggggctatgtcttgtgggtacagtggtacacctctgatcagaataaaactattcaaatagtcgtgcccgtggttatgggcggtcaaccagattcaccatgattagtctcaccctagtctagtctaatggaattgattagttcaggtgggtggttgggcctgttgcaacgtggtatagcgttggacagtggatggttaatattgattaattattacaactgttttactgctttcaactactgtctataaatgctcgctttatacaaatgatccgctctagctatcctttggttatatcctgcatcataccccctatttcggtatgacttgctgagtacagtgggtagtactcagtcttgctctattttccccaaatccccagagtttgagtatgcgtcagatggtggcttttccgaggagtaggcttcgtccgtgccgtcgaggatgcctgtggagtggtgttcccgctgcagtccaagtcaaggcttagctccagttatcttttattttccgctgcatttgtgtaagacttttataatgtttgtaagacatggatctatatgtcaactttgtcgtttgtgtaccccggccggtcttggacgggggttttaatacacattctgcttggaattctattcgggaatttctgggcgtgacattagagcaggtacaatagtaaactattatccagttataaatatattttagagagataaaggatgagagagaagagcagcgaactatagatctatagccagctgtagcacagactccaagacgcaacgtgtgtatgacaggtaggaccatatattaatagtatagtaagcaactattgtataaattagctattaaattgtctatagatgatttggagctagtagtctgctatactattaagggcatgtttggcacagctctagctccagctccagctccactttttccggagctggagctcagccaaacagttttagctccacctaaaatagaagcggagttgagtggagctgggtttaggcaactccataactccactccaaacctaactcctgaagctaaatttaggagttgaaactctaccaaacagaccctaaacttgctcttagtgtccagtccaacgctagatgggccggtaaaaggcctatgcctagtacaccaaacagctctttcatggccgacacacaaacaggcacgggattcgacatgaaccgtgtccatgcacaatgcacacacacacacgacattatctcgatcttatccggccccaattaacgtgcgctactgagcgtcccccaccaaagccgtcgtcaagtgaggctaaattagtggggtttggcagggttagcgtctggtcggccagagaccgctgcaacgctgctagatttgtgcttgctgttgctgctgctgactgctgttggttagccggttgccatccaagtggagcaagcaagtacgtcgtcgtggcagtggagggacgtactacagtacggatcaagcccttcctcgggaccacaatctaggacgacacatggatcgatctcctaccatccatcatacacgaccgtccacctaagcgtacacgcactgaagactggttttttttgccatattataatcattggaagattctttacaattaatgtcggctttgatttgcttgtgtttgtgaacaattgagatcactcctcactgatatatgggtatgagggtacatgagattcacgtgtctacgtgtaatgctgtgacatcctgacccagggctcaataggataaatagaatacccaaggctcgataagattaataggatactcatatctataagtgacgaggactctctctctcgttcataaatgctacttcctccgtttaacaatgtaagtcattct

SEQ ID NO: 30807 - DNA, 16600 bp, Oryza sativa
  unsure (1)..(16600): unsure at all n locations
tacattgttaaacggagggagtactctagatttgcatcaaccaagtttgactagtaattcgattgcaatataggtccatccaataactatatactactaagagtactaatagggatggtaatagtgacatgaaccccgacagagaattactcgattagggtacgtaaatgggctaaaattatcacccatgaggctgaaatcttgaaaatattgccccgtcgggtaatattaagttagtgacctgaccccgttcaacagcccccggccccgagtattaagttagtgacctgaccttgtacggtttttctatttgattttaacttcatcgttatcaccatccaaacggcattacaagttgtcctttttatccccataccaaaacgtcgatcggtggtgtagttggcttccgggctaaccgagcaatcgtccaggctctgtcatccggtgttgttattgtctcaatgaaaattaatgactgtagaagtttttttttaataatagaatagaatattatctcggtctttgataaatgagctacataaaattattacaccaattcgtttaaagcgagcgcagttcaaagaaaatttataaaaacactcccaaacatgaagcaagcacaaaactaataaagagtaagacacaagataaagagtacacaattatttaatcctatttgtgaacttccattcgaagttgataaaaggttgcatgagaattgtctcaagattacaatatgcaaactttaaaagcttgttgttttcatcacacttttgtgagccaatgactgtagaagtttgtcaaggttacggataaggcatatctcctatcttacaatttactgaatatgcaagattggtataccatcttctatacgatatatttccatatgcgataaggaagtatataagatattatggaaaatatcctcacggtctggcgattaacaaagtcctacttgaatatgataggattagtctatatcatgtagggttcattgtctccgagttttactcgaagactaaggcaactcatggtataaaaggcacacccctagagaggttcaggatcatcgaatcatagtgccaaccctcccacctcagtttacaaagtcgaaagacacaagccgaagctgccgggagatctcgtcgaacgatctcgacaaggacctcgtcggtatcgtcggattcatccgttctctatactatgcggttttccatatcaatctcatataaactggattagagctattaccttacaaggggcctgaaccagtataatccttgtcttttatccgttttgatgtcgtatcgtgtagatcctcgtaccaacgtatcccaatatcctatttatccggtctacgggtatcccccgtgacaaagttagccgacgactagaaaatacttttgttttcatctgggcttaagaacaagccacctttgcttaggaagaagctatggtggaggcagattgctatgctaccgctcatatggttttgtgagaggagttgagctcgctggaggtgaaaaacaagctccgttaagttccaattgagggcttgttatatctaccctaaaattttacatcttgtcatattgaacgtttgaaacttgcgtgaagtattaaatataggctaaaaaaataactaattgcacagattgcgactactttgcgagacaaatcttttaagcctaattgctccatgatttgacaatgtggttctatagtaaacatgtgatattgatggattaattaggcttaataaattcgtctcgcggtttactgacggatactgtaattagtttttttttattagtgcctgaacacccccatgcgacaccctatataatacccgatgtgacacgccaaaactctacacccctggatctaaacacccctgaaactattttaagccagctgactaagggcctgttcagatcccatgacaaaatttttcatcctgtcacgtcgaatgtttatacacatgcaaggagtattaaatataaacgaaaaaaattacacagtttgcgtgtaaattgcgagacgaatcttttaatatttgctaatgatggattaattaggcttaataaattcgtctcgcagtttacagacggaatctgtaatttgttttgttattagtccacgtttaatactttaaatgtgtgcccgtatatctgatatgacccactaaaacttttcacccctggatgtaagcacaatctgactccattgccagctagcaaatctgtacttcatgatttttttaatatgtcttccatacaaggttgcccggggggaggggaggacaaaacgtgaaaagcagcccctaattaaataaccgtggaaaattcaagagaaatagtcaaagctgagaccgtacaaaatcatctcatcacccatccatgtatccaactaggagtaaatatgaagtgtaaaccacatatatattctagaaacttaaaaatcatcgtacgacaaaaaaaatgtactttcgatatgtatccatattattataagtaaaacatttacttttggatttaactgttagtagaagttttaagagaaataaaagatttactcgtggtgacgtgaataaatattatacattcattttaatatcctagggtttccaccacatatttttccttacatcatgatcggttaatccccatgagaccttgttcgatttgaagggggaataagggaaaataatttcatattataataggtgttgaataaatccctccaatctccctctcttgaggattaaccgataagatctaagggagagattagagggaatttacttcgcatctattacgatgtgaaattattttctcattctatctaatccatttcaatcccctcttaatcgaacaaaggcattaaccggaaccatcctcctacctagcctgttttccctattctggcctctcatagtcataggtgagcacttgcctgccgccgcctccctgaacgacgaccatcatcaggtccgatgctctctcgggacgccaccggtggatctggccctcatcggcatgacaaccattaagccgccaagaactaggccaccatcccactgcacgcaagtaggaggcgtagctagcgactggtggccggcgcagccaacgcacctccccactaccaattgtcactgcatctccctgaacggctgccgttagatccggagttatccgggggtgccacagttgaattgggcccttgccggcctggcaactaccaagctgccaagaaaacttccaaaacaccaagaaaacgaaactggagtagaaagagagaggaaaaaaggaaaggatttcacaaattgacttcaataattgttttctccttgtgtgttggtttattatttatgttcttattgttgcctgggcatttgctttcttcgagagaattttgtaataagttgatgtatcttctttgaagcaaagactggaatttttattccattataagaaaatggaaaaggaatggaaaaaggaatgagatggggaggaaggtggtgggtggagcggctgcccagtctcaccgccggaggcgatgcggtggccatggattggccctttggggtgtcgggaatggcatcccaggccgctcgaacaagcgacggccgaaagtttatttttacaattaatttttaaccgagtccgatctttaaataagtgttctaataaaagagtaaattagacaaaaaaaaaattttgttctcactcactcccctgatgaagactcaacactcaacagtagtcaagtcgccgtggcggcctgcgccacgtggtgaatattcttggtggtcgctccacccattcggctcgcggtcgcgggttctgcacccaaccaaacgtctaaacccagaagtcgtggaccatgccaatggccccccgttctctctgctcgccagtttgctagctaggtgcgctgggctgcctggccctggggatgcatcgcgtacgtacatctgcaccatgtgattcatcacgaacccatctgccaattttactcactcactagtaggagtacttctactccagtgtccagtcgtccatcacgaaagggaaacgcttgtcctaataccaaacgctcctttcatcgcccacacacacacacaggcatatggaaccgaggaatcgtacgtgttcatgcacacacgagacgggacatgatttcttcggtcttatcgccaacgttcgctactgagggtgtgtttagannnnnnnnnnnnnnnnnnnnnnnnnnnnctgggtactatataggtgtcgtatggggtgtttgaccactaataaaaaaactaattatagaatctattagcaaactgcgagacaaatttattaagcctaattaatccatcattagcaaatatttattgtagcaccacgttatcaaatcatgtaccaattaggcttaaaagattcgtctcgtaaattagtcacaatctgtacaattagttattttttagcctatatttaatactttatgtaaatattcaaacgttcgatgtgacagggtaaaaaattttggagtgggcctgtttagaagagctttagattctgacaagcagctgtctggtagccagcttctgagaatctggaaaagctctgagacccagcttctccagcttctggtttcagaatctataactacagattctcagaaactgtggactgtttggggcaacttctagccgaagcggtttttgagaaaagctatagctggggcaagcttcccaaacaggacctaaccttgaccagccccaaccccaagccgttacaaagtgaggctaaaatagcgtctggtcggccagagaccgctgcacgctactagattgtggtcttgctgttagccggttgccatccaagtgttgcaagtgcgtcgtcgtgggagaagaggggacctactactactactgtacggatcagcccttcctcgggagcacaatcgaggacgacatggatctctctgtcctaccatccacaccctacacgaccgtccacctatgattgggctgtgtttagatcagggcgaaaagttttagcgtgtcacatcggagtattaaacgtatactaataacaaaacaaattacagattctacatataaactgcgagacgaatttattaagcctaactaatctatcttagcaaatatttactgtagcaccacattagcaaatcatggagcaattaggcttaaaagattcgtctcgcaattacacgcaatctgtgtaattagtttttctttttgtctatatttaatactctatgcatgtgtctaaacatttaatgtgacatgctggaaaatttttgcggaactaaatatagccttggtttttgccgtattttaatcatttggaagattctttagctttaattattttccatgtgttttgtggatgcctactgtagctttgcatcaaccaaatttgactaataattcgatttcgagtgcaatataggtccaatcactatataagtcacttacctgatctattttaaggtttttctagtggattttaacttcaccgtctaatcaccatccaacggtatatatacaagttagtcttttttttctttttcttttctttttcagtggtggagttggctccctggctgaccgagcaatcgtccagctctatcccgggagttgctattgtttatcagtgaaaataactataaaaattaatcgacgatcagaaaacattttttgtcacccaggttctagaagaagccaccttgcttaggaagaagccatggtggagcgcagattgctatgctagcactcacatggttttgtgagagggggcatgagctcgctggaggtggaaaaacaagctctgttaaattccaatcgaaattccaatatttgtactttcacgataattttttgttaacatgttgtcttccacaggaggttgccgcgggcgcgttagcgggaggagggggggggggggggagacaaacgtgaaaaactactgcctaataactgtgaaaaatacaagacaaaacatctctcacccattaatcctgagaaagctaaatatgtagttgtaaacttaaaaactaccgtaaaatagaaaatgaacgttcgagatttgttcacatcgccatgattaaaactttactcttgttagattaatgggctacacccaattaaatcctaataaattccattagcccacattaagtgctatgggtaataataccactgtagaaatctaagtgaagaggtctcaacttaaatatggagctagttgagagtctctgttgaccggttgagatggtgcgtggacagccagccggggcgggacggggcgaggcgaggcaggctacttctctctctcgttttgtaacggacggtaataacgtcgtgaattgattccgtcttgtaacgggcggtaataaaacgccgtgaattgattccgtcggttatagaattaaacgtcgtagaattgattctgtattaacaagtgtgtcggttacggaattaaacgtcgtgaattgattccgtcagttacgggattaaacgtcgtgaactgattccgtatcaacgagcgcgtcggttacgggattaaatgccgtgaattgattccgtcggttacggaattaaacattgtgaattaattcaatattaacgagcacatcggttacgaatttaaacatcgtgattgatgatcccaaacgttactctcgcgctcacatatatatactccgcagcgactagaaggaagaagataagttcttcccgacgtctcttgcacttcaccggttcctcctcctctgttcctccttctctgttcctgcgctgtagaatccttcaccggttatgttcacctgcacgcaaggaactccgtccgtttgagaacctgcacgggtaggcgggcaatcatgtttttgggtaacgcttcaagcgcgactgctctggttcttcgacgacaacattgcatcttcctctacttgctttaccatggtttctactagagagaacggaggaaacaacatcaacggagccaatacgaatgcttcaacatcttctgcaccgttctctgggtataaaattgaactttatttgattttcttcttgttatttacatgttaacaatgttatccataggatttcaatcctatgtgaatataaacgatgtctatgcttattttaccttaagtatgctcatgtttacgtttagtctcatcgctagatcgcttctaattatgtatgttatgattattctcttaatattttagattaaaatatgctgagttatgattaaattttcaacaactcttaaatttaaccatcaataaaagttttaatagaagttaaagatttactcgtagtaacgtgacaaatttcaaatgtccatgttaaaattctacggtagtttttatgtttccggcatatatttttcttttaacgggagccatcctcctatcctacctagcatgttttccctttcctagcctctcatagtcataggtgggcactggtagctaggcagcgacgccgacctgtcgccgccggggaccatagtcatcactgtagtgacattgttggacctcttcaagctttgccttctcccctcctccagtcctcttctcagatattttcagattttttttttgttgacctactagtgtgtaaatgtttttgggatagtactccattttcgaagaggagaactgaacatgtcactagactcactactccgtagcaatctacggagaagtaacaatgagggcacgtttggtacagctccaactcctaaatttaactccaggagttgggtctggagtggagttgtggagctgcctaaacccagcttcacaactccagttcattttatgagagagctccacccaactccactcccagttttggtggagctgaaactgtttggctgagctccagctctaggaggggtgaagctggagctggagctgtgccaaacaggccctgattgatgattagtcaaacaaggcggcagatactttgagatgttttgtgcgacacacagcaacagcagctggaaatatctcttgaacttatcgataaatgtatggtagtaataagttgctaactatctaccctttcctgtctaaaatatgacaaaccagtactgtattaaacataatttagtattacaaatcaagatttaagtattagtgttgtttaatcaagtacaatattttataacgaaatgagtaattcgacaaaaaattactttatccgttccgttctttaatataagggacttccgtcatataggtgatagcagaattaacaacatgtgtactatccacaattctttcctaaatacacgttgctttaagagatggagaagcattaatttccccctcactaaataaccgatgtcatttttactagtactattagataatttattgtatttcacagtacggtacaaattgagggcaatagaaacaaaaaagacaactacgattctttctctgcacaaaccaaaaatgaactcctgctacgacctcacaatcgatcggctcatcaatagatcgagatagctaggttggccatgaacccgttctgtccccagacgatttcccagtcgacacagatcgaatcatcttcaaacaagatttagatttgaacaaatcattatccccaatgcaaaccccattcattcattcatgcattgccgacgaccaatcaaaaatgccaagttgagcctcaactttggcccggtctaactacttgttggcctcatatcacgcatgcatatgagactggctaccacatcgatcggtaaccaccaaaccagatattttgttgctacacatctgcactgcatgctctgctctgcaccctacgtacacatccccttcctgatcgatcactcattagcacaaccagctgcttcatcaacttgcaggtaatcaatagtgacatgcaactgcaaaatggtcctgcagagtacgcttgtatctgcaccatgacaattatattgtaacacacacttgacactttcattgatccattcgttttaagttgtttgtcgtttcggctttgttctaaatcaaatatactacttcctccgtttcacaatgtaagtcattctaacatttttcacattcatattgatgttaatgaatctaaacttatatatatgtctagatggaaaatactagaatgacttacattgtgaaatagagagagtacatatgtctattcgtgacaatcaacttctaaaagaaattgtagtttaacaataggtaaattatatattatgaaagtatttctcaagataaatataaaaatataaatcttacaatgttagaaattgatatcgaagatacaaatgtttgtcttaggacgaagttagaacaagtaatttaaaacagttagggtattaagtatgttgacatatactccctcaatttcaaaatgtttgacaccgttgactttttagcacatgtttgaccgttcgtcttattcaaaaaattttatgaaatatgtaaaactatatgtgtacgtgaaagtatatttaataatgaatcaaatgatatgaaaagaataaataattacttaaaatttttgaataagacgaatggtcaaacacgtacttaaaaagtcaactgtgtcaaacattttgaaacggagggagtatatgttttgtacttttgtaagtaagagtacttttgatttgttaatgcaactagcattagaggggtgatgcatccagatcaacaaagtgacaccaaactattgttgtataggagtaagagtttgactaggtacacttgaatttgacagaaccctggccggcaaaaactatggaagcatatgcgaattgcgcaattggataactccagataagaaagcgaccataataagtttaacaacgccactgttgaattagtttttgtcaaaaagcacatcactgctcacttgtcaagtcgacaagtcatcacttcatttctaatttttcctttttctttttgtttcttttctagtattttgaaatgaattgtggatggtgacgtggaacagaaaagtcacgcgctgaaaccgacgtgtaccaacgggaggagctcgacgtgtaggccatctggaatgatggaagaagaagaagtgacttctggttgggtaggcaaaggagttgctgctaagtaatggaaggggtgtttttgtaattttacaaggcggttaggacaagcaagatttggacacctgtcgtgtcctatgctcatatggtattaaaatatgttagttgaaaatcataatctaatgaagaaaggattagtttatggagtactagggctcttggttgccatgtggagtatttcagtgagtagcaagtgtccagtttccagtgagatggcacccatggatttctgtctcataaaaatgcaattaaaatttttgtactgcctcattcaatacttttatcctttttagctaatctaaacacaaactaaagcgtgacaaaagtagaattctctcttattgaaaaatgtgagtaaactttgtgattggaaagaagtcgtacaaaattggactgaattcatatgccatctgtatcaatacataaaccggttatcaagacacatttgtaacgataaaaacaatgtacagtacgtactagaaacatttcttggatcccatttcaataatcattctgacaaggaaaacaaccaaatgggcacaaacagtttcgctttcttgatagccatgtcgcagccacagctttgtttgctagaatgagacacccctgattcctcagccacatacttagattaagaaactaatcaccttcctcaatcttggttcctaatccgctataaaaagcagaggaaagcagaggagacaggcagagcagaggagagaaccccaccttggcaaaaagaaaagaaaaataatatcatcgcactttttgctgcccttttcatcccctcggatattcacgaagcaaatctctctgcaattcttttcttttttttttttgatcttgcggatcttctccattgaggaaaggcgagagctttgggatcgattccgggccatggcgaaggaggtggatccgtgcgaccacggcgaggtcgtcgacgccgggtgcgtccgcgccgtgctggccgagctcgtcctcaccttcgtcttcgtcttcaccggcgtcgccgccaccatggccgcaggtaagccccgccgctcgccgccgctcccttctccggtcgattaaatattttcgttttttttttggttaaaaaatggagtttaattttgggttggggttaggggtgccggaggtggcgggggcggcgatgccgatggcggcgctggcgggggtggcgatcgcgacggcgctggcggcgggggtgctggtgacggcggggttccacgtgtccggcgggcacctgaacccggcggtgacggtggcgctgctggcgcgggggcacatcacggcgttcaggtcggcgctctacgtcgccgcccagctgctggcttcctccctcgcctgcatcctcctccgctacctcaccggcggcatggtaagcacccaacccgtcaccgccgttaattctttctttctttctttgcctgtcaaaattaggatccgtgaaaagaggaggaaattttttttatttgggggtggaatcatgtcgttctctcgatttgtccgtggccatcaacttctaaatttgtttttgttagctttttttgggaccagatgagatgctgggttaatttactaataattcacctgataaacttctgtgggtttaaggttttatagtagtaattgttgaggaacttcaaagattgtcaggtttttaatcctgtgattcagttggttcagtttaccaaaaaaaaaaagactttgctgaaaaccattagttacaagcctttttaaatcagttttgtgattcagaactgtgagaattctagttcaatctatagttttgttttcttatttggataacaactgccgattgcttcaaccaaagtcaaccaaagtcgtataagatatgaatcattatgctgttagtgactctgatgaacttccaggtttgtattctgctttagtgcctgaagtctcaaaaaccctctagagtcttggtttgtaaagcatatgtatcacaaagttagtacaagttagccaagttaaacacgctgttagcaacactgacccttgggaattggaatagctggtttaaaaatacaagttgaagactaacataggcgagaccaagtcacttgatcgtactttccggttagtccacatagatacataagcaaattcatcactcctaagtataacaagttcacacctgtgctaaataagtataaattaaaggccacatcaccatctggttttctgttcttttcaagcatcttgtattcatgtgtaagctgaacacgataggtatcttcctcacaatctaaccaaactgtcgtaatgtgcaatgcaggcgaccccggtgcacactctgggctcagggatagggcccatgcagggcctggtcatggagatcatcctaaccttctccctcctcttcgtcgtctacgcgaccatccttgacccgcggagctcggtcccgggcttcggcccgctgctcacgggcctcatcgtcggtgccaacaccatcgctggtggcaacttctccggcgcgtcaatgaacccggcccggtcatttgggccggcgctggccactggagtgtggacccaccactggatctactggctcgggccgctgattggcgggcctctcgctgggctggtctatgagtcattgttcttggtcaagaggacccatgagcctctgctagataattccttttagtagtctggtctctttagatggtttcatttgcagaatgcatatattgccaggtagtaataagatgcttgtgcagcttgtaggcctgtaagggctgtataattattattttctttttgccctcgaggattttatcaacgttgataatcagccatgtaaaaagattgtttgggatatgatttttttgttagtataaaatgtagtccggtagttggtctgttgtaaatcggcgaatgccatgtggttttgaaattagaatctatgtaaacattttcaaatgaattcagtaaaattcatttcaaatgggtatcaacttgacctcaagctcttcatatatcatctaaacaaaatgctaactgttatggctatgtacacctagcagcatagaaacacaaggagatccaagaactgaaaaaatcaatggctcattgcagctattatctgtgctgccagtgcaatatgcatacctgcttgcttggcccatcaatttggcccaaaactgttatgatcataatgaactcaccacattcatggagttgactgtctatgcgccagtttcaactgctatcttacttcaattttaattttggtatcgggtatcgccaaaaattcgtaaggtataaaatgctatttttccaaacaagtttgtaatggagctgaagaagtggaacgactacgtgccgaacgtagaacaatgtcggctgacttatggaagaaccgtgtcaaaacagcagatcgagcgcaaattcaaggctggataacaaaactgaactagatgatcacagcgctgctcacccagaatattcagacatttctattcatacgctctactctttctttcttcttctttctttactttttacctctgtattattttatctcctccttcccttttttaaatggccacttggccttgtaaaccaccgatcaccattaatacaatggttataaggtagagcctctctaccttttacctaaaaaaaaatatggtgtgcagcaaatcctcgctagctcaacgctcccaccatcctcaccttcattggcaagctcagggctatctctgtcaacggtgcctcaagctccaccccccacatgccactggcttgtggtcccactgccgccgccgagctcaggaccccaaatggcgttggccacatgttctcgcgggtgtcgccgccaccggcgggaagctcgaagtcttctctgacgactagcggttgcttcgacgacggcgtcatttgctcccctagcgacaacgtcttccttccacctaagttcatccgtgacacgtgatggagagttcttccaacgtaggtataaaatggataaagagatcaccacatacgcgtcttggaaagcgtaagaagtatcgacgcacgtcacagtgtccgcctaatagacggggcatgttggcatccctaagagcaagtttaatagtataggcaactactagctacaagttatctatagccaatttattagggttatggataccacatacctaatagtagttgactaaatcttggcaggacccaccacttaccatgtcctatacggaaacaacctgcggatataggaggagttccggataagagaagacaaccagagttctatatggaaatgacaagtactactcggattgtatccatattggtttccctagttctacttagacaaggggacacctatgggtataaatacaagaccccctatgaggagaggggacaatcaacacccaccactatcaactaacaatagatcaatatacaagccaacatacgccaagataagacgccgaatatcgacttcagagataggcacggctagtcccctacggtgtctccggatactgataggagagacattgcgctgtctctgatctcgccgggcacggattcgaggaggaagactaccctgttgtcgactacgagtcagacctacagaccgccaagtcgacaacagttagataggctaccccaaatattgtattggtgtgattatggtgaataaaagcaataccggcttcgcccaacaggatgtagggttattacctgacaattcaggggcccgaacctgtataaaaatccctatctctgtctcttttacctcagtctcgcgtatatcctaataccgacgatccccataccatgcaaataccggaatcgtgacatcaaacgtcgacacaatttaatagccaattcatacaacagttgcttataatactattaatatttggtcccatgtttcatccacacattacgtcttagagtccgtgctgcaactggttacagatctatataccgctgctcttctatctgctcttttatctctttaaaatatgtttatagttggtttatagtcagctattgtacctgctcaaagccgttcgacacgagttgcaggatcggacattcagaacaaagcattttcatgaagaagtgggtttgtgttgacaaatttatttatcatatttttatcttgatctgacgacaaataaattccattattaaaaaagaagagagaatcccttatatgccactgaaaattagtctgatcccttatatgccattgaaaattggctcttcccttatatgccattgatccaaatttgcacaccctctcatgccactcccattagttgaccgtgtgttgaccaataaaaatcaaggaaaaaagatgtatttacccttataagtatagggcatgcccaacaactcagggagagcatatatgtcttttttactttagagttaacggtcaacaacggacaactgactattgtggcatgaaagggtgtacaaatttgcaccaatggcatataagggaagagccaattttcagtgtcatataaaggatcagaccaattttcagtgtcatataagggattatctcaacaaagaaatacgtagtacattactattccgtttcattttatttctgcagactctagtcaacaaacttatggtcgtaatttgcttttagagcgattttaccggtaggtagtattacattttgtaacgtaaaatttggtactagtacgatacatcgaggtatcacctcaattacagtaaaatttctcacatttttaagatcacaatcttcaatttcaatttcaagtcagctcggagcaatccgatcaatggttgacgacgtcgcagcgcctcctgatctccccttcgtctccggtgagcaccccgctcatggcgagcttcacgaacgccgacgagaaggcccggaagaagcggcgcccgtccgccgcgaaccgccgcacgtgccccgccgtgcgcgcgtcggcggcctcctcggcgtcgacggcgaagatgccgcgcccggacgccgcattccagtagtagaggttgtcgaaccagctcggcgtcgcgtcgctgaggacgggcacggccgccgccaccgcccgcggcgcggcggcggggcacgccagccggagcgccgcctcgaacgcggcgtcggagcgcccgcgcccgcgccgcgccgtgtcgacggttgcgcagtggccgccgccgagcgtgtggccgccgaggatggcgacggtctcctcgacggtcatgcccttgctctggaacatggcgagcgcgccgtcgatgccgaggaagctgtccgggagcatggcgtcggcgcgctccgcgctcgccgccgtggcgtccctccggccgaggggcacgccgcggatgcgcggcccgccggcgtgcgccacgggcgaccacgccgcgaggacgacgatgtcggcgcacgacacctggccggggcacgcgcgctcgac

SEQ ID NO: 30808 - DNA, 14700 bp, Oryza sativa
tcaaaatcaatttattttcctgaaatttcctcaaaatgtttatgcattttgagatagtaaaccatgcctcgaacatatgatcgactttataattatgattttacgtaggtagattttgatgatcactaatagaattcaataatttttatgatctttttatgctgtgtgagtttttattagttcatatgtgcttttgtttattcaggtgtgagtttttgttgagttagtgtaattattggctgtagcctctttgagtaaaggccaggattatattccattatcttaaaaaaaaatcaacagtgtgtattggagacaaatatattgtcagtacgtacctgaacttggcagtcgtggaagaagaggcggaggagcgccgccggcgaggtctggtcgacagcaaacaccggcgcgagggccatgtcgacgacgagctccagctgggggcacgaccgccggtagtagtcgccggagaggccgccggcgccggcgccggccgccatgcctgcgccacctggtcctggtgctatcagtacaagtagcgttgcaagcgcaagaaccgagccagttgcaacgctaaccattgcactaatactagtacccaatgtcttagcttcttaagccttcactaattaattaacttcgatatcaagtagaggagttgtgtagtttcgttcgtgtgatctacttttcttatttatatatttgtctctggagtgataggagtaatttataggtcaaataggatggtgatgggcatggaaaaataattcaggtcatgtcttgcatatgatttaattgagtcagatcagtggatgaattttgatcgaagtgatgctaggggacttgtgtcgcaatgggagatttttctattatcaagaggttgctgcctgttttgcacaagaaatgtgactgtgttttgcggatagtgctaaatcaagatcgttaaacattttggtttaatttgttagctagtattaattgaaacgccgagcaagaagctacccactttaattgctccagaaatgggggatttagacccagaaaattcaaaacccggtggtgcgaggaattggatttttacaactccactgccctatactcgtttacttcgtcactactcagttatcaacaacaaaagctattaaaaaaatcctgagaagaattaacgtacaacattatatagtgtaacgtcccgcctcccctaggccggaccaacatatatcttttctgcacactttgtcctcactcatgtgcacccgggttcccggtcggtcacccatcccaaattgctccaggccaagcacgcttaaccctggagttctttggagattggcttccggaaaagaagttgcaacttattgatatgagtattctattaatcctattaagccctaggccgggatgttacaccctcacccccttaagagagatcgacgcccgtcgatctaccctaggctaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacatacatctgatagctttcataggtcatagactgccctccaccctcacccccttaagagagatcgacgcccgtcgatctaccctaggctaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacatacatctgatagctttcataggtcatagactgccctcatatcttttctgcacactttgacctcactcatgtgcacccgggttcccggtcggtcacccatcccaaattgctccaggccaagcacgcttaaccctggagttctttggagattggcttccggaaaagaagttgcaacttgttgatatgagtattctattaatcctattaagccctaggccgggatgttacatatagcaggtgtctaccatgatgcaaaatttgaagttaaaaagtcgatctacacaaggagaagcaaaataaatatatattttttcaaaatacattacagacagaggcattcatataaattaacatatatatatatatgcacagattatccctttaagtacctcacaataccgagccggtatatgttgagattcacgaatttatcatagcatctatgagcacttctgaagactaatccggtatctcagattcatgagtcaccatagtatcgacatctatcgctgaaaaaattccttttctcctatgtacccttctttttctttatgtaaattcttctgtaaatgtttttctcaataaaatcaccgtaggaggctaggagcctctcctgctgtttttccctaaaaaatcgctgaaaaaaataattaaacgtaaatacaattacatgtgccaagtcttgctaggacttgaacctggataggtaagttccaccaccatgtgaaaaataaccaattgaactacgcaaacttcatcaaaataaataatttgagttatgttttttttatgttgaggtgtgaaaattgaatttagtgttgcatacataacaatgtaatctatgctatgaaattttttatgaccattcagatgacatataagagataagttatttgtgttgcataaacaacaaatgcacttaagtactggctggttttaatgtttgacattattgacttttgattgaatatatgttttaccattcatcttatataaaatatatgtaattgttgtttattttgttgtgatttttttataattaaaggtattttaatcatgtttttttatatttgcatatttttaataagacgattagtcaaacgtatatctcaaagtcaacgacgtcaaacattaaaaatggaagggagtatatttttagaatttaagccactgctatttaataggagcatttttactgtttttattgcttttaataatgtttgcactgcattgttgttatttttgcaaatttgcatacaacattggtactacccccatgtatttaaacagacaaaaggctacccttggacccttggtccaaattcaccgaaacaattttaaagaaggaaaatccttttttgcggagaaaagaagtgatatctgaatgttcagtattaaaatatggttaaattcgctagaaagaaaacgaacaacccgctctgttgtaattccaacagcatctctacaaatagcattcaagatatatacacgcaaagtagttctgcaatgtgtgctggggcccaattgctatatgttgttatcctctgataattagctgagttcggatgggggagatgggagcctaactcctgtgcacggaaaacggagtggtccattaacacgtgattaattaagtattagctaatttttttttcaaaaatggattaatttgatttttttaagcaactttcgtatagaaactttttgcaaaaaacacaccgtttagtagtttgaaaagcgtgcgcgcggaaaacgaaggagaggggatgggaaaaggtgcatgcgaacacagccagaatgttgttgcaaactgcaaccagtcatatgatgatttataccaacacttgatgaaaccaatttgtgtagcgtattgcgtatgctagagtttatataactgaacctaacactattgtcagtttgccttttcagctcttcagtaaagtcagtttgcctcacatcatacatgcagaatggattggttttgtataggttattaatttctcattccagttatgaatgcagcatgttctatgggcatgttatacaaagctctaacttcaaagtttaactccaggagtttagaacttgagtggagttttgaagcttctaactcttttattttatgagagcactttagtatattccactttattttttgggtggagctgaaaggtttggctcagtttcaacttcgggtttcaacctcagaagagatggagttggagccgaagttctgtcaaacacatcctatatacatattgcacatatatatactactgtcaagtagttcctccaaccatatctacggcaccaatttttgcggtggttgccatatcgatcatgtacatggaatgaccaaaacaaattctttagacgacgctgcatgttagctagctcgttcagtcgttctagacttgaagtttccagttcaaacagactaccaactagtgttgcatggctttcacttagctagaaaaagatcgatccggccgtcccaatccaatcctggctgctgataattaaattaagtaggcgataggcagatggattatggataccacatgcaaaattgtgatacttgtgagtgtcgatatgtgactactagcctgcgagcaactattcagctgaactataatatcttcttcttacacccgactggataacctgaagtgtgtcactagtacaataacgattttttcgtgtggtcgaaagcagttttcgcatatggatcttccacccgtcttgaactaagtgtctgtgaaaatccgattttttttttcgggtgacgcacccgcacgcgaaaatcgcaatttttatatgcgggcgctttagcagccctggaaccccaatctagccgccgccggcctgcctgaggcccgccgccgtcgtctcagcggttgtcggtgacgaatccagacgcctgaggctgggataccactgccgccactgccgtcgtcgtcgccacggtggctgacgacggatccgctctgtcgccaccaccctagctgatgccaccgatgccgctgctgccatcgatgccgccgtcactctcaccaatgccactgccaccgtcgccgggagtgggtagagggggagggggaggggggagagggagagggagaggaaacgggagtggccgagcgggaggatgggaggagatcgagtggcgccgggagctaaaagggtgggtgggctattttcgcgtgcggatctattaagaggcccgcttgcaaaaattgattttttccgtgtggtcattttaaagagccgcacgtgaaaatggagcacgatttttacggacgcgaccacttatggtccgtctgtgatctaaagtgagtcttgtacaggaaaatcatttctgtactagtgtgtgctccccgcgtctctccactcaaggggcgacatgtgttaaatatgtgatctgaattttaggcctgcaatatattcggataagtttcctaatattttaggcttgcaatatattcagattagtttcctagtatgactcttgagttttttcccattaggacttctagatttctcctatatataggaaacggatcctctattgtagagctaatactgcattggtgcttgtagcgatcaaatcaagccatccgattagattaagcagctctgattccgtccctatatatatcccttggaagctgtatagggagggtgcgacagcccgatgtatcacctgtgtttgtattcaactcctctatagtgatcattgtcggtcggcacccatggttttttccggcaagggttttccacgtaaaattcatgtctccattgtgcatctattttcctaacaacatgggcgccacccaagcagacaccggcccagctaggtggatgcaaggacggtggtggcaaggctctctcccctcgctcgtagagtcgtggtcaatgaggctgagtcgctgacgagactggactctggagcctgagggcaagatgccagtgtccagatccggtgtcgtggagtccggacacgatccccccatggccgaatctagtgctcccacggcggatcgagctagatcaacggcgcaacggcaacaacaacttggagttgaggcggagctaggacatgcagggacggcggtggcaaacatggatctggtgagggggatggctacatctgtcgtcctagcgactggcagtgatggcgacaatgatgaggtggcggcgtgcggccatggagaagacgatgcatggaacggggtggaggagggacatggctgccaaggcgagccgaggtggtggagtgcggccatggaaaaggtggtgcattccctagccggcggccatgggaagccggcatgggtggcgccgggaggttggtgcgggcggcggcaaagaggtcggcccggccgatggcgcaaaaaaattgaacatgatgtagaaaaatcgtcgaaaaaagtatatcagttcatccatagagcatttaaaatcactcaacaaaaaatggtgcaactaaaaccgagatattttttctaaagcaacataaatataatttcctgccaaaagataatacataaatctaaataagatcatattttaagagaaaattaaactttgtttcacaatttagtatgcaagttctgtttgtacaatttgtcactagtacttatttaagatttttaattccgttatcatttttttaaaattcaagtacataacccatgcatgaaattgcatttcatttttcaaaatgtcatttaacataaaaaaaatatagagaaactttcagttgcacattcgtgtatgttaaacctaaatagattgggcctgttaaaaaagtcaaggctagtctggcacaaaattttattttatacatattataaaactgtttttttttctgtggaccatttaagctgcgttcgaacttattagcatatgattaattaagcattagtttttttttgaaaattagattaatatgattttttaaagtaactttcatatagaaaatttttgtaagaaaacataccgtttagtagtttgaaaaacgtgcgtgtggaaaaagagggaagtgagttgggaaactatactgccgaacacagccttattctgcttatatcccacaaaagtaatctagattgtatatactatatagaataagtggtaaatttgaagcattttttattcatttaggattttttttaaaaaaaagatcaacagaattttcatccttaaaacacaatgatatgtcatcaaaaactaatttgaatctggtgaaaggataaaaagtaaatggtatggaaagttcagggctgagcaatatccaattttaaagtttatggatgaaatttagacctttgtgaaagctcagaaatgtaaaatagacctttttttttaaaaaaaagctacagagtatatgacttgtgcatgttataacaaacctataattttcttctcacaaaaaaagatctatagatttgctatgatctgggcatgccataacaaaaatgctatgaataaggcatgttataacaaaattcatgagaaatactggccacaatacagtctcagtggtgatggggaatgctatgaggactaggtgacaaacatagactcttccaatggccccagcctcccatcagaacctgtggttacagatagccagaaataatatccaccagctgctgctcttctctatgctctgaaagattagaactgggaggcttctaagcagcaccaagcaggaactatgcctggcagcatccatgtctcaggttttttttttctctgatgatttttccattcacatgagtatctgaagaaagcacagaatgactttgttcagtatcttacttctcagctgctcaatcatcagctgccacagctccactgttcttgcaaggttaggtctcctcaaatcaccatttttttctcacttacattactacgattttgtatataaacaacacgatggatgcagttgtattgggcaagagagagtacaacggaagcataggacaaggggaattctcattgtgagttctgcatttctgcttattttcatcaagttgcattcaaatcccccttgttttatgcaaagaaaattttcagcatgtctcacactaattaacggagtatatctgtatatgtaatatgtgcgtagcccagttacgtcacttcgtgagagcatggtgatgctgctgtacaatgcagatagatcattaatatcacaagcaggtgtttttcagttagttcattgttcattttttctacttagccagcacaaatatgaactgctgcctgttttaactaataacccacaaatcaccacagaactgaagatgaaagcagttgttgagtcaggaactatggatgttgattttagtcttgacaatggaggaagcattattctaaggctgcagttcctactcagtgatgaagatcgcagacgggtccaagaaatggtaatgtggttctttttagggtattttcatgttagttcaaaccacaagtcctttttaattcattattataattccatcttaatttgaattatctagcttgtgtttatactgttttccctttattcagaggaactctgcagtgaaaagaaagcagcaagagctgctttctgatggttatgtactttctcaaggtaacctgtcaaactgtgttcaaattatgtctcatttttttgttgcaaacacgattttagggatctactgaacagactatatgcttcagatgtgccaatgttaagcagttaatgtcttagctaataagaacataatatttaatccacatatattagtatttaaatatatgtgagatgttgtataagttcccaaatatctgacctttgctgtgtgtagtgtacaattcatcaaactcgtatttaggctgtgtaactggaatgctaatgtctgaaatttaatcactgataaaatgtacaatttgtatggataactttcttttcttataggtgattttgaaaattttcagacagcttgttgtctaaacaagtcgaaaatatctccaacatttcgagagaaggagatgaatcttcagttaggaagagcatgtcactggatgatttgcaggagaaggctgttttctctgcaattattgtagatccccagatgaaagacacaaaagaatcaccggagcaaagtggatcaaatagtgcagtgcagaaaatgataagtgcctttcaaagcagctctccacaggtataatacttgtatcaatagatcaataatgcagggcaaaaccactcctaatatactccgtccgttcataaatatttgacgtttaggatattttgttaaatttttgaagctttgatcaacaatagtttctcaaatgcttggtttattttattgttctaaaaaaaatgatatgcacatttttgacttgagtactatcatagtatcacaaattcattagattttatgaacttattttaatacaaaatggattgacaaagtttcaaaagtttgaccaaatcttatcctgaacatcaaataattatgaatagaggaagtactagtacaatttatctacatagtcttccatggtcttgcaggatctgacgcggatcaaatcagaaagctcactaaaagggctgtctgcttcttcagagaatttcacccagtcttcttcagacaagtcatctagttcactagcaacccaggatgtttcaggccacacagaggcaggtcttgtggctgggacatcaggcaaaatgcagcttcctcctggtgacaaaagcttcagtaacaaaagatcaaatgcaaccgagcaacaggccgttctgtcaaccacatctgaaggcagaatccgtaggctattcagagagaaggacctcgataattcagagatggtgatcacagtccaaaaccggagcaagaagcggtcgatgccgaagcgtcgtcgcgccgccattggcccttactctcttgaacacatgcatccccatgtctgcatcaccactgcaagcaggcagctgagagagcttgttgagcttgagccacccttggattcgtttgtgtttgtaggacaagttgatatcaagagaccaaatgtgaggggaggagctagcatgcaagatcaggtatgattatgagagaaattttatgaatctagagaaagtatctgttggtactaaaattttaatgttatgagtctacagaaagtatctgtcggtactaaaattttaactaaaaaatttgatgcctcgagacactagtatctggagatatcaagttttacattagaaaatatagtacctctcgatgtcttctccaaaatgataaaattatccttaaactgatagtttcagcttagcctgctgatccctgaacttatgcactcccatgccaaacttgtgaaatgtgaagcagggcacaagcgacagtaaaacgaaaaatgagatggtttctgctcgaggtgatgatcatggttttccaatattggatgggcggttgattaatcaggcaagtcagttgtcgatgtgtgctgacattttctcctctttttctttcccctctctgactatctgaatttatgttgtgcagggagtgcgtgttgtcattgtgatcatagcttgcggagcaatatttctgaacaacagataagggtagcaggacatgtacatttagattgtgtgtgtgtgtttttctttttcaagtttcagtaagtaatgcaactgctatacacctccatccctaaaaaaattaacttccgagaatgaatctaaacaacaaagtgaacaaacgtgtgtccgagtttatcttagaagttgcctttttttttttaaggacagatgagtaattcttgtgcttgcggtggtgtgccgtatgcattgcagcagttgcgttttatcaggtttggtgttttttttttttatctcaaaccgtgctctttattgatatgttggttcagtgtaatcacgaaccaccaaagaccttacaaaacacgggagggggtcagtccaaatggacatctgacccgggtcccaattagcccctcgacgagccagttcatgagcacaactattacaagatcgataggcgaaagacacatcaacctttacaaagtacaccaaagacatcaatctgatttgcttgaagatgacaccagccgtagcttgatcataatcagctgatttgagagcttgcactaggacagagcaatcagtttctactgagacatgagaaattccgttgtttgctgcggcgcgcagagcataaagacatgccgtagcctctgcacacaaagcatcatgcaccagctcaattctcccagctccagctagtggtcccgtactacaaatccccatccaccggtcttgccttcatcaaagaaagccccatcaaaattcagcttcagttcgcccaggatagggggatgccatttcctctgcgcttgaacgtttggtcgagatttggccgggctcaacagggaagtttcagaaaccatcctcatgactctgtcatacacttgctcagctgatctgcgatcttccccagcgtttactttattccttgcatcccaccagttccaaagaaacagcacagtggtcagcattttatcctccttcatattcagaatatgtttgcacacatccaaagcagaactgtactgcatcagctctaacctgatatgcttcaaattcatcactctccagccagctttaacatatttgcatttgaagaagcagtggccaccatcctcattcagacgatggcagacagggcatcgtgtgtcaatctccatgcctcttctgtcaatgttcatgcgcagtggcagggtattgtgggcaaaacgccagaggaagtgcttcaccttcgggaaataatgtagacgccatagcttcccccaatccaggctcgccgtgcgagcaacacccgacgaggattctcccgtttgtcgagacgctagatgctctcgctgatcctctagagtatgatatgccgatttaaccgtgaagatacctgccatgctgcaaaatcttctgaccccatattcagcggtatagctaggatattcctcacatcctcctcccagaaaatatcctggatcaattctttgtcccattctccaagtctgctacccggttcagtattgtgcctcctcttggagtaattggccgtcgggttatacctgatggaatccaaggatccttccatatatcaatttcagaaccatcgccaacccgccatatcagaccagacttcagcgcctgtacaccacgcacgatactcctccatgaataggaaatacctgggccttccttcacctccaaatctggaaaatacttagcttttaaaactcttgcacatagagagtctgggttggacagaagccgccaagcctggcgagattaaacggatgcaggtctctgtaacccagcccccccttctccttccgactgcacaacctatcccaggctatccagtgcatcttattttcccgatcgtgttgcgcccaaaagaagcggcaaatgagactgctaatttcatcacacaaagtttttgtcagatcgaaacaagacatcgcgaaggagggaatcgcctgtgcaaccgccttgattaaaatgtccttcccagcccgtgacaaaagtttttccttccaaccttgaattttcctccacaccctctccttcagataactgaaggtttttgattttgatctccccatatacaccggcaaacctagatacttttcattccatgcttcaactccaatatccagtgcccctctgaacttctccctgtcattttccttggtgttcatgctgaacattactgaagatttctctttattaatggtttgccccgagcatcgttcatacaaggaaagaacattctgcagacactcagcactccgttcatctgcctttaggagtaacaacgagtcatccgcaaacagtaaatgcttgttgacaaaccttcaccccggatagatcacccctttcttctgccgcattcagcagggacgagaacacctctgcacatagcaggaataaatatggcgagatgggatccccttgacgcaggcctcttataggaatgatctgctcagtataggtttggtgttttttttgtcaggaataaaggacagggacttagattgcctgcatcgttgatgttttgtagtttctcatgtctgtcatactactactactagtacactctttttgttatatagagaggtcaatcgcacaaatatatatgtacatgtctgattgtttaggtgatgtttggatccatggacttaactttaatctctgtatttagacactaatttagagtattaaatatagactatttacaaaactaattacataaatgaaagctaatttgcgagacaaattttttaagcctaactaatttataattagagaatgtttactgtagcaccacatagactaattatggattaattaggctcaatagattcgtctcgcgaattagtccaagattacggatgggttttattaatagtctacgtttaatatttataattagtgtccaaacatccgatgtgatagggacttaaaagttttaatcctatctaaacagggtcttaaacaactgaacctgaacacatctgaacctgaacacatggcaactacgacaaatatcccgctttgcaacaaaagcatacgaatagcgcaacaattaaagaacggaatttactagatttcacgcgtctcaaaatttctaagttttcatctacataaaattgcacatagcttaaattaaaatcgcagtgatatgtaatgtacaactttagatcattactcgttgtatgtagtttgaatactttttcatttatttcatagatactagcagagggcccatgcgttgcaacgggatttgagaaaaaaaatatagtaacggtttcacctcgtgatcaagtatatttgataggtacaatggtatcatcttaaggatgtccgaccgtgttacagcgtgggcacagctaacagctaacaggcgcacactaaaattcatcatatagcctgaatcatctatcgtgtgtgaggctttcatcgttgcttcggtagtacactggagccagacaatagcgtcgtacgtatattatttttgattggaaactcatcttctaaagtaacaactcgtatgtatgtatattgtgctggtactcatggtgatggtggtcagtcctagatgaaaccaaaaattagatgattagcagaaacactaccagaaaaaccattttcccaccagaaaaaccattttcccagatgatgacatttttttctaagtaggtaggcctctcggagctaaatggccacctgcaaaaataacaaccgtgggcgatatcgttgtccgcatgcaaaaatacctcttaagagatccacctgcaaaatagcttaggcatcataaaaatcgtcgcaacagtcaaaaaaaaaaaaaactaagtcctctccctcacctcccacctctccctcaactcctccctctctcccctgcgtcccgtacctcccacgtccctctctccccccacctctctctctctatcggcggtagcggctaccacaagtggcggtggcggctccacccggacgcgactctcgtcccctccctcccagatctggccgaagcggggaggcgggagggcagcggcggcagcagatccggccggagggagggggagggcggtggcgacggcggctccaagcgactacccgtgcagctcccctcccctcctcctagatctggcggagggaggtggcgactgctgctcctagcggcggcggcagcggctttccct

SEQ ID NO: 30809 - DNA, 28960 bp, Oryza sativa
  unsure (1)..(28960): unsure at all n locations
ttttcgcaaacttatgcgtacatgtggaccttcccccgccagggaaaatgctttttggccccatggaaaaacacattttctagtagtgaaacgtaatttaatcgaactcttcgatagtattgccaatgtatataattattgcatggacaacgatgctcgacggagacacatacgtggataaagcggagccacggatggactcgcgacataccaatcggactaaacggaaacaacttcaatcgtgctgttgctagtcaaaatttggaaaatccaattatataccaatgtataccaacgcaaaaaccaattcaaacacggacaatgtaccaaagtagtggtagaaacatcttcaatttctataatatagaaaaatgcccgtgcgttgcaatgggtgaatgttattttaatcttattattgttatacggttttagctaggataaaatttacggtgggaattcgcttagatttttttttataaaatcatgagctgcaattaggaatctgacttccatatcaagttagcatgcatgtttttttaaaaaatttcttatctgacttcttttgtattttcaaaagcaaacgaacttaaaatctgactcgtacactgatctgtattttcaaaagcggaggaacttaaaaaccaactcaaatacaaatgacgtatcaaaataccagcaaaaacatcttcaatttttataatagtagagatttcaatcgggtgtagtgtaacaattaatggcacaatgtgggatgacacgagatgatgagagtcgagtagcagacgaaaattccatcagaagtcttatgaatttttttttaattaagtatagatagatggatactgaatgcaaatttgatacatgaaatttagctccgaggaagtggaaaatatagatttgggagtaataaccgaaatatttcttctttaatttaatttgggatgtgtaactcatttgcataaactatagttccatactaatggctataactttagtgcacgctgcatgcacgcatacatgaaactctcatctgacaaatcaattcttggcagtcagcagcaatgccgcatgatcatcagtgacgccatgcttttctccattgcatgcaagacgatgcaaactgcaaacatgatcggtaatgatcgtgaaaggcacggtccggtgggccatgcgacacacgagccggagacagaacacagagcggacgaaaaaaaaaagatggtgacgctgagacgtgagatatcgggagtcaagacatgacgcaaaatctgccttccatctccatcgcgcgtctggattctgcgtgccacggacaagtcaagcccaagccgaatagaaatcaaacacaaattttcacgatgtacgaaaaaactctgataaaaacatcttaaacttttataaaaacttttataatagtaaagatagtgttatataatagtagagaaagatataaaagtagagatagggatatataatagtagagaaagataaaagttaacataaaagttcgaagaaaaaggctacgatataaacatgtccaggaatatcacgaagcatgcattgagcatgttgtcacatatgcatcagccaacaaagcatatatgaatcgtggatggcacccaacccaatggcatctctactggtactaatataatatataagtaaattaataagtacggagtatataagtagataagagacaaatcaataaaaaaatctatgttacgcaactgcgctgttattaagcttgcaaattctgagaggaagaagcttaagcaatcaagggcttatacactgtggtttgcgcctggttggtcgatggtgtccatcagtgtagatcatcgagaggtctcgacgctggtagggtagcgtaacgtgcttcgtcgatatacgtaagtagtgagggcacacgaggtgcgagcgcgattgtccgtccggcggcggcgttcatggaaggtattatgtcagcggaagggtgtccgagcatgaccgagtcgaagagaggcttggacggactacgacactgaaaggatcttgatgtcacctagaggggggtgaataggcgttctcaaattttttcacaacttaatagcatattagagtgatgagaactttcaattcaaatcggaacttccggtatggtaacactaaaagagatcttatgataggtggcgtttcatttacgtcataaacattaaatttacgtcatgttgtgtaatctttgacgctcgcgtgacgaattttcattcattacctatcatgcgtctctaatggcgtttgtcagaggggtgaccctctctagcgggaggctgtgaggccccctttgtgagttcggccgggggcagcgggtgagattcgaggattcggtgagcgaagccgtgtgatattgagggggtcgagcccacaaagacgatgagaccaaaagggtttatataggttcggccgctaacaagcgtaataccctactcctgtgctatgctccttgagtgaaggattacaagctctccttgttggagtaaaatgtggtgttgatcatcagggctagagactgctctggagcgtccaatggatcgtctcgtatccgtccctcccccttttactaggcctggacttccttttatacctcaaggggttaccacatgggcccaaaaacctagctccggtggagaagtgctttgtattaaatgcctgtcttgtctcttgacttgggaagcaagcgcacgtcatctttatgatggggcctatcaaatcttgctgcctgacacgaagggcgcccatgtcagctgctattaataggagaagacttccgggtccctatttgcaccgggaaacgggaaccccaattgaccagggcggatggaccgactctggccgggatgagaggttaagacctctcgtcatcatgactgatgggacaagacagggagctcgccccctgacccatgcaatagtacgcctgacaccccgtgtcccattagtcattcaaccggtcacaaaccaatttagcgcgtgctgcacgccccattaaatgcggcgtggcgcgcctgctcaggtcgtcattaatgcgggtaggtgagcgctcgaaggtggccacctaacccaccgcacgtggcaacccgctgaaggggtcgggggagcccgacccctagtcacatgagggagtggcgtccgccccgcctagtctagagacccccaggcccatatcaccgacagtattctatgacgaaaccttttttttttgtcattaatctagtgacgatccttctgtcgtcgtagagttatgacgcccattttcgtcactatcaagcctaaaaatcgtcataagattctatgtggcctgttaaggcccatgtagtgagcaacctgtttatgggctaggtctattgtaaatccaattagatttttaataaattcagcccaattatacaatatccatctatattaagtgagctatacatattcaaaaggcccaatagacccaagcattgcaatgaaattgaatttgggccatgcatactcaagaagcccatatatcaaacagaacgagctcagttaaaatccaatacaaaacccaattaacattcacatatctgacatcttatagcccaattaacaacattcagctcacattaatacaaattcacaaaacaggctatcacaaattcagaaaaaaaaacaaagatcgcaggttatcctcaagtcagttacatgacaagtcagttaattacatccacaaatcactatccaaaacatgttcaattacatcacaggttcattgaccataccggaagttttggtctcaaccgaaaagttcggcggataacggaataaacactaactataaacttgtagctcgaacaaacaaaatgtatattaatcaaaaggtgacaaacaaggtatctaaacaagatataaaatcaccaactatattaattaagcatgcaaatagatcgggtaaaaacaagctcaagcacaatatgagagatggtaagaacgagcaaacctaagagaggagacacattgatttgtttcccgaagttcggatccacggatcctatgtctccgttgaggggccacaaggccgggtctattttaaccctttcctcacgaggttgcacaaatgcactcctcggtttcactcttgattttttcccttgcggaggtgaaatcgaagcctttacaaactttatgtggcacaccacaaccttgggtgctcaccggcgacgcctagccgtctaggagaccttagtctcaagagtaacaaatacaatcgaagatttgcttgctatgaacttgagtgctcaaagtatggagtgaagctcactagctctcaacttctcaatctctcaatccaactctctccccttctcaaatccctctcacaaagaggcaccacaaaggatggagtgaagctcactagctctcaacttctcaatctctcaatccaactctctccccttctcaaatccctctcacaaagaggcactacaaaggtagggaaatgaggatagctatttggctttggatgtatctaatgttgtccaagaacagcagccactcaaaggaggggtggaggagtttatatacccgagcctcccaaaaattagccgttggaggccaagactgtaattttcggaatttccgaaaagcattttcagaaaaaactgaaaatttatataagcaaatctcagtttcgtagccatttttggaattttcgataatttttcggaatttccggaaagcacagagtaaaacgtccataacttttttgctcgggagtccgttttttatgatcttggattctatggaaagctcactcagaggactaaccaactcaaccaaaaacaaagtctaaaaccacttaaaggatatgttaaatcttgggtttctcttaaggtagcattatgataggtcactttgagcaccgagacatacacaaacacctcaacattgcatccctcttaatagtacggcattcctaaactcaaatgtaaataggaagagaattataccaataggaatgccttcttcccatctttctttcatgggacaatttcgtttttgcccccactttcatcttcaatattgattttgcccctactttttagggttttcgtttttgcccccacctttttgaactggaagaggcgtttacccctgctttggatggaagttagtgggaccgggtatatggcagtaaaaaaatagagaaataaatgaaataaatttttttcgaatttgtgttttacttttttacccctggcactagtctaatggagaatcgattctttcccccaacctcgctgcttctctcgattgtacaggcagcggcggcgacctggcagcggcggcggctagggcgcagctcctcccgtcagcggcagcgagcagcggccaagcggctacgagcggcggggagagggtaggtggcggcggtgggtgcacgggagaaacgaagctctcctggtagacatgttgcgtcgcgaggagacatcgtcaccatcgtcgtcgtcaccgccgaactccctgtcggcggccaccacctcgcccctcttgagtcttttgaggttgtaaaccccataccgatgcccctgacttgaccggagcagtgcgtccccaccaccgctgtcgtcgctcatgtgggcgacgaagaaccccatcatcctggccacgtcgccgaggaacccggcggcgacgcggtacacgcattcccatgcctcctcgtcgtagtcccggagcagccacagcgccaacactccgtcgccgtctgcgtcgtacgacgaagcggccatggtgccctgtactccgttgagctggctggtccagtcggcatcttgggagtagtcgcacggcctgcgcatcgtgcggaactcctctgccgccgtatcgaacaccagcacagtgcggaacacctcccccgtcaggacgttctagtggaggcagccgcacagggtcatcggcgtccggacgttctagtggacctcagccgtgcagggtcaccggtaggtgatgccacgatgtgttcgaggtaaggtacatgtcgccgtttggcggccccagcagcctcgccattttcttgcccctggcaatagtctaacagataataattttccaaagccatgtataatggaagcaaaaacaacatcaatgaatagagatggaagagggtataaatgtcctacttaacaccgttaactcctccatccaaaacaggggcaaaagcctcttccggttcaaaaaaaactgggggcaaaaatgaaaaccctaaaaagtaggggcaaaatcaatattggagatgaaagtgggggcaaaaacgaaattgtcccttctttcatcgtcttaagggacgccaatgctaaaaccgtttcaccatatctttttcaaatgattgatgcggttacttgtagcttcaaatggcctcgcacggtccatcatgacaaagccgtcacttgcccttcatcactggatttggttcttgtcacgccttgaagttcttctccctagccaaaattcaattaataaattgttgcaagaaattatttgtttaaaggcaagagagaaaccctaaatcaaaaaaatgcaaataataatcagaatcaacatgtggaatttttcttgagttctaaatgtcaaaatatgctaacaggatttttagtggaattttcagagccatggaaataattttaaccaattaaaaatgagcatgtgcattatttaatcccaagaaaatcccccttttcattttctcttctttttcctccctttttcctttttcttgggccgtaaacccactcccttgcgcgcccgattgctcgctgggccggcccactccctccctcctctctccaagtcaccgacaggtggggcccacctgtcggccccgtcttcctcttccaaccggcagcaactgccgcccacgccgccgcttcctccgcatccacgcccccactccgcgcccacacgcccccccacgtcgccgcccccacgccccgccttctcccgccacgcgcacgcgcccgcaaaggcgggattcaattcgaatccccccgctctctctccacctcccacgtcgccggcgaaatcgggagcctccccggccacgtctgcctccccggccacgtccgcctccccctccgcctataaaacgctccccgtgtccccctctctcttttttcgctttcgccgagcttccccgtgccctcctttgctcccgagccgcttcactcatcgacgccgccctccggccgtgctccggccgtcgctagccgtcactagccgccgcgtgaagcctcaccgcgtccgccatccgcccagccaaatccaccgtcagggcctgcttcaccccgcacgccggtgagtaccaccattgccgccgccttcggccatgggtttcggtcgctgtggactccctctctttccctctaacctctctcttttcctctcttagggtgtcccgtagctcggccgccgttcgtcgtcgccctccggtcgctcgccgtcgccgttagtcgtcgcctcctcccgcgccggccgaaccccggtgaggcaccccctcccctttttcccccttcctctccctcctagcgccgagccgcgccgtcgtcgtcgtccggcgcttcaccgtcgtgccgccgcgtcgccgcgtgccgccgcttgtcgccggtcatgccggctgccgccgccacttccgcgcgcaccgttgccccatggccggccggccgacttggagccgtgccgagccaggcaccacgtcccctcccttggagccgcttctagtagggcctgcctgccagccgccccctctccgcttaaaaatggttttgtttcctgtttcagtagtcttatagcatgttttgcttgtgtgctttgtttgtcgcatagatttcggccgtttcgtcgatccgcggtttcttgaagacgttgctgtggtctcatcagtgcgagagcaaggcaagtcatgcattataattgatcatattgtacccaatttacaaatgtcccgcatttctattaaaggttgcattatttcataatatcatgtgggatgggtcctactactcagccatatatattgtttaccttataccattgataacttgggtatcaaaatgattagatgttggattagggattgcttagccatgcttagttcaagtagtacacaaagggggaattacattaatgcatagacattattggtatagctttggattagtgccaccgtaatggtgttagttaattaaaatacactacgtggtgggctgtgggtgcatggtttttctagtcgtgcccatggcgattaaggaccggttcgcgggatgccctggaagaacttatcgtacttaccacaagccagcgtgggcaacggctgggcttgtagtgtagctttcctctagccgacgtacccgggcgagagtgggcgtgatggagttgggtcggccgaggtgtctggttgatcggcttccggattcaccgcggcacgagaggggggctgcccgttgcctgctggggacaggggcgaaccctgaggtgtggtgcgatcggttagagggggctatgcgaagggtcctgtcatggtctctttctggtatgtcgtggtggcatgtcggcgcacggaaacatgtcgtggggctgtgtcttgtgggtacagttgtacacctctgatcagagtaaaactattcgaatagccatgcccgcggttatgggcggtcgaccagattcaccgtgattagtctcaccctagttagctattgaattggtgtagttcaggtggttggttgggcctgttgcaacgtggtgtagcgttgagcagtgattggttaatatggattaattactacaactgttttactgctttcaactactgcttttaaatgcctgctttgtgcaaatgaacctttagcctcccttggatatatcctgcatcataccttctcttccggtatgacttgctgggtacagtgggtagtactcagtcttactctcttttcccccacaccagagttgaagttcttctcagttggagatgtctcgaagaagttggtttcgtcgctgctgtcaaggatgcctatggaatggaattgcccgctgcaggagtcaagtcttcagacttagctcgcttttatcttttccgctgcatttgtaatcttttatatttttgtaagacgtggatctgtatgtcaacaattgtcatttgtgtaccctagctggtcctggacagggggtttaatgcacattcagcttagaaattctggttcgtgaatttctgggcgtgacagttcttcggcgccaagccccttgcttgcccttcaccgccgcatggtccatcgtgactgagcttcacatggccttcaccgtcttgccatggtagccacttcgtatcccacatcttcaatatcttcactttgtcattcttggtattgttaggtgtaattatatcacttgagcatcaacatatttgcaatccttgggacctatttctttcattcaactaaataaaattattagtcccaatgatccggttggcaacctccacatgttgaccaacccatcacatgtataaaaaaatatgaataaatgatgagtattaatcaataccacaagtgtcatatactcaaatatatgctcaaatgtaaagatcccaattaaatgaaagtgaataacttggatcgattacatgcataactaaaatatatgatttgctcctcctaaatgtatgcatacaaaatgtttgtatgaagcaagagtatgcataaaagaatgaaacattaggagcttaccctatacaagaatagaatgcatttatcaaatataagcactaaaataaatgtataccttcatcatcttcatgttctgaatgtaaagagactaaacaagagaaaagactcaaacaaaacattagtctcacatgtatattgttattcacatggaaatattatatatgaacgtatcaatatgtacatgaagagaaagagtgatacatatagcttgatctccatgcatttcatcattgtgatttaggtccaccatcaatgaatatttctatctcaactcataagaagttcgggaatcacctctcacacactctactttcatatccacatgagactaggcaaagaaatgcttataaaaacatcagtatcacataattggatttgtcattaatcaccaaaacctaattaatggcacttgaactttcagacacatattagtattgcacggttgatgggcctcccgagagctactccattaggtctcccctaatccaatcctatctgccgacccatatatgtgatatatatgatagggctagcgtgaaagatggatggcgaatacgtatgaaagacggacaacgtaccaagcacccaacaaaaacattttttatttttataatagtagaaatagagaggtggaacggtagaaacacctctaattttttataatactccctcaatcccaaaaaaaaaaggccaatcctagcatcccaatgtaaaattagtggggagtaaaaatgcccaaaatagccctcattattggaaaaagtaataatggtgataggtaggcaatgatatttaagagataaaacttctcgttttatgtgctgagagtaggtaggatggtagaagttagttttttttggataaaatttaaactgtagaagttgagttttttttgggacgaaagggtaatagatatagaggggtgggactgtagaaatactacgaatcttttaagtaggtaaaaattatgaattgtaactttattccctatttagcttgtattaattaattgtccaatcttttatctaagaaaataatagaattttgtttataaatatgtaataggaggttgtcatagaggatgagaaaagttataaaaatgattcagttggctaaaattttgacatccccttaaagaaaacttctgaaataacaacgaaaaaaaattgtacaacaaaaccttaatggagaaaggtagagaaaacgtgcattatgcagtaaaaccatacactttaacgtttgtgaacacttgtactcctagacctgttacacctgtacatgtaggagatgccatgcttctacggctttaccccataatttctcatagatagtccttacaatctgtgcataatacctcctctaacattgactccttgcatgaaaaaaatatgatgaacatttaacctacggttacacagatgcatgatattcataagtttcctttttaacataaatgaaaatcaacacaaggaacttattggatatattaatatagcacagtagacttaatttctactgttttttttataaaaaagaacactagcaccctagagcagtctcatcggtgatgatgtagaaagatatgggtcttttcgtcggccaccacactaaaccatcaagaaaatattaggatatatataatggacaagatcgtagatagagatagatcaagatgtttcttgccatttgcatattttgtcgttgtgttggaggtatgttgtaggtcggtggaatagagtgcccgtggaccgctggattctcaaatgacaaaaaaataacaggtaagacgcgtgacataaatcattattatattaaaaagtcaaaaaaaaaggaaacaatgttgatagaccattgtttcgttagaggttggggagttgaaaaagaagggaacttatacactaagacgattggatttaaattagatggaaggttgagaattaagctgatcctaaacgattttgttatacatttgttgataaattttctttcaaaaattacagtgtaattacatcataacttacgtgtaattacaaattgtaacttttacataattttgaatcgttaaatttgtttcaaggattcgtgcgagcgaggatggaaaaaatcacaacgtgcgtacgagtgaggggatttcataaaaaaaacatccgctctgcgtaaatagcgtgttaccatgagatttatgaaactttcatataatttataagggacataatgtaatcaccctataattaaactactatatttacatccgttatattttgtagagagaatttagcaacaaacgttttgatagtctcgatgccaaccaacacggcttgaactaccgggggttgttgggcctatttcccatctggacgcagtactttgtcccaaaatcggaaacccgtactatctccgtcacacccctctccacccactgtcatgtgggtcccacgggacccgcgtcgtcggtgggccccacatggcagcggccgcgcggctccccgcggtgggacttgggagagtgtgtgtgtgggccccgccgcatataaaaatcgctacgcgcacacgcgacgaaatcctcctctcgttcgcctcgtcttctcttctccccccacttcctccgcctcctccgccgccgcgcttttcgccgccgcggcgagccatggacgccgcagggtagggttcctctcgccccttctacgtcgtggaggaaccgcgtgggccgattctgggtgggggggttttgggatgattttttgattatttttttatctctctttttttggttttcctcgcagttacccgaagatgcaaggaggaggggcgtcctcctcgtcgtcgtcctcggcttcctgccgcgccgccgacgcagccgtgtgggacgcggtgcagcagcagaagcggcagcgctgccaggtaccccccgtcgcgttcttgcgcccccgccccccgaaagttctgggcctgaaatcgcaggaagttataagtttttttctttttgcgccgttggttgggtgtaatctgagcgggtttttgtgcaatccgggatgcgatcgttgtgttttgtttgatctactaggccgtcgatccgatcgatcatggtacgaggggttttggtttttctgtgttgctatgtttgagagattcgttcttggcgagattgttaaatctaggtttttcttttctcctgggatttagtttctgttggatcaaaccggtgggattgtggtgtcgtggttttcattgaggtggaatcatcgtgttggtggtagggttttgggttttgggggtgatttgatcttgggttgggatctgtttattttttatattttcgatcacacggaagacgtacatgcaccaaatgcacatttatgattaaaggagaagattgtttcttttttaccaaacatatgcggatcaaatcacttcttacaacaagaagaaatctttctcggtatcaatccccttgcccctcattctttgagaattagaaggatccttttcgagtttctatttcttcatttggaatctgggctcttctatcttcaacttatttttttttcgctttattctttaatagaaaaatgtccgtgcgaggcaacgggtgaagactattttaatcttattattgttatatatggtttagttaaggtgaaattaaatgtgttaaattcgcttggatacatattttgttagaaaatcatgagctgcaattaagagtccaatcgtctcaagttagcatgtaagtttttttaaagagatttcttatatgattccttctgtattttcaaaagcgaacgaacttaaaaaccgagtcaaatacggatttgtatttccaaaagcgaacaaactcaaaaactgactcatacacggatgacgtaccaaagtattggcaaaaacatcttcaatttttgtaatagtagagatttatttcacacgagtgtgccaccaaacgtttatgattaaagagattgagactagagaccagcggcaaatcagttttgtttaggtttattatatggtagaatggaggttttgtttattcttttaactcctagctagcattacttgtagattgggttagtgatttggggtgtttggcactattctcatgtgctaattctgtactaattctgagcagtagtgacatttgcctttgtctgaatttatacaaaccattgaagtgccctagtgttgtgatggaaatccatattatgtaacaaatatcatccttgttagatcatatggaagctatattagtagagattcttcgtgatttgtgaggtttttatgcagtgtaggcttagtcatcagctgtaatatcatatatggttggacttgcacgatttggtagatattgcgacatgtgttgctttcaataaggaaattttatttttttcagcttgtagattcaaggatgattacatttatgatatgcaaaaactacataagatgttcttacatgctagtctattgtgtatgtgtaggatccatagacttgaagttgaagctgcatagattatttgcttcgctcctattattactaaccaaagatcaattctatattgatccaaatcaatacgtatgctcccatctttaataggattcctgctaaactcatacatgtactgtaatgtgcttcgctatgggtatttggttactacatatcacgtatgtaggcgtataatcgtcaatttgacagcataagcaacaaggaagccaaaataaaattgtatttccaacgtagcagggtatgaatcatctgtatgattgagtaattagacttgtacagaaatagggcagtgaatctgaaaacaacagttttactttggggtgtgtgtagagaccatctgatcactggaaattaaaaggaaaaagtctgtgccttgttttccacttgacttcctgaaccttttttgcgtccattttagctccctaagtcgctatgctgggttatgttacctcatgctggtttcaacatataaggggggcatattcatcattgcataagtgtttcacattatattcatcattgcaaactatgatgttgaaacccttatatgtcgaattcgccccttatgctggtttcacatattcatgattggttgaatggttggcaataatcccttattgcttcagtttttgtaatgtaaatatattgctcctccaacatcgtagtttgtgttatctacattatattctcatgtaatcaagtaatatgcttaatgtcatcggttgtcatgcaagatctgatcctagatgttaatgatgaatatcaataaaatcataatatgcgaaactaaatttacaaaagtaataacggtgactgaaatcctgtcttttttgtgcaagctgtctaagatctttttatttcttacaataaccatgacatactttgtagggttcttcatccaatgatcaagttggactcagtactgaaaataattccttccaagcacctgaacctgagctgcagaattctgactgtgtggaagatgaggaagaagattactatttgtatgatgaggatgatgtctgctatgatgatgatggagactatgaatttgatgaaactgacttcaatcagcagctagctgataagtttgatggtttggatttgcctccgggagtggaggctaccgttccatggctgcaaaaaaaggatattgctgatggacctagcactttcaagtcaatggcagaactagatgctgatattactaagaaatatgaattctttaagcagtttgatgttgttgagaatttttcggaccatcattatgctgataagcctgttgggaaggtaagagatcatatgcatatttgtatcattttatactcctttcttcagatcaaaactaactttttttaaataaaaatatcagacagggaaagactggacaaaaaggattcagtatgactggaaacttctggagaaagatttaccaggtcaacttcggaaagaacagttgtatcattgttgttataaatgttgcatctgcatatttattgaaatttcttttagttctttaatcaacattgagcattctgctttgtactcgtaaaaaactgttctgtaaaagcttgaggtatcttttgtagagatgcaaatgttgatgatgaaatgctcatattgttagtcctatcgattcataacttcactactttaaaatacttctatttacacagttttagaataccctgtggctcacagatataggagctccagaggtttacaaactacatccatgacttgcaatacatatgtacactgttgtagatgaagttagagatatgcttgctctgtcttgatatgttttattccataaatacataattcttgtaattctgattctttttcttctgtgcagcatccatatatgtccgtgtgtctgaaaatcgaatggaccttctgagggctgtaataattggacctcaaggaacaccttaccatgatggccttttcttctttgatgctcaatttactagtacttatccatctactcctccagtacgtgttcaaaaattgttcttgtcattttttatttaatttatttatgttttgattgaaatatctaagctgatatttttttcccaggtggtatattatcattctggagggcttcggctcaatccaaatttatatgcttgtggaaaagtctgtcttagcctgctaggcacctggtctggtagtggttgtgagaagtggaactcagctcactcaactatgctacaggttttagtctccattcaagctctcgtattgaatgagaacccatacttcaatgagccaggatatgagacctatgccaacagtgctactggacagaagagtgccatggactataatgataccacatttcagtactcatgcaggacgatgttatactcactccgtagatctccacaggtaatgttgtgctgcttatcaagctcttttgtactacctccgtcccaaaatgtaagcatttttagctatgaatctagacaactatgtgttcaggttcatagctaaaagttgctatattttgggacggagggagtagcatagaaataatcatccattaggcatttgaataacatttcttttacaattattattgtggcatgcttatctgtttctttgattatgagcatggcactcttttgcctgtaactgatgcgattccatagcttacacacaagaccatctaataacatcccttgtcatttattatttgtttcagcactttgatgcccttgtagctggccacttccgccaccgtggtcatgccattctggctgcatgcaaatattacatggaaggtcataaggttgggtccgtagtccctaacgaggacgaggaggatgcgaagcagcaggacgacactgatgcaggaggatccggcagcagcagcggagcaaagccgcagcctgaaaagccagacctgtgcaagggccgtgctgcatccttcaaaaccaacatggccgttctgtttgaggagctcttgatggaattcaacgtcaagggtgctgacaccaagaagttctgcgatgagaagttgaagaagaaccagcaggctgctgctgctgctcgctgaagaggccccccagctgcagctacaaaacgcacagatcttctctagttctgagggtttcataatgaagcgaaaaccgtagaaaggggttttgcttgcctaactatagaagtgctgtgtagatagtccattctcgtttttctccttttgttgtacaggttgagtgtgtggacttaaaaaatttaaatgatcatgttagatgctaactgaagtatcatcaacccacccctcgttgtggtgcgatcatgaaatagacacctgcataagtaagcaaggtggcggttccatatgatttatgttggcttgcatttaggttacaccgtgttacttgcaagagtttctccatcggctagcgtggtggctttgatcatatggttagatttgccctttttcttgtgagttcactttttttgcagctaacattgcgttagtttcaaactgctttactaatagatttaattcaaccttgagttgacatttatcttctcggaaacatatgaataattctttactgacggatgtaattcgaccttgagataaccattatcttgtatgaaacatttgaacaatttgtgcgatttatcgtggctagactttttttttatcatctgttctgatagtatcttttacttgtgacagtagtagagtagcagaatttaatctaaccattgaattgctataggtatttaaaacattttatttaaaaatttgacaagtacaactttaataattcatctatggcaacatttcataattttacccctcaaaagtatttgttattcacataaccagataagattcatatatattggtttacttaaacgccgtaggagcggtgaaaatttagagcgctacgtcagcattttttacaaaaacccccctgcgctttcggttaattatgtgccggtttccgctgctgtccactgtcagatctcaccatagggtcgatctggccgtctacgtgtcccgctgtgtcggccctttctcagccgtgggatagtcaaatcgcgaatgaatggcgtagattttgtccagccggaccaaaccctagcccctgcgcccgtctcgcccgcagcctgccgcagcaacgccgccacctcgcccttctacgcagccacgccgctgccaccgtcgcctttctcctttgcgcgagccgtcgccgacgcatcctcgccctcctccaaccatcatcgccgtgccgctcataaaccctagccgcactaccaggctcgcacacacgtgatctcgcctgccgccgccgccactgctcgcctgtcgccgccgccgccgttgctcgcctgctgtcgtgccgctcccctcgctccgcacaccagacgcggcctcttcctcgctgtctcacggtctctgcccaggcaccggcctcgcgctcctcgcctttctctcgcgtgaggcagagacggcggcggaggcgcgtcgcctcacctgctcgcccgcccgccctctcgcctacattgcctccttctctgccctcccatcctccctctcgctccctaattccgtcggcccctctctactatgaccaatcgatgcctccaatccccagcctcacctcccaaaccctaggttggcctaaagcatcatcgaagatggcattgctggagcagggggtgggggtttcgtctacgatgcgctgccatggatttgaggctcctgacccaaacctctaaggtcgtttcaatctccagcgatcaaggtatcgtggccaaccaagaacgctgctccgatgtgcatatctgcctccgttcccctctcaaattgcatgctatgtaccgtcagaggagctcttattgataatgtatagacgatatgtgttttgaagctcttagtatttcaagcatcaggtaggctttcagtcacttactgattaacattttttttctttgtgtatttgctctcactgcccacttggttcttcatgtaatttctagatgaattagacttggcgctaatagaactagattttaagttaaatagatgatttatatgcaggaagatccgatttacttcaatactctactatctacatgccattttcagtatttttgttgtatgactattatacctatcctagcaatgttacatacatatcattggaccaaatggatttgatccttctttacatttttaattctcttagctggtagatcattgaatggttaatatggtcaattatgggttgtatgctaatatggtgtatatttgtctacaggattttttcccttccctttccctatcatccttctctattgtgaggtattactttttatttttattttactcatccaggccttctgcaatagttattttgatggaattgttgtagttttcataattatattcagttatcggtcttttaaaactgaattactagctatgagctcataatagtagcagagcatttgtcgttgtaaacagagatgatttcctacagcccactaaggagtgatggcaggatagatgtggctcttatgtatcctggtgattcaccttgaactattaaaaagaatctttgtccaatcaagtaatgcctcctatttgcataaatgaatattcagtttaaatgcattgggtctactcagcccatttcagtgtattgccagctctttctgaatgctacttaattagttttctcaaatatgtagaataaatgactccatagttaaagttttccaatccaaccataagctcattcattttcttccctttaatgcaggaaacacttttactagcactagcacctcaaaatttgagcaagaaaagttattttagcatcggaactgcatggttaatggtgattagtaagttcctttcaccgtactttgataacttgatatgacaaagagataacagaattccccaaaaggtgttataattttaactggatgtacgataactgtagtatactttcctatgggattgtaaaattcattgtttattttgtcaaccttcaaaatcattgtcatcggcaagcatagactaatcttcttttcttttaccgttgcatgtcttctagagagggagttttcagtcgtaatatatgcaacacagagcatatccgatatactttccatccgtgggggaaagtagtttagatgttgggtgagtgcatttcattgctggagtgtaccagtgtaaaatgtgctgaaattatttcgtaactaataaagcaaatttacaaccttctgttttgtatacaggttaatggtgattagtaagtctctctgacgtgttgtgcctgttatgcttaattcaatattgagtttgtagttctcttggaccttagatatattaattattcagtgacatcatcgaccggcgcagcctttgcccccggcatggagttggatctcgctgccgccgcaagttgccaggattgattcattgccgttgcggcctgatagacctgcgctgcgggcctgcggctaggagcaatacgctgcttcatcgtcatcgtccagaacaccaaccgtgtccaggtaggatgcctaaattcctcctgttcaatttgttctctttggctaatcggatcctgtgcatctgggataaggaggaggataaataattggggtgatgccaataaatttttctctttaacagatgccttctagatgcttggtaaaattcctagaagaagatctaagtttactctcaaaatatatttgtttctgcagctttcttaattataatgtcttataattttgtatcagttaacttctacacaaataacttctcactaataatgataaaatattgaagatgggccatacaccatctatgtcatttatcagagatgtacaggttcaagcaaggttgtcagtatcccgatacgtagtatcttacgatattacgatcctaccaagccgaaacgataccgatcccacctagtatcctaattttcatagtatctcaatcctactattcattagtacacgatcctatgaaatcttaggtggtatcccgattctacgatccctacgatactacgaaatattatttaaaataacatggtatgaaaataatgtaaataaatatgctcaaatttatataaaaatcagttaaatatatcaaaaccaacgtggtttctcttaataaatgcctctatttgcatgacatatatcattactatattttttatatagaatggctacatataattaatataaatattaattaaactttaaaaaagaaaatctcatagtatcccgatactacgatacgatcctacgatacgatattactttgagcaaaacgatactacctagtatcccgatcctaacaaccttgggttcaagattcatacatggtccttcataatgtaatcctgatgtacgtaggtacatatacaggccaattgtttctggaatcttaaataaatttggtctaaaagaatatatgctttgaaaaaaattctgatttttattattctcagttacactgattcaagaatgtagatatgagtatatggcatggtactacatggaagttgtgattttatttgccaagatatatacttgaaaatatactaagttagtttggagggtacgagttttgatgttcttggcttagcttcccttttcctatagatgttaatgagttaattctgaagtaatgtcaatattccttcattgtataccagtctttttgcagccaccttttctgtgcttttatcaatggcatcttcctgcagcaacctttatgtgcttatgcttggaggtatatatgttttcttactgtcttatctgggtgatatatgtggccttcagatctcttataaaattatttaggtttagtgtcatgatagcataatgtttattgtacaagtaggtttttcctcaatttccttccctatgcaacaaatcatattttatttgttaatctgttgtgctctatatttgtacacagagtgaaaatacatatgcattgataatatcctttgtggacaattttatattcgtaatagtgatgcatacatcataaaaaaattatctgtcaacctgacaacttggcatatgaccccaaaatttggatcatgtagttcattttctgagacacaacggtctttagggcttagtatagaccgccacaggtcttttagcctcatatttggagactacattattttacgaatcatattataacgactaaagttggttagcgctgggtctataagtcaagacagtaattgatcacaaagtatgttgcacacctagcaaaaaagaaatctaattggctcaattgaagatttcaatattgacaagaaatttagtaaaccacaattacgataggttcaggcactttgtataagaggctaacattttttcttccgctataaccatttataagctattaatatttaatatttaatataacattgattccataggttagtgttgtttgcagggcgaactattgcttacccgaaaggattaaagccacaggtataagttctaaactatatagtaccatcctcagttgatatgtgtagtccatataggatgacagtacatatatgtgccaccccaaatgacccaggcctccatatctctggctatactgtgtggttcccgcgttgatcataaaattttatttcagttcattggtgtgtgacaaagctacatgcacttcaaacaattttagatgagacatgccatatgttccaatagggacacactgggatattatttttcttctatacaagcgttattcctgcttttgtttttcccatctcgacatagtttttgaattttctaatgacccatccttccgaatttatattatttgctttgtaaatatgcttacagagttttcattatcaaccaacttcaagatatgattttattaatttgttttctgtttaatttattattgttctgtttgccccttcttggaagacatagatgtttcaacacagtttatttgaaaagagttttgtcctacctgtcatatatactcatcacatggcaatatatgaatgatatccaaacatgcccttagacataattatgtatgggatacctcagtactcagtggcgctatgcaaaggaggtaccagttcatctactaaactgttgcaagtacataatgtgatgtggtgttgtttttattgggagctaaagcactaaattttctttgcggcgcagttctatatgtgaatatattcaattagttcatgatgaagatgtctgagaaaatgttgcaattctttgatcacttaatgattgaacactgctacttttctaatctatactcccacatcacgtaagcaccattgtcctctatggttgttgcttttctgtaaatgtgcatgattgtaaaaataattatatgagcaaatggattatattcgcctttaatcttgtgatgtatagttgtaatgtgtttgcatatgtgagtatgcttctgatataatgattttttttagataatgtttggatataatgcttaaaagttacactatatcttgtgctattttgattatgatatcccagcttcaaacattaattcccacgcacgtggcgtagctcgtgactcttgctagttagataccaaacgagatggctattagggtgaaaatcaggtgggtacagtcacatcacggtacgtatcctaacatatatttttcttcaaaattaaaaccggatacagtatattaccagataacatatcactcatcttttagctatataccatatatttttccttcaaatcgtagttgcaacgggtgaagattattttaatcttattattgttatacggtttacttaaggtgaaatttactgtagaaattcgcttggaaatatatatcttttttttagaaaatcatgtaaaaattcgcttggaaatatatatcttttttagaaaatcatgagctgcagttagaagtctgatcgtcttaagttagcatgtgagttgttttaatgagatttcttatacgacaacttgtattttcaaaagcgaacgaacttaaaaattaactcaaatacgtatatgtatttccaaaaataaacaaacttaaaaatcgactcatacacagacgacgtaccaaagtaccggcaaaaacattcaatttttataatagtagagatttgtatctcttgatcatggatattaatctagggagacacttggtgtgctaaaaagatatacatcatgaaaaaaaattatgtaataatacttgcgagctggtaaaatcttttagcactcataatagattttcatgtatatatttgataacatgggacatacagtcatgcggacatgtacaacttttcttgtatcctaacctgcatttttctatggattcagattcgaactaaaatatcaccgggtatttgttttctcttggggtgtgtttgacaaatggaatatgggaggtgagattggaaaggaaaatggatgaatggctaggattaaatgagatgtgaagaatgaatggttaggatgcaatattaccctttaaagggtggatattattttccaatccttgtgtttagttaacgtcaaaattagaagtttgattgaaattgaaatgatgtgacgaaaaagttgaaagtttgtgtgtaggaaagttttgatgtaatggaaaagttagaagtttgaaaaaaaattttggatctaaactcggcctatttgccaaacaaagtaaatgcttgggcgggtcagtgtgcgaagaaaaatcctcgacaccatttcagcccaaaactttagggcttagcaggccggcctggtgcggagtgtcaagtccacggcggcggcggcggcggcggcgcgacacgagtgcatgacgacatgctccggcgggcgaccacctcgctgagccgccgcgccgcctgcgccaccctgctccgccgcctccctccccggccggcgacgacgcttgagcgccacccgccggtccaccccggcctccgccccgcggcggcggcggcggtgcagcttcggcgcctcagcgacttcggcgtgtcggtcccccggcgcatggcgcggcggagtcctcccaccaggcccgagggttactccacctccgacagcgaggcggacgggtggtccgttagcgaggatgacgaggaggaggtggaggaggttcagttggagcccatgtccgtcgatgacgtcgcggcggggaaggagtgggaggggttcacattggagtacgaccacgagcacgacctcgacgccgatgatgaggatgccgcggagtaggagaagaagaagtagcggcgctggaggtgggattctcttcctttttctgcgttgcacgccaggtgcttgcggaaaagcctgtgaggctttacgcgtgcttcaataaactctttagctgttgatcactgatcatggatgcccatttgggtcgaacctgattaccattgtcctaaacaattttagtcaaaacctaattctactgcagcatcgtgggcatgcattgttggtttattggaatggcgtttccacattttaactgcacaaatgtttgcttgtcatgtttgctgtgcagtattgcagtgtgctcatgcttatcacaattttacagtgcttagtttttgtgtggacaactgagttggaaccttgaagggttagaactagggtatgtttggttcgtaaacaatgtttttaccccccataaaagaaacacattgtcattttgatcttgggcttaagtgcagcaaagttagttgttttgtcgcagaatacattggtctctactcattagagagatacacactaggccctgctctgaatgcgaaaaatccccccttcgctacaagaattgatcccttggttcttaaggtatatgccattgatcaaattacaaatggaaaggatagtatcttgatcatcgagcctgcataattcttttttttttggcatttgttatgcttgtggacatgtttgtgacctgtgtcactacttattgccaaatactttggtggtcttcatttgtcacctgggaaagtccctttgacagctaatccccatgaaattcatttgtttcatcagtcccttagtcgagttacacctataatgatatcacaatatactaaagcacagtatcctagctagttctcatgtttcactcacgaaaatttatactgaaatagtctgtgatacatcaatggcagattcagagatttttgttatattagttgagttcaaatataatacgagaatgttttactaattatttggatgcacaaatatgacatgctgtcttgaatatcatgtgaagaattaggagctctgcccctgaaaatcttcaatgtaatacatgcagctcccgttgatcacactctcactacctttgacattcatatttgctccagcaagcagcatgcgcttctttgttgttgcacttcccataaatgcttagtgcagcttgcattgttctctagcaaaaaaaaaaaaaaacataatactattatgctttgcgtgggcatgcacatttagtatgatattttctctcattgacaatctcttaacccaattttgcatttgatactttcttaatgatttcaagtctgaaaatgttgagggctttgtggaacttgaattttctgcaatgtatgtctgatcaaccttggagaacgcatatgtgctactatatattagtgtgttcaccactttatctgaacagcaaagcatctcctccggtgacaatggcgaaaagatgtctgggttcagtctggggagggagatgaggtaggagaccgaggttgcattggtgagataagcagaggcatcaaggttgtatcgagtgaggtgcttggttgacagctgctgtggctacgctgagaatttgagagccaaactggaagtatttgttatgcttgaacttttgtccatggtaagggggaataaaaaagaaaggggatgtgggcatacggatatggcttcttgtcgttggtaaagagggaaatttaattatttgtcactattaggtttgacagttatccaaatacacctattagatttgttcttatttttttgccgctctaagaagatggcctcataactatttgctacattacccatgcggcatgccagcgtggcaatccaagggtgaaaaacattgtgagacccactagtcagtctctccactctccttatcttccttagttgactaggcgacgacaccagacggagaggcctaggtggtggttaaagtggaggtcaatagccgcggcaaacctctctacggcggcaatggagataagtgccccttggagtgccggtacggcaacgggcacgcggcggtcccaaatcggtggcatggtgaagaggcggtaggaccacaccttcgacgacatcatggaggtagattagctagtgtgtcgcttcctcgccctccagtccctcctcctctacacagtgacccccattgcactcgccagtggtggggacggggttgtgttcgtgcctttctcccacctcggcgcactcgtgtagtgccagctccgcctcacgcccctcgacgttggccgcttcctcctacgccggtctgggattgtcgtgagcccgttgcccccacaccaatgcttcgagggcacctgtctcgacaaccgcccgggagagggccgccatagcctcctccactctggccgccgcctggtcaactgggatgaggaagagataaggggattagaaatattgactagtgggttccactccgttttttacatgtgggtaaaagtgtcaaaaagccattttcttagagagaaaaaagagcaaatctaataggggtatttagataattattaaatctaatagtgactgatagttaaatatccttgggaaagaggtaactgtcgagatttcacgaggggtaatatggactgggtctgtagggtaaatcatgtagggtttggtttgagaatgataaagaaatggaggattaaagcttagagttcctatggattcattcactgtagcagcctttgatttgtaggaattggtcataggaaaactgaaggaaatattccttcgttgctgattctatgggagaaacacaggaaacttcctatctagtctgagctcatttttcacttgctttgcgtaggatcgaggcaatcaagctcctaatctctttcttcagagcaggagaacaagcaatgaatggataaaatttgtgttggatgcagtgtatttattagaaatggaaaatgggcctaagttcttaagtaaatatttctgtgtttttcctatacccaattcaaacgcattgtttacattcctctattttacacgtgaattcctattctatttttgtgttttttctattcctgtattttttcaatccaatgtttcaaagagaccctaaattaattaacagatggattctccagactaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30810 - DNA, 355 bp, Oryza sativa
gcaaaaatctattttcgaaggcggacctcttatgtggtccgcctgcgaaaattgacgtggcatataaataggcgacacatcgctaaattttttttctaagtctcatctcctctcttctccctcagctctcctctccctcagcagccctcatctctcctctccctctcccttagtggccgtgggcattcgacggcaggggcggcgggatccggtgatggcgaagcgcagggtccgcgtcggcgaggcatgggaacggccacggcaacacgcggggtcggcgacgcgcacgtgggggcagcggcacctggcacggctcccctcccagatctggccggagggagggagtggggggcgg

SEQ ID NO: 30811 - DNA, 1143 bp, Oryza sativa
attctcccgtcagttataaagcggtaattttaataaagagaatgcaatagtttaaaacaatataattttcgcaataatcgggttcaaaatgttcgagaagagcatgacttgtcttgctcaaagaaaaggtattcctaagcttcactgacaaactcaaattgcacaacgagaacctccgaagcaacaacaactacacgaacaacaaaataaggctaaaactcttaacaacgaaacgataacagcacataaaaacaacatatgatggttcttttaagttataacatcaacttgtagctcatagaaccgatatatgactattcgaaatttaactgcatttcaaatagagattttttaattgtttaatgcaacatcgctcgagaagagaaatgatcgagcgactggcagctgagaccccacaggacaaacggctatttcaccgtggaccgggttcaccgagacagtctaccggaaaagtaaagcgagacccacttgtaagtcttggagaagagaccgacaagtggatcccataggacaccacgcaagcagccacatacgcgaacagacagctacccgtgggagggataagacaatcgtcactggcggcaacacagggaggacgagcagaggacagcgaggggagggttctcaccacggacacaacaaggcgagggaacagcggcccttgcaaccaatcagtggtggatccagaaaatcagtttgttggtgtcataacgtgtctatcggtgtcatagtatgctaattatacttagaacatagtgttatagtatatggataaacagttttgttatacgttttgccgaaagtcgtcagtgtcgcctaacaccgacgtttatactgtagatccgcccctgcaaccgatgacgagtttggcacaacagcgggattgagatccagaggaacttgatccacaacagcgacgaacggaggagggcaacggagacaaatatgtcgacgacgaggggacggctccggcgatcttcaagcttggcgaagaggtggatgaggaagggctcgacgctgcgaacttgtcgacgatgatagggttgaccttcgggtcgacggtggggatggagcttctgagtcttcacttgacgaggcggcatgcatggccgaggaagaaga

SEQ ID NO: 30812 - DNA, 812 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattacatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaattcgccaaatccttgcggaaaaatgtaatccattcaccagcttctacattttaataacaagagaactattgtatttatctaacacctggattatctccacctttcatttgatccctatttatacataacgttgcgttgctagcggcccgcacctctattttatcaagggtgaggaaatgaagtccatgtacgccacatacaatccgcagaatgtggtggccaccgcccgtttc

SEQ ID NO: 30813 - DNA, 3245 bp, Oryza sativa
  unsure (1)..(3245): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactccactgttaggcacctaggccacattggtgttccatagtatatacattgactgttttacactaggcaaattccacacttggccgtcatcacattccatatttccagcaccagcagtatatttaaaagtaggaatcttctgtttcataaaaaaatacaaatattaagctgacgaagccattataatattttaactggaagtcgcttaacctttttttcctttatttatattatttcaggtgaattctgctgctgagatcatctatgaccttgttgatccaaatgctaatctgatatttggtgctgtcatagacccatcactcaatggccaagtaagtcacagacaaatttatcttgatatagttttcttatcaaatatcttgaaaatatggttcagctggtgcataagtttatacttgcagctgttataaaccttcactcggtgccatatacaatttttttcaatataattttcttgtccaatatacctaacatcgtggtccaatactccagttatgtgccattactcattagtttcgacaaatttgcaactcaccatttggtttgtacctgaaattatgtatgcacataattttgtttctgcacgcaggtgagcataaccttgattgccactggcttcaaacgtcaagatgaaccagaaggtcgcaccacaaaggtaaatgcagttaaataactgctggcccgagttgcacgacaaaaatacttacctggtttcactttggcaactgaagggtggccaacaaacgcaaggagacaatggtcgacgcccatcctctgcagaaggcagcatgattgagattcctgagttccttcggaggagaggaccttctcgcttcccgcgagtctgactgcccaggctcccttcccttgcccagtatctatgcttatcagcattctcctagatcagtcgcctcatgtaggataccaggcatgtacagtactgtagttgtttggttgttcagttttgtttactcccttatgttctatattttgagatcttactgttaataatttgtagcaatgagcttgctaatgctatagaaatcgttttatcccagtaggtcaaaatgatcatatgcccctactcaagttgtgttcatctcacgaggcttttactcggttgagagcctggaggttcctctgttttatcgacattgtgtgtgcattgcctgacaagcatggcaaatcgtatcccttaattttggtttctatgccataatcactattgtcacttggtgcttaaacttaccaagcactatgattatgagtgttcacttcggttaaaatacaggttcaaaagttgtgcgtgcctatgattggcgaaattgaatcagggataacagtaacgattcaacgacaacggatataaaggatgtttttcatgtcgttaacctgtgtaaaaccattgagaccatttgaacaatgcaaagagagaatggcctcctgggtgaaaattgtacaataaagcgctaaaaacgaaccgatcatctttagaacgacagtttttagagctgtttgctttggagtggcacatatctttttttttacttgttttaattgatcattttttatatttttacacgataacctccctcagagcaaccttgccccacagacactagaatatacaaaatattactttcagaatgtacacaatattgctttcgcatctttattgtatttggcaaagatgtgaacccagaactaaagcacatatatgtttgttgtattagatattcggtgcagtaagaaatttctcgacaacgaaacaaaatgaaattcctcgactgaattgcaataaatacaaagcaattccaagtgaatccaatacacacagatatgcgtagaatattatagctagaatataaatgaggaagcccattttacttgaactcaccagcttatcagtaaactgaacggaaaataaatgagccagcttcatgtattcaggctattataagattacaatacttaacaaactaaggcatgtatggaaaaacaaaactgaagtgaatccaggtaatacaagaatgtttgcactcaactatcaactgcttgatagtgcagtcaaacattcaatcctcttaaacaggatttctgcctaccatggtagttgattacttgattgtacattctgttgctcactgttccctgggtgttcatggagcgacagactgtcagcgaaatcatcttgaagcccatttgcaacacaagctccaatttcaacctgtgattattcatggagttgatagactgccaccaaaatcatcttgatgaccaattcgaatgcaagcgccaacttcgaccctgtgcttggtacctctatccctttgcgcgtgatcggtatcatccgcatcctcatcatcactgtcctcatctctagaagcaacaccagcttccatatctttcttctcaccttcctcatcatcatcatcatcatcgctgtcctcatctccagaagcaacaccagcttccatgtcttcctcctcatcatcatcatactcttcgtcttcttcatcgtcattctcgccctccgcaccaaactcctcccctatcatctgctcgccgcgaactgtcttccgacccttgcccttgcgcttcccggcctcctcctgccccatatgcatcaaatgcaggtactgataccttatccccatcatcgggtgcttgtcgaccagcatatgccgccggaatgactcccggagcaccaccgtctgcgtcctcagcttgtgagataagtagaagatccccgggtgcctcgccaacaccttcctgaaccccggcggcagccgcagggcctcgccgagcttcaccagcacctccttctccatcttcttccccacggtgaggctcagcacctcgtgcagcaccgccgcggtcctcttctccgtgatgtcgctcctcggtgtcaggtgtgagccgtcctcgtacggcgagatgtatggcagcctctgccagtcgtcgagccacttgcgcaccttcttgtcgagctcgaaccctcgcgggaacgagagcgggaaggggactgtgtcgccgaccttgtacccgccggtgcgctgcgcgtaggtctgcattgc

SEQ ID NO: 30814 - DNA, 586 bp, Oryza sativa
agtccatcagaatcaatatcgaacgacgccgggacgagcgccgagctgcccgcatgggggaaggcgcctcctcgtatggagtgccgcattcctcctcgtgaggcggcccgccccccacgttcacccttggagggaccggttgtagggccttcgttgtgagtctccagaacgtccggtggcccccaaagtttcgccctctgagttcctccagatctacaccacgatcatcgtggcggcagggggcgacgaccgggtcctggcgaattacttccccatggccctcaagggtcaggcgcgcggctggctgatgacccagccccccgactgcatccattcctgggaggacctgtgccagcagttcatcacgaacttctagggcacatacccccgcccaggagaagaggcggacctgcatgctgtgcagcggaaggacgacgagtccctctgatcgtacatacagcgtttctaccaggtccgcaacactattccatgcattctggcccacgcggttgtttatgcgtttcggaatggcttgcggcataaccgcatgctggagaagaacgcctccaaggagcccaagatcact

SEQ ID NO: 30815 - DNA, 497 bp, Oryza sativa
catgactacagaaccccagattccgcacatcctcacaatacaaagcacttccctagttagatgtaggttagacttgccgtgcgagaaactctaccttctacctgccctcaatttatgcacgattaatgaatgccacctgggtggaagcgagaggtggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgt

SEQ ID NO: 30816 - DNA, 507 bp, Oryza sativa
taaaagcacaaaattcattttaaccaattaaaaaaaaagaaaacaaataaaatcccctcccctgccttttgggcttggcccaagccttcccctcctctcccgtgggccgcgtgcctcctccctctctcggccggcccgcgccttgcgaaagtctgctttacgtcccccggttccctcctctctctccatccggccgacaggtgggaccgtggaccccacctgtcagctcctcctcctacctctcgccagccaaccccaaccgccattgccggccacgtcccgccaaatccggcgccctcccgctcgcgccttcgcgcccaaaccaagtaaaatcggttcctcaccacctcctccaccaaatccctcacttttccccaatttttggcgccaaatcgagcccccacttcgcccacgatgtcgcccacgtcgccggccgttgcccgctcaaatccgccacgttcgggcacgatttctccttcccaatcctataaaaacgatccctggagc

SEQ ID NO: 30817 - DNA, 11821 bp, Oryza sativa
tattggcatcgttaaaaaactcaactagcatatgcttagccaagaggatgcaccaaatactaaattgtcaagttcttgtactggaacacccacttgtcaagttgttgcattcgaacgtttaatttttaattttttgcactatatcgcacccacctgccaagttgttgtaccgtaggtgcaatttactcttatgttaaatacaacgggaatactcctaaataatttacatcaaggctgcactcaacaaggtttttgcctgggcaaggccattaattatttagtactcacttcgtccattttaagcacaactataaattttaaactataaattttaagtttatgcatccaactttaatcgtacgtcttatttaatttattttaaaaagtaaaaaaatataagtcaagtataaagtagtactattcatgttttatcatctaataacaataaaaataataatcataaaaatattttaaataagacaaatgatcaaaattagatacggaaagttatggttacggttaaaatgggacggagatagtagctacgtatctgtcgaagtcatacatgtgttgtacgccgtagaatacaccacatgtgtatacggtgtttggtaagtactccctccttccctaaatgtttgacaccgttgacttttttaaacatgtttgactgttcgttttatttaaaaacttttgtgatatgtgtaaaactatatgtatacataaaaatatatttaacaataaatcaaatgttagaaaaagaattaacaattacttaaatttttttgaataagacgaacggtcaaacattttaaaaaaagtcaatggcgtcaaatattttgggatggaagtagtactagtagtggctagctgccactaccgctagctcacatggctgtctttttctctaatttggcgacgattataaataaccaagtcattccctcgtattttctttccttttgctcttgttagtcaacaaatgttgtcactatcataaataaatggtattgctatcatgaatagatggtatcatgctttttccaatctgtcataaataaaggataacaatatcatctgtttttttcgtactccctatctgtaaatttgcgagagaagatttaattaaagtttcacctttgttgtaaaacggaaaattttttaaatccctttccatatggatcagtacagctatgacaaatattcagggaaaaaaaagttcacgttagacaggtgtcctcggtaaaattaagttgacatactcgcaaacctcttagaccttaatttgaaatggagcagttttacaatatttaaactaaaatataaaaagctcggcgaaatttctgcgtttcaaaaagcgtcccatttctttaaatttcaagaattgaaccctaaaaacaactatttaagatatattcagggctggtttggtttgaggcataaattaggcttaccaatatttaacaattttaatagcgtttagtgtctatttggtttgaagccaaattttagcatgcctaagaaaataggccatttcaatagtgaacttaggctattttggcttcaatccaaacacaactttaccttaccaaaattagtcatgacaaaacttgccaaaatttgacactgataaaatttggtaaggcctatttaggccacaaaccaaaccacccctcaaccatttttgacctttagctgcgaggtttaacaatttaccatctgaatatacatatcccagacatattaaaaatctcaaattgaacatttcatccatggaaacggaaggagccttctagaaccaagggcgcatcgagattcgtgctcaaacggaaaggacgcgatccaacctccatggcccaaaaatagacgggcgagatgaacagcaaccaattcacaccccccttaattgcccgccacgtcaccgattaattgcgcccttaattgggtttaattaagatccagcgagcaaacgccagccatatataatactatatattaaaaaaaaaagacacaaacacacacacacacacacgcagaccacgcacgcgtcctaacctcctctcctcactcccctcctcctcctcgtccgcgacccaccacccaaagatctcgccctcctctcgaaaatctcccactctcctggccctccggggattcgcgcgcgcgctgcttcgctcgatttggtttctggctggattggatccggggaggaggaggtggggttcggtttcgtgccgccattttccccaatttgggtgctgcgcgcgtccgttttcttggctgttcttgggtgggtgaggtggggcggtcggatcttgccgggatgggcgagctttgggcgggatttgatcggctcggagcgtagggcgcggcgggcattggccatttttcctcttttgcccgatttttgatttttgttttttttgggttcttgggagaggctcgcgcggctgcgtccctggaagaaatcttgtgcccatttcgtcgtgctttgtggtgtccctccaagatcgctagatccaattctctgggagcattttcgtttcttcccctcgattcgagagactgtcactatcaatcgctgtcatctcatctcccaaccttttttttcttaccctcgcggaaatctaatccttttttttttcaatttcgatttagttgctgttcgtcctcctccaccaagaatcacccacccgcgagatccaatccaatcctctcgcttgcattttctgctgctgcgtgcgcgtgctgagatttcattcggatttgttgggggttcgctgagatcggagatgacgtcgccggcgacgacgtacgcctcgccgttcgtgctgtcggtgctcctcctcgtctccatcccggtcatcttcctcctcgcgccgcgcctcctcccgcccaagacgcttccggccatcccggacgccgacgagtccgacgacctcgcgctcttccgccgcgccatactctcctcctcctccccctcctccgccacgcccacgccctcctccgccgcgtcctacttcttccgccgccgccccgcccccaaggtcgccttcctcttcctcaccaactccgacctcgtcttctccccgctctgggagaagttcttccgcggccaccaccacctcttcaacctctacgtccacgccgaccctttctccgccctcacgatgccgccgacgccctcgttccgcggccgattcgtcccggccaaggccacgcagcgcgcctcccccaccctcatctccgccgcccgccgcctcatcgccaccgccctgctcgacgacccatccaaccagttcttcgctctcctctcgcaatcctgcatcccgctccacccgttccccacgctgtacaacacgctcctctccgacaatgccgggcctcatggccgccaccgcagcttcatcgagataatggacgatgcctacatgattcatgataggtactatgcccgaggcgacgatgtgatgctcccggaggtgccgtacgaccagttccggttcgggtcgcagttctttgtgttgacgaggaagcatgccatcatggtcgtcagggacatgaagctatggaggaagtttaagcttccttgcctgatcaagcgcagagactcgtgctatccagaggagcactacttcccgacattgctggatatgcaagaccccgaaggctgcaccgggtatactctgacaagggtgaactggacggatcaagtcgagggccaccctcacacataccggcctggggaggtgtctgcaagcctgatcaaggagctgaggaaatcaaatgggacatactcgtacatgttcgcccgcaagtttgctcccgagtgccttgagccactgatggagattgcagactctgtcatcctacgtgactaatccagcaacaacaccacatttcagggtgtcggaatttgtacactgaggtgaatgaggtatggatatgtactgttgctaaggtggtgtcaaaaagatctaatcttcttttaggtgttgtgttggagacaatgtcactgaatggagtgtacatagtatgaaatgcgggaattttaggttgttctgtaatttgtatgcttaacacttacgcaataaagtggcatgctacatcaagagtgttgttgtgtcatcaaatggaatgcttactacattggattgttcgtgtatctgcaactgtaagtttctgtttgttagattgtttagaagtatttgctaattggtagaggccggtgggtcttttgctgttgctgaacatatgttcttgtgccattttctcaaccaggtcagatgtacattacacaaattactatacaagtcattactgtcattttcttggttctggtgacattcataccactcatgtaatttggtttgaaacattttgaaaatattttaatattaagaaaacctgtttctatccaaaacatgcttttcttctgctacaaaaacaaacaaattttaattttgatgctcattctgatttttgttgcagggttgtgatgtgatgaacaagcacagagtgtccatctatgcccttgaactactacgtgaggaacaacatatcccctctgttttgttattcagagattttccagcaattgaatgcgctgctgggaggtgaggatggtatgactacaaattgtccctacgtgagtatcctgtatgaatgtgacaatctgttggaaagtaatagtagggtgttagttagcatgatcgtcctatgtattacatggtggcactgtaaatacatgcagtgatggtttattatttttgttccatacatgccacggctattgttattacacttcttatgttctgcttgccatgataatgacagtttgtttcttagtcggtcttgcactttgaagtgataataataataataataataatagtaataataaaagggcctattgatttctgtaggatgtttttttatgaattattttgtgaagaaaaaaaaagtagatctgcattaacagggttcaaagatcataatatgcccattttttgggttcaaagatgtaggcttaaaccctaatatacccactgttgggttgggacttgggagaatatggtttcctaaatctattggccgaacttccatataccctacccgctgccccctctgctaataggcattgtgatatttctgtcctgaatctatgctgctcctaaactgtacatagcgattggtatggcttttggggtagatcataaggttaaaatatgggcgttaattgtaactaggaaggtggcccgcgcgtatgcgcacgcgcgggcacttatattattgaaagataagattattgtatgttcagaaattttgtctcatagatttagggcaaactaaagtttggataatgttattttataataatttaaggggtctattttttttaaggtatcttagaaaaccattcacaaacttttgagtaggagatggattaagtacttacgatttttgaatcatgttttttttctcgagtaaattataaactattgatagttaattatcataagtccatgtatatacataccgtgtagtatggccgcaaattaaaaatgcgagtgcaagatactcaaaattcttttgattaaatcgtctcatgaaggcgtatgatatagtaataaagggagggaagcatatgcatgggaaaaaaaagaagaaagagaaaaatgaaaaaatggaggggaggcgtacgtagccgcgcacgtaggtgcgtacctttgtcgaggtctagtatttagtttgttttaagatcagtttaatctaacggtttataatagatactttgatatttttcatgagaatttctaatatttgccctaatttattatagcaccacgtggcagcttaagagtattttaaggaattttaaatgactaattagaatattaactacgcaatatatatgtatgggacatatggtaatatttgttctagcttcatccatgtttatatacatgtagagagaaattaattttgtggctagcaagccattagatgtctaattaatagcaattaattttgacacctatttacaattgttcagagtaactcttatatattcatcttacgactttgatgatccgttgatcaccaatttactgatcaccatggctcgcatgaaaaaaatatgtagtacttaaggtttaggacagttgaaattgatgaattatataatttatgtgatagctatttgagggtataaatgaatgaattgacttctaaaaagttagaatgttgtgtaaagaagacaccatttagaaacttggaaagagtgcaaacaaaaatccaaaatatggaatcggaaaaaaaagagagggccttaaactccctttatcacccttgtcgtagtaagagttctattgatattcgttaatattgcgctcacatttataacataatgattcctttcacatgtacgaacaaatagtacaaaatctaaatacgacataacacaaatacattataattgttatgtaatcaactctcggtttcaacttaaacagagctaattagtgttgagaaaaacacaacacatggtgcttaattattctctcgctgcatcacacctttaattttcttttcatgttattaacaaaattaatcatctccatatatgatttgatatgtggcaaagcggtagtgctatagcggttgtgatcaccttaaatgtctcagacactatgctttgtcacacgtgcgaaaggtaaaagtgcagacgtgcattatgcaacgggcaaaaagagaatttttgacgctttatttattagcaaataatagatccgatgattacatcgtgtactttttaaattgttaatttaatgggtacacaatataatggtgtaggctttattttgaaacagtgcattacatgagaataatagaccaatgtaataaaaagtagatctgatgatttatataatggagtgcccgtataaattagttaatatagatattgtttatttgataggtacacgatataattgtgtaaaacttattttaaaatagtgcattatttgaaaataatagtaaagtaatgagtacatcggcttaagttatatgatggtagattttttgtttgtaaaattatgattatttaaaaaatatatccattatatatataaatggaaaaaagaagaaaaaaggaaagaggggggggggggtggaagcgtacgtgtaagtacgtatatactccacctgccaatgtgtgggaggggaggataggtgggacccatggtatttagtttgttttaagatcaattttatctaacggtgtataatattggacccaccaatttaaatgaaaatcaagggatagatgttttgattttttttttagaatttctaggattttctctattttattagagcgccacgtggcggtttgagagcgtttgtaggaagtttcatggacgacttttagtatataatagaagatggtacattagaggggattgctgtcgtggtcttggaaagtataagcaagaagagtttgggatgaacattggtttgttttagcacctcagcaagtttttggttgcaaaaagaaaaggagacctatttcattctttggaacttctgcctgtatttagatatgcctaaaaccatagtagatggcttgtgtctgtctgtctgtctcctctctgtcgccaggttttctctgggtgtttgcaactgacatctggttaattgttcctcttttgtcatgattatttttcagaatggtggatcttaaaacagttatggctagcagtagcactaatgtacagcttggtagcagtcaaccgtgttacctgtttggcgtccatggacgagagtgactgaaagcatggaaatatcaaatatggcatgatgttgtatttatgctgtactccctccgtttataatttttatattataagtcgtttgagttttttcctagtcaaattttgttaagtttaattaagtttataaaagaatttagcaacatctaaaatatcaaattagtttcatttaatttaatattaaatatattttaataatatgctaaaaatagtactatatttttatataaagttactcattgactaagaaataagtcggacgacttaaaatatgaaacggagcgagtataaacaagttgctgccttgctagaaatctgtgatggcattttttttttgttgaatgttcttcgtcggattgaaaaggtgatcaactcttaatctgcgactgaaaaaactgaagtgatgaagcagcaattagcccactgaactaacaacgaatttaacagcgccgaaaagtccaaattgttgagaaatttaggtgccacgtagatgagggatgttacagacatgtgtgggacacacataggtgccatgtaggataaaccacttaaggattgatttttgagaaaaatataaaaaccacatctataagtcactttaagtttgacattctaccctataaatcattttattgtaaatacctatccacttactcagttttattgcaaaaaccaacgtttgtgcatacatgtttaaccgaattaatatattttcataaagtgtgagccgtaaggtgttctttactaaaattaaatattgcaaagtgtagttttgacaatttttttttaagatttcacaaatagaattatgttgagagtttaaatgttgccatattgagttttgctgtatgaaaaaaaaaagttcaatcaaatatgaaaaataagtctaatgcacgcatttggataagattggcttggctaacttagcatgtggtgactctagctcagtgataacgaattgattcggttaagcacgtgtgcaatgaggtggtttttttaagtaaaactgaataagtgggtgggtatctgtcgctttgcttcgcccgcctgcgcgtcatcaccctactccgtcgtcgctcgcctgctccgccgttctcctcgtcgcccaatgctgcggcgcctgcccgtgtggggctgcatcaccggcggcggcgacacagtgccgtccacgccattcgcgaccagccaccgtcctcgccttctcctgtgtcgcagccgacgtcgccgcctcttctcccgcctcaccccgacggcctcctccctagcagcgccggccagccaccgtcctcgccttctcccgtgttgcagccgtcattgctgcttcctctcccgcctcaccccggcggcctcctccccagcagcgccggtcggcttgcctagagaagagaagaatgagatagaggaggagggggaatagggagggtgctgacgtggcatcttgacatgtggggtccacgtgtgtcccacgctgactcagccatcatgtagtgcaaaatcggggtcaaaatcaccgaaggacctaaagtgaatggtttgtgtaagttgagggatatcatatatctggttttgtggttggggacgattttgtaactcgatgacaagttgagggaccttcggtatactttttcctacttccaatgttgtcgagaaatttagcccacagaacgagcggccccaaaggttcagtcagaccgacccaggttcatgtcacagaaaagtcaacccacttagtttaacgcccaacagcgtcaagaagctcagcccaacccactaacgaccacgacggcccatcttacccacagcccaacaggaccagccctcaataatttcagcccgctaaactaaccggcccaccaacccacctcctttccccttcacctctcgcctccacctccatcgctgtcacccacgagctcgcctccctcaactcaaccacttctcctactacagccaacctcctcttgcctcgcctcgccacggatcgcgccgccatggccgcctccgcctccgcgccgccgcattcgctgctgctggccgccgtcgcgctcgcggcgctcgcgtcggtggcggcggcgagggacgagaacggggtgtacgacccctgcagcgacacgcggatccagcgcggggacgggttcagcttcgggatcgccttcgccaccctcggcgccttctactccggcggatccgtgcagctctccccctgcgaccgccgcctcagcctcgcctcctccggccagctcgccgtcttccgccccaaggtcgacgagatctccctcctcaccatcaacaccaccaccggcttcaaccccgtaagcccatcccccccaccttccccttcttccctgcacgcgtctcatgggggttggtttactttggttgggtgggtggatccggtggagcttgcgccgtacctgctcgtggaaatgccgcactaggtggcggtcggttaggcgtgatctgctggtcagcttctgtgtttcttggtttgatctgagctgcaggaagcttggactggtaggattctggaggctaatgtagcacttcttgatctgggtagagcttggagtaaactcgttgctcgatcagtatgcttgtgacacgcaactatgatgaaggaatttcgctccgtacgagttcatggcaatgtagtagatgagctggagactagctgggattgctgatcctgttgccttagtgctgggttgttgctttaagtgatctcttgcaagaactctcattttagtgtgacctattgtcatgtgggtccttttcttcaccctgacattcctgtggagggcatcgggcctgggtttttacgtgcgaatagtctacatagtgacatagaagctcttttctgtgggtactggtaggattaacctcaaatgttatagtattccacccatctcttgcttgagtacactattttgcatttctacccaaaatgtagcgtgaaggatactgatgtactttgtgtttgtgattgtaggcaatagtgcagatagagacagtgaatgtgttaaattaaattgatgataatagcaagtgttagatgatgttattttcttcttccaaatgaattccattttcactgagttaattgacttctgtttagataggtgtaatcatggtttgtggttaaatgccttgatacatttggtctctttgatggaccttgaataatgctcacaggttatgcaagtatgcaacatatgaatactttggtgattttgtcatattatattgtggtgaaggaagccttctagttttcttatcacctgtaagttagtgactatagtctacaattccattaaatgcaacactaacaatatctgttctagacttgttgtgtcccaatcttgctaatttgtagtcacataaaggaatatttttctttggtttaatataaatgcatttatagtttatagcgtttcaaggactgctaaaccttgaaatttgactgctatgcatattgcatcaatttccaaggtatacctacttctaacttaatagtggccactacccaaagtcatcaaggacatactgacatagcatcatgtatgtgaagtactttgtactattgttttatcttcttttttttgaaagtttttttctgacatgctgctttgagaaaaaaatcctatgacaactaaaaactcttatttttctcatgaaatccattcagttttcatcctatggactactgttatcatgctatgatacgccaatggtgaatccagatctgtttagaaaaccatttgcattttgtacccaagcatgcaatgctagagcaagaacctaggcttgagaatttaatcccagcatgtcccgcattaagaaatgtcatttccacttttgatctgcttatgtctgtagtttatgtcaaataaaggcttctccaattgtgagaccagataagctttagggcctgtttggtacagctccaactcctatatataactccaggagttgagtctggagtggagttg

SEQ ID NO: 30818 - DNA, 6155 bp, Oryza sativa
acattttgtgagagagctccacccaactccactcccagttttggtggagctgaaactgtttgcctaagctctagctccaggagctggagctgtgccaaacatgcccttaaactccaaagcaattcgtaccggctattatttatttattttttcaaaaggttggtcaaataaagtagattgttaaaggttatgcattggctaaattgtttaaatatcattgtatctcaattgattatgcacgtttctatcttgagtttatcacaaggatttattttgctgacttgggctccatgatgcacgctgcctagtagtttgactgtagccaccaataatgttcagcattagcttttcttgattgcgtcattttttcattatattttttctttaaaaacaggtgaactctacactctgattgttgataacatggcctactgttaacctcaaaatgttacctgtagctcttgatcttatttactttgttgatcttggtcttcaccctcatatatgtcaatttagtagcttataatgtgttcatcatacaaatgttgatatttgctactattgcttagaatgctctagagagaacagaaaatgcttcttctttacaaattgttccaacatttgataagatagtaatattgtgaggaaccagttccttcagctttgtttttcattagctaagttgtgtgatcactcagcatcgtcaattttatcatgtcacagctcactggctcttactggacactgattaggtttagtgttcagccttttttgttttctgcatattatgcatctaataagatcattgatggatctaatacttttttgttcagtccttttatatataatgcatcaaatgatggatcagtatataaccaaaattcttctgtgtatatttcctaggccacagctggtgggtacatggtagcatttgccggtaggaagtatgcagcccggtctgttccaacctttgtgtccaattcctcatatacagtctccagcttcaccctggtatggaaccaaagatgtaccactatgcccatcacctatcaacttgtgacacaaagaatattcttaatgttgtctccatctgatgatacttgtctaggttcttgagttcaataaaggcaggcttcaaaacttgcattggaagaaggatggctgtggtgcttgcgcgaaatcttcaagccttgtttgcatcggcaagcaaacctgtgccttcagaacacagagctgcaagagccagggacctgttgactgcagtatcggcatccagctggctttctcaggcaccgataaacacgaatcagttctgaactcgtggtatgaggtgtctaacctgcggcaatactccctctacgggctgtactcgaacctgaaggacaccctgagcggccagttcaacaagttcttctaggcttttggtgcacccgttgttcatactcttctgccactatttctctggagctccctgcctgatgctgtacctattgctcgttaggtttgcccgatctgattttagcttgtgtggagatgctcttctgcgtcattttccactagtattctttccattccagttcccacttaacttcaattatctgatgggttgctatatgttaatgtcatgtacgcaagaaaggtccttgtccggtttgcgcgtttgtaaaaaaacttctggagtgaatcatgatattaacagctttcatctatgtaccagtcgccacatgtttcagaaattgctgtctatgatcatcggatggttaaactatcttggagtcttgtgtttgcaattgcatcatggaaaattctttttaatggatttgacatcactgaaataggtctaatgtctaatgcaaaggaggattttaggaattatactgtttcctataaaaattgtttagattttcgcgtttcaaatgaaccgtgaccggtgaatattccaatgaggaacagagctgttgtctccaacgtggcaacagacatgctagccgaagatatagcagacagcaatccttggtgcgacagagattcttagctgctgatggtctgatattctgaatattgttgccgtaaaatccaatgcgtcttgtccatttacccgttgattaaacttattacgtaattacagttttgcactatttacgtttaacgtttgaccgttcgtcttatttgaaaattttttatgatcagtatttttattgctattagatgataaaacatgaataatactttatgtgtgactaaatatttttaaatttttcacaaatttttcaaataagacggacggtcaaacgttgaacacggatatctacggctgcacttattttgggacggaggcagtatagtgttcctttctccagtttgatttcctgtatcaatttcttggaacacatttgccaggatgtttttttttaatcagaagctgtgttctgtcctttccacctctgacaattgggggttcacctgatacctgacctagcaacaggccgacaggcaacatctgttgtttttttttttttttgataatactccctcgtcctaaaataagtgcagttttgtactattcacgttaaacgtttgaccgttcgtcttatttgaaaaatttttatgattagtatttttattgttattagatgataaaacatgaatagtattttatgtgtgactaaatatttttaaatttttcataatttttataaataagacgaacggtcaaacgttgagcacgaatatcccatggctgtacttattttgagacagaggtaacaacatttgctgttaaccacagtttagtttagcagcaaacccctgcagaaacgagacaggcacagaagttctctgcaggagatgcagaactgctaccactgcatatacatggagtatggcagaatgccagagaggcgtcactcaagcaggcaaaaattcagagaaaaaaaggccagaattttcttggcttggcttgcattgaaggaatcgtattcgctagtatcctggtttcttggtctcttcgccaatgaagctaggagtatcctactccatcatggacaaacattgcatgacaaggatgcattcacggctcaccaaaactgaagttaaaatataaagggggcaccaaactttctgtcatccaaaaggagcaaaagacacatggaaattagcactttgagaggacatcggagtgaagggacagaagcagcagcatgatagaaaggcactcacatttttgcaagggagtgagcacctgagttaagtttactggttaactggtactcctaacactgctgcagaaagagcactcaaacttttgcaggagggggggaacacctgaagttaacccctctgttctagtaacaataagacaataaaagttcactttttatttcttccgtttgttctaaataaatttatttttggctaatcattgcatcggagtttataaaagtatgaaataaatatattgggaatagataaaataagtaatgattgcattgagatttgaaaaaggtgagggtattctgttttttaaattttttttattggtatgtgtgggatgtgtgaaaaataaatttgttttggaatggagggagtaattgacattgatgctacgtatttagtttaagctttgaccgcttgcctttattacagaagatttataaatagttgaaaatatgtcatcttattggaatgcgaagcatcgtaaatgtaacctataactttcattcattataatataattatttacatataatttatggttaaaataagatagttgtggtcatcaattatttaaaaatgaatggaatgtttactcctccctcaggttccttattaatttaacgctttagacaagagtttggatactaatgagtaattaattagagtgactatttcctattatacccataataattatatccgtgtggctagcttaatgtgttttgcatacacgaaggggtaaattagtccaaacgtaacacaccaaagctaaaacatctttttttttctccatccaaacagtctagtctctaacaccaactaataacgaaccggagggagtagtactccactggttaatgctgtctgaatcctactacatctgaaaaatccaagtgttataggctaactacatgagcaagcattttagtagtagtatcaaacacaagatgttggaaaggagatgaggtgagcatgtgggtgttaagaacagggagaagataagatggtgacgtcacggtgcaaaggtggctggatggagggaaagaatggtggccagtggccactcacctgggcagcaccactgtaaaaaaaaaaaagaaaaagacatagtaagatttcagtgcaacatcagaaaggatttttcagtgcagcatcatgccccacagctgagctggagttccaacaaggtgcttgcatgtgatgtttcatttgtttttgtggtggtagtggctgcatgatttgctgctggaagtgaccagtagtttcagtgtggtggtacaagattcatttcttgcatggcttcagaagaatggggtttgactagtactccatttgagcttattggagggaattaacctgctaaccatcttaatcataggggccaaaaaaggagaagtttatcaggaaatggagagatcatgggatcagattggcaaactccctttgacggagcaattgagaaattatggaagaggaaatgaccggaatccatgcgaaaaccgataatagtggatttgtaattggacacttgaagtaatgccgtgagaaagacgaaaagaacaacaatacaagtggataattacgagtgcgccatctagaaaaaatagattatacatgaatgatctctacacagtgccacccgtgtgaatatatatattttctaggtgatgtctcaggcaaccgcgtatgtactaagtgttattacgagcggtcacttaaaaggcaaccgtctacgtactacctgctgttgcccatgatattccatttatacggagagttcaacgttggaagaaaggaatggactatccactactacaaaagtgatttttctgtacgagaccccataatttttacaaacggaccataactagtggcgcctgcaaaaatcacgtggcattttcgcaaacggctccttaagaagcccgtatggaaaaatcgattttcccatacgggtctcttaagaggtccgcatgcaaaaatgatgtcatttttgcatgcggctcacttaagcgcccgcatggaaaaatcgatttttccatgcggctcacttaagcgcccgcatgcgaaaataaaattgaaactagtgtatctcactcatacgaactccaaattggatgattctttttcctaaatgtttctaaaatcatgctctatcatgttattgtgttcttactgttattatttaggccattttttcttgtgactttgttttatcaatttaaaatttaaatttcaaatcttcaataatattatgaagcaataaacgatttcagctgaaaaagtcaacaacaacaaagttgtataactcatcaagatctataatttctattttggtcatttctttatttgataaagtgatactaacattttcacaaaatttacatctctctcttatagtttataaaactatataatagatatgtacattctgtgaataatcttacaaatcactttgtcggatgaataaatgaccaaaataaaaagttatagatattaatgagttacaccaattttttattgacgattttttcagttgaaatcatttagtatctgaaaatgttgtttgaagttgttataatttgaaattcaaattcagactgttcaaacaaagtcatatagaaaaatgaccaatacaaaagttgtagatcttgataagttatacaactttgattttgataacttttccatttgaaatcatttactacctaaaaaactatttgaatttcttatattttaaaattcaaattttatatagttcaatcaaactcggatggagaaatgaccaaaagaaaattggtagatctcaacgacttctacaactttatttttggcaactttttcatatgagtttatttaagaccataaaatttgattcgaagttctcacatttttaattaattttttaatgattatttttacctgcggaccacttaaggagc

SEQ ID NO: 30819 - DNA, 753 bp, Oryza sativa
aatgacgacggccgcggcgggggcgacggatccgatgccgccgccgacggatccggcaccggtgacgacgatgggtggcgggggcgatggatccgccgccggcgacgacgctgggcgacgggggcgacggatccgccgccgacgacgacgccgagcggtgggggtgacggatccggtgccgccgccgacggatccagcgccggcgacggcggggggtggcgggagcgatggatccgccgccggcgacggcgtgcggcgtggatgcggcgctccggtggcgggctagggtttggtttggggttttttcgattttattttttttgtttgctcaatttattttcgcatgcggccggtataagcaaccgcatgcgaaaataggattttcgcatgcggttgcgccggccgcatgcaaaaagggtgatttttacagacgatttcgtccatgcggttggcacaaccgcatggaaagatggttctcagccgtatggaaaaaccatatctgtagtagtgatctacccagaatattatttaatagattattatgtctattttataaggaaggtagctcttcaacacccaccctcctccccatcctagtaaacttaaaagcaaatattttccatttgagataatccattatatgccactgactttgtcgcacatctacgatttaccactgactttgtcacgttctacaatatgccatcgacttttgcttaacttctacgatttaccatcgccgtccggttagcc

SEQ ID NO: 30820 - DNA, 5786 bp, Oryza sativa
gcgatggtaaaattgtagaagttaagcaaaagtcaatggcatattgtagaacatgataaagtcagtggcaaatcgtagacgtgtgacaaagtcagtggtatataatggattctctctttgcatttttatccgcctgcaaaattgaggctgagcgaccggcatacgaaatccgttcttttagcagtgcatgattccagtatttgtattccaatttaaaagtactcaatttgcccgttaattgcaaataccacaaatgcaatcctctcggctatagaatctgttctagaatttttcatttattggaaatactgcggctgagtatcattctaaatcctatcatactgcagggttgaaatcaacaaagcgaatcattttcttgtaactttgattgtttgagctacgaagaaataaacgagcaaaaatactaatttatggggaaaatatttatgttattagcagtttaaaagataagactgaacagtagagtatgatgaaaaaaaaatctaaaaaatcatctgtaaataaaattagatctcaaaatttaaattttggttaccgttgaataagatttatgattgactttgatccttatatgtatcacagacgacagtacgtgcacacatgaatattagtaacgggtgagatgtcatctaaatataataaaatttcgatctctcttgttatgcattactagtactcttactatttatatgtatagtactccctccgtttcaaaatgtttgacaccgttgactttttagtacgtgtttgaccattcgtcttattcaaaaaatttaagtaattatttattcttttcatatcatttaattcattgttaaatatactttcatgtacacatataattttatatatttcacaattttttttaataagacgaacgattaaacatgggttaaaaagtcaacggtgtcctaaaagtacagtccaaccgttttgtcccgttgaaactgcttatatagaaagaacaaatattatatagattccagtgatgacagcaattagatagtagacctaaccaagagttatataaccaaaagatgcactgaagctttgcattacattgtgcaaaaacaaacaccattaatggtgctcatctaatatgctggccatgcagttcttgctttaaaaagctcagaagagaacaggattctgctgcaattaaaggttgctggctggttggcgttccactatatcatccactccctaaaatatcaccatcatcttttctgttggcgagttcatctagttaatttgtgtattgggcttacatgcaagatggccccatgttttcaggtggcatgccttctttttatcctttttctactaggtagttgctcagtgcacaagttttttttccttttttttttatcatgggcattagagcagctataatagcaggctattagccagctataaatatattttcgtgagatgaaagatgagagaagagcagtgagctacagatttgtagtcagctgcagtacggactacaagacgcagtgtatgtatgacaggtgggaccatatattaatagtatagtaagcaactattgtataaattggagttagtagtgggctatactattaaacttgcttttatggatactaatggtttgataatatatagtattaggtgtttgaactgtgtagtttgtgctacttgatgtcacatgtcagtgatgattttagagcgtgccttttagcctttttctatcacagtgatcacgcaaatcaatgagatgtagaatacatgtggacaactcaattgaaattaagtagctagaaacccccttggcatttaaatttcctactatgtttgacatttcatttctcatttatatggctgaacatgttgtagttagtaagaatagatcgtaaggttgaccatcagcactatattttattattgccatgcttactcacaagagggatattttattcacgggcatgcttgaccagtagcgagccataaatctatactcctaataaatcccaaagcactagcaattattatatagagtattttacatcacatacaagaatacaacatcatcatccactagcaattattatctagactattttaaataataatagagtatttttttttcaataattgttttctccttatgtgttggctttattgtttaagttatttttgttgcttgagtatttgctctttttgagagagtattgtaataattggttgtagcttcattgaagcaaaggccggatttaattccattatctaaaaaatctagagtattttaaatatcatacaaacatcatttacaatgttattgtatttttagaactcaatatgcaagcaatgtcaaatcattgtctccacattattttcacattatttaaacatatgcatctatcatttttataatgtataatatgcattcatccatatatcccgcaataaagtgcagggtatctagctattgaaagactagttgatagagtgactatttgattggctatagatgatgtgtcaatttttagagctatcagttggctgtactattaaacttgctcgtacatagaggcttttgcatgggctcttgttctctgaaaataggcaaaattctttgcagaagttcactcgacttcttggcatgcatttctcacctaccaaacatgttagatatatgttattttcttttctggttttctctgaatctctgttaatcttatttaattaaatatatacaaatatctcatttctatttttttatgtggattcatgtgtgaacttgtcacgcccagaaatttagcccaactttccagactattttgtgtattaaatccctgtccaggactagctagggtacacaaaacgacaagtaatataatatacagttccaaacgtaaataaagcgtaaaatacttacagaagagtcacttagtcctcacaccgaaacaaaagcagcagcagcggaaaaaggcgatcctagcgaggcttcagctccactccacaggcaaaactcaactggggtctaagccttggtcttctaactttgtcttcagctcagaagcactacacttctaaaaagggggaataatagcaaggctgagtacaaccaccgtactcagcaagccataccaatgatgcagacgtgcaaggggatacaaggatggcttgtggctatttgcataaaggcgattgtaaaacattttattgagcaaaacggtaaaactgttgagtaattaaagtaatattaaatctccactgatcaacgctacaccacgttgaataggcccaaccaacccacctgaactatagtgcattgggtcgatttattaagtgtgagactaatcacggtgattctggtcaatcgcccataaccacgggcacggctattcgaatagttttactctggcaagaggtacacaactgtacccacaagacacaatccaccggcatgtcaccgtgcccggccggacacgtcaccatgtcgagtgattgtgacaagacccttcatataacccgctctgaccaagcacaccacacctcaggtttcaccaccgcccccagcaggcagcgagcagttccctctcgtgcctaggtgaatccggaagcgacagaggccgtcgcagggcccgccccgctccatcacgcccactcttgcctggatgcatcagccagagaaaagctatacttcaagtcaggcagttacccatttctgcttgtggcaagcgctgtatgtcttccagtgcatcccgcaaaccggtccttacttgccatgggtgcgaccagcaaaaccatgcacccacagcccaccattcagtcgtattttagttggataattacgaccatgaaacatggccggatgtctcgagcacgcagctcatcatgatactaacatgtctaatactgcaattatcccatctactgagctagtggtaattaagcatggctaagcatatagttctagctaggtcatcaaagtaacacaagctagtcaattttcacccaaggttgacaaaggacatatatcaaataacatggcacaagcaagcagataggtaaatcctattcccatgtaattagcaaaacgatgcatatttatttgcaaacaataaaacatttataaatttggatcaacatgcccaaggggaatgtgtgacttgccttgcttcttcaaacaatcttccgaactcttatccttgcgaccgcgatcttccgaaacgacggattctacacgctggcacgcaaaatgaggaaaaactctaataaaaaccaaggaaacagtacataaaaagtaaacaaacatgtagagctcaattttagatgaattttgcaagttgaatggctcaatttggagttcgaatgaattagatatggattttagaagttttgagccattttaatgaatttctagaattattatcgatttattgcacaattaaatcctttatggcatcagccgagaggaaggggtggcgccgacaagcgggccccacccgtcggtgattcacgggaggcgggtgcaccgtggaccaagtccacgcacgcgctggtccgcgggcgcaccacgtggcagacacgtggcaccacgagggcacccacgcggggcggcacagggaggccacgtggacggcctagatcggctagggcggccgatcgggcggccacgggcaggcgcggcgcggcaaaggggtcgggcggccgcgggcgagcagggcggcggcggccgaccggaaagcggcggcgctcgacccgatggtcgccggctgcgggcggcagcagcgctggatgcggtggcacacacgggaggcggcagggatgggagaggggctcactgagagggcggggacggcgaggcgaaggcgggaaggcggccgacgacgaggattggcggcggcgcttctcgggttggggtcggggacggcgctccgacgactcccgaccgcggcggaggtacggccgagggccagcaggacctggggaaggggatggcaggattaggagggcacgagaagactcccggcggcgtgaatcaccggccgaaagaaagaaaaacagcgggtgctcaccggtgtgcgatggaggtggagttccagcaggattagggcgacggggagcggtggccgaggaactccttgtccttgcagagccgagggaggcgacggcgtgggttggcgatgaccaaagcagcgggacgacgtggctgcagtcggcacacggaggtggtggctcgggtcgatggtggaggggtggttgcggtggcgatttagggaaacaaagcggatgccggtgtgcggctaggcacagcgaacctttcggcggtggtggcgcagcgcggcagcgacgggggtggcggtggcaagcgactggaggcgacgagaggcggctgtgactcgggtgcacggtgaaaccggcgcccgggtgatttattgcggaagcggagcagtggacggggttcggcaacgcgcggcgaggccggcggcgcaaacggcacggcgcggggacagcggcagcggcggcagcagccggttggagggtcgccggtgagtggcggcacttgggctcgcgtggggagagcgggagagagcgcggggagctcgggaaaaatggggaaatggaagaggggaggccggggatgctttttataaactcgagagtcgacggggaggccggttggcggcggatttgaagggggaaaggggcgccggcgacgtgggtgagtgggctcggggtggcggcggttttcacggggagtgggggaagaacggcgcggacgtgggcggagaccg

SEQ ID NO: 30821 - DNA, 2000 bp, Oryza sativa
gtgggcggcaatggcggttaccggcggagtggctgtagaaagaagatgacaggtggggccgcaggtcccacctgtcagccagaggaagagaggagaccggttggggggggggaaatgcagactttgagagagagggccgagcgggccgaggaggaaaaggaggccggcctggccggatgggggggggatggaggaaggggtggattgggccgaaaacggcccaaaaggagaggatggaattttaatttgttttttctttatttaaattgattggatgaactttgtattattataattatttcttgagctctgaaaattcacgggaaaatttcagagaatatttagggcacaaagaatattgcaaaatattctcggccaatgatttttaagggaaaattttaattctcctattatttcacttgattaaattgctttaatttttatttaatttctagaaaatgcactattaaatgatttttaatcctgaatgaaaatcggggtgttacagaactctagttgttaagtacatgcgtttagagttgttaacaaaaacaagtttgctgacataaaagagaggaggaggagaaagagagaaaactttgttgttatgtatgacaacagcttaatatgtaacaggaaactttattgtatgaggatggaacaaaggaaataaaataataaaaaactattttagtgcattaattgttaaagtccttttgccgtttcaattgttattagaggataggttgtgtttagttccacgcgaaaattgaaagtttgaagaaattggaatgatgtgacggaaaagttgtaagttcgtgtgtataggacagttcgatgtgatggaaaagttgaaagtttgaagaaaaaagttagaatctaaacagggccatagtctctatatgaaataaagagtctatatataccactgtaccaagcttttgaacatgtcgtataaggtccttctcgattggtacaagtaggcaatgtttctctcttaaaagaaagtattctgcaggtgatgaaacagcaatatgaatacacacggatcacttattttgtattgcaatttgcaatataacaaaacataacaaaatcattgttccccgcaaaaaaaaaacaaaatcattgttggcatttttttgacaaagtcaacaagcacaatcgcaccacctaacgctttacagtgatcttagagtcgccaaccacctcaatctagcaaaagctaaactaagatgggttttgataaattaaactggctagcggagccgatctagatagactgatagataactacccgtctcttgggcaaaacggaaggttttcaggacaaacctacaaagaggtgtcgcactctcgcagcggcggcggatgatttacagcgcaaatcaacaaagatggacaaactaaactagaactaaagcaaaagtaaaagaacgattcgattggttgatagttggttgtgtctttacaatgaaccggccttgccccttatataggggttggtcttaccctttacaggtcctcctccagtccaactcgggctagaaacagatgaaaatacgaaacatgcctttccgagcaaggaaacccgagaaacgacgaaaatggagtctgactcggactctgccggttagacgggccacataccgctggtctgaccggcccactggcggcggtctggccggccaacacacgacggtcagaccagccctcttagaggaaaaccggcagaatgtccaaaccttggcattttccctattttaattctagatgccaaatttaggtgtgaacaatcataatattgctatattgaaatttcgagactatttttcttctatcatttcaatatggcagttatagtagtactccattgaaattacggttagtaattgcctatatacacaatattctaggtggtcatcgtatttagaatactaaagatcatgtgataggtcaatattaatatatactagtatggatgatgggacatatatagg

SEQ ID NO: 30822 - DNA, 12291 bp, Oryza sativa
ccagtccaactcgggctagagccagatcaaatacgaaacatgcctttctgagcaaggaaacccgagaaacgacgaaaatggagtctgactcggactctgccggttagactgcccacatacagatggtctgaccggcccactgcgacggtctggccggccaacacacgacggtcagaccagccctcttagaggaaaaccggcagaatgtccaaaccttggcattttccctattttaattctagatgccaaatttaggtgtgaacaatcataatattgctatattgaaatttcgagactatttttcttctatcatttcaatatggcagttatagtagtactccattgaaattacggttagtaattgcctatatacacaatattctaggtggtcatcgtatttagaatactaaagatcatgtgataggtcaatattaatatatactagtatggatgatgggacatatataggggagcagggtggttggatcaatttgagaagggttagactttttagcggtgatatgggattatttaatgacttgagattcttgagaggtttattgttagaaaataaaaccctatcatatgcagtggctttaaagacggttcaaaaagccaggtatcaaactaaagaatattttgactttatttaggagtaacacagacaacatctagctgttacaaatacaagtcaaaggtaaaataaaacataaagaatttctggtatggtgctaaataagctttccattaattccctcagcaagtggctgacatggtagacctggacccaataaatcaaaaatattcatggcatttaaggaatagcaaagaaataagactagctatagtataaatattatctattacctccgttctaaaatataaatatttctggatccaaatatttgtttcacaaactatgagtatgtttagttgccaaccacacttggtgtccatgtaccaacaaaagtcatcacactgtgtaagctgaggcggtcaatttcattatcacacctagcaagcataagggaatctttccatacttttttttttactcattgatacgtgaaatctaatttgttgaaagaaaatattgccacaactatggcacccagctaccaagttaattaaactcgtctaaccttacacatggtaaactgtggtcggcaaccaaacaccctctactacttatccaatcaaccactttccctttaatttcttcccatcctacctcaagcattcacacatctctaaccttccctcatttatcgagggacaccaaattcttttcttcttaatcctaatttccactaaacaatttagaaatgtttatagttttggaatggggggtgcaaatgttaacaaatagcattgccccctgcgccttgaaactccaaaacaattacatgtacatatcaagaaaaaaatatctaaagttgataaacacttaggaagaagcaagaactaactattttttctttagaaattaagaaaaataaattaagttgaaaaggacccaaatctaggaggtgtggtgtaacatccacccctcccatacaactactcaccaatgaagctaagatgaacccttaaaaaattttaaaggcgacgcattcatcgagagcgaggcgtttgtggttacttcatcaattttaagattcgtcgataaccctgtctctcagaggtgctaatgcgaatagggagtacatgcgtacgtgtatgcgattgcactaaatttcgaaaaaataatcaaacccaacttgccaagttcatagactggcagataaatgcatgtgcatggggtgaatattcccattcttaatgttgtgtgctgaaatgatgtatgttttcttcattattaaaacatattatttgctccacactttgaaaaacatgttttcttaaaaaaaatattttataaaatatttttaaaaacatattttataatttatttaaatcacttatttaagctatttgttaaatttgtttcttaaaatatttaatttacttttataatcaaatcgataatctgttgtaataatctattatcattctaaatgagagtatgtcgatgtcctagttgtcatagtcttaagaaagaatggacatgcgctaccaaaatctaaatttttggaccaggcagttaggttttaattatgggtgcatatggacagattctccggaagattagctgttggaatcaaaactcagtagtaggaccaacgagccattggaaaagtctccaggagatacagtcttttgtttctctggtggatgctcggatggcttgaagttggatcttctgtcccacagcttcttggagtgtagaaaaaaaaagttattgcttttagaaacaaagccattatggtggaaaaaggtgtagtaatagtcctccccagtccccaccagctcatccctgtaaaattagtgtgatgcccatcttcttcagtgaacacaaaggctatggccaaattttccaaagaacaaggtattgatttgcagttctgtgtagagtttaaatctatagatttaacaacaaagttatcataaaactataaatttaaaactaagtattataagactacagatttagtattgaagttatcaaaaaatagattatagagtttaaatccctaacactagagttataaatattatagttttgtgattaaattggtgctaaccatacatgtagttttcgatttcttttttactaaatgtgtagttttgtgatatttgactctaaaactatagttttgtgataactttagtgctaaatctaaaatttgtgatacaatgtcttaaatctgtaatttatcgatagatagatcaaaatatctgtagttttgtaaaatttactcaaactataaatactccttcacaaggaaaaaaaaggaaagaaaccacatacacgcaaaattaaaaaagatctcatgatcgcacatcatccctaacaaaaaaaaatcacagattcactttgttttaaaatgtaataatttttagagtatggcaatgtataaagaataggggtaaaaatatatgttctccttcttagaatggaatgggtaatgtgtaggtccaattatagtaaagccaaggtagggttagtttagcgtcaaaagttaccttttatatatcgaatacgtatcctaaacacacaaggcttcatatgtacacactatgcacaccaactaataaatatcactaaaaaattctaaaaaaaatcgtacatacactttcaatagttatacatctacgtaaatcttattttcaaatttaaccttcgtgaagtgaaaaaaggacaaatttctaacagatttatattcttaaaattgttagatttttttttgttatgtctaaaatataaagaatttgaggttaagattttagacgtaggtgtaatactattgaaggtatatatttttcttttagatttttatggcatttgtttattggtatgcacgcagcatgcatatgaagcctgtgtgtattagatatgtttccttatatatcttgggttgccatatatgagacaaaatttaaactctaaaactttccacgtttttggaaggagggagtactgaatgctacgaatgtttatgttgttccaatgcacaagacggctatagtgcacaaggcatttttcattgtcatcttggaataagaatatatttgatgccgtgcaattctagagggttactttcccaagtaggttcatatgctcaatgcctaactgtacctagagtaccggacaataagacaatttctcattgtagcatcaaattagttagaagacgtatatccgcaaattatataaaagtaagacgacgagtcatccaaaagaaatatgacaaagacatctcgtagggagctaaacgttgacaattctcttcaccattaattgtgctactattaagggcacccacaatagttatttataggttctctacaagagatccatataagcatatttttctacttggaagaaattaaatgaagagagagagcaaagctatctactaacctggagatagtctatagagaaaaacgaggcaattgattagagagctatagatacccatgtagacataccattgaagtggtttactattaatctagtctattgttgagatgtacatcttttatagatagcaccttactttaccattgcgggtgctcttaatctcactatccccgtaaacacatttttcccatgtattaattgatcctttaaaacatgggaatttaattggagttatttcagttcccgcaagattcctccgttgtaaaggaggtataattctcgcctatgtcgatgtacgatagaacaagaggttcttatttttgcttaattaatagtgacaagcacaaattatcaaaacaaattccatgctcgagatcaacccattagggattttccgaggaagaagaaattaacaaaacactaagaaaacagaaaaggagaaaaaggtcgcagccgatgaccgtgcaacagggtttaccggtttacctttccgatggacggcaggataacgaccctcgccgatacaacgatttatatcgaattttgacaaatttcgatcgaaaaggtgaatcctaccgtgcagtgacaatgcagagagagggatagctgatcatctgattcgcccttacaccttttccacgagaggaaatgagacgagaatgagatcagtagaggtgtactgctacaccaatggcaggagctatatataggtaaaaaaagataaaagaagatagtagctaccagcggcggcagcatgactaatttggtaattacacggctcgattcgtctgggaatcttacccaagttagcccacacaccccaagaagtaggaagagaggaggaggagagggtgtgatccaaaagcagcagtggcagcagccaccactttgcacaaaagaagcaaagtaaatggatggccatcgccgttgaggaagggttggtggccatctagagagagagagagaaactagagagagagaggggtgagcagctgagctctgcatctatatacagcactgcatctctctctatttctctctctatatatatctctatctacagtggattttctctctcctctctctctcttgccgttgctgttcgatactgttgttgtcctctcgtggccattattagatggcctcctgctgctgaaatgtgagtgagagctttgctttgcttgcttgctggctggctggctggctagctgggggttggcttcccctcatcctcgtgcatcatccactgtgctcggctcagctgtctgccctgttcttgctttggtttgtactaaatcctcttccgtagtaatactactctaggacatagcatacatgtaacatggatatggatacatctcgccgtccttcccttcttttcatgctgatcttggtgtgtcctttcttcttcctcttcttcttcttcttggttcctttgatttttggttcagaacaattaatcaagcatttattttgcttaaaaatgtgtttctctctctctctcttcttggctttctgcgagcatctgttgctcttttttttctttgagattatttcatcggtttaccctgccaagtggagtatacatgttcttccatctgttcagttcttgttcttccctccccttctgattcggctcctgggaattttctttatccctgcgaatttttttaaccgtctgcttgcgcatcatcacaaggctctaaattaatccgcttttgtttaatcgtttggtcttaaggtggttggacggttagcatcttcctcctcaagctgagatccttcttgacgccattggaggggtcgctgtcgcctgcgtccttgagcctccctgcttttctttttctctctctctctcctcggcgagggagacgacgacgacggtggcggcggcgatgctgagcttcaagcagagccacgaggggttcggccatgtcgccgccgctggagctggaccgcagcagcagcagcagccgtggtgggcggggtcgcagctgctgtacggggaggcgtcgccggaggaggcggcgctgcgcgacggcggccagttccaggtcgtgcccggaggccgcgccgcgctggatccggcggcgccggagccggagaagacggcggtgccggcgatgcccaagagaggaggaggaggaggggctcctgaggtgctgaaattctcggtgttttcaggtgaggttctttgcttcttttttttttcatctttgtcagataataataataagtttatgtgaattttgttttcttctttgcataagtaaatcaaaaaggtgattaattgaaatgaagaattttggcatgcatgtatagctgggttggatctgtaaacacaagggaattattggattatctcctattttctctagcttgcaaatctgaaatctcaaagaattttcaaggcatcatttcacagtctgattgattgttaccctttttttaccaagagaaatctccagctttttatagaaaggagtaatagcaagttctctgatggagtgatggttagtgagcagtttgctattgcttgattgctacacatatttttgaaagaattgaggtttcttctgcaattgatttgtgagaaaatcttgcatgaactagatggatttgcatatgaatgttgcatgaactaaagagggtaataactttgattcccagatgtttttgggtccaaacactgtttggtggtccctttagttacatggacaacactgtttgtcatgcttcacatgtaggcgcattcactgacatttgatttgatgtttcctgttgcaaggcttgccggtggtggtgggcattctttgttttttttaaaaaaaaaaatcgcttataaacctataggatcaaaaaggaacaaataattgaatcaactaagctcccaacccttgaataagtcaagaaaatgggggaatcaggattgaggtatgtaatgtatttgaaggccatggcactgtaacaattggtcaatctaatattttgcaatcttgtttgattagttctatgactgttgcaattttttgtcatctaaaaaaagaacaagacattgcattgttcggtatttttttatgtttttgaggggagcaattgtttcgcctcgtcgtttcgcccattggaaaaaaaacacaagaacaaggtcttattgtggggacatcttccaccaaacactacccaagaataccacatgaggaaataacatgtccttgacaaaaatatagcaaataatatatgacaggggacatacggcacatacttgcgggtttagaagccaacgattctccagttttgaaccttgaatagctttttagctcatatgaccttataaaatagagtaggccaagacattatagccttctcttcagattccatgagtggcactcacgtctctccaaacattatgcatttctataatttaaagcttacatcacctgtcctagaataatttagttgagataaggaagcatcagccgtttggtgtcctataaaatgctctgatgctctaaagtgagactatatacacttaattactttcagttggataattcagaacattgcctagatttgttgcgtgttgttgatctgcatcttttagaatgtggcaagcttctaaaaggaaaaaatacaatgcatgaatgccccttttgaaggttgagagaatatatattgaacttgaaaaataaaagacagaaatggtgacattctaaaacctgttagatgttgtcatggagcactgaaaattaatcatggtaagaagaatcagctaccaaatctttctcatccaagctggccaatgtttccactctagttatgcatataaggattcatagagaagtttttgtttatgaactatggtaggacaacttggtgttgttatactaagaaactatggggttcaggtaatttggagccgggagatacaggagagaagaacagagagcactctgccactattgcaatgcaatcgccgttgccagaatacaacggccatttcgagcttggtcttggtcaatccatggtaaacctttcttctaaacttttcagataggtggaaaagaaagataaactgctatcatgttcactgttcagttggaaattattcagattgtactactaaaaatttatttctgaatagtaccatcagtgtgtttgcttgctaattggtaacatactaacatgtgtttcaggtctctcccaattatccttgtattgaccaatgctatggtcttatgaccacctacgcgatgaaatcaatggtatgggttgctttgtcctatactaaataatattttctatgtttcatataataagatttttttgttttaaagtcaaaattcttttaagtttaaccaaatttataaaagaaaaacataccaatatttttaacacgagacaaacatagtatcaatatatattcaatgttagatttaataaaaactaacttggtattgtaattgtagatgaggtcagacttaaaagcagtttgatttagaaaagaaaaggtcaacatgcattgtaatataaaacagagggaatagcatttcaaatgcgatattagactgatccactgaatcacaattgtacgaagtatactgagaaaaattttgtgatacatgatgtttctctgacatcctgcatttgggggtgtttgcagagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaaggtcagaaccccagcctccttctagtagtccccatttgccaatgtaattttatgaataaaatagcttgatcaaatggcttgtgaaaaatgttttagcaaatacacttttagttacagatttttgtatgtttgccatctaaaaaaaattacagctttttacgagtatatggtaacgaaatttggtggtgaagacaaaagtttttttcttttaatttactccctcgaataattgacactggaagctttgaccgcttgtatttttcttcttgaaaatatgtagagtgtaatgttaaaaatatagtcatacaaccttcattcatcacaatattatgctgtaaaagaaatttatggtaagttactttatccagtttcataattcttaacattttagataagaataagatcaaaatttcataacttttactatcaatatttagtttaaaggcactagaacaatatatataaatttatcttacaaagtattataataaaagtaaaaatatatttgtttattgtatatattataatataaaaacatagttaaaaatatactttggagaacatgtcatttactaaaacgtaagaatgatgtaaccggagggagtattcgagaacgaagtgagtaatataatttgagtatgatgtaaatgttccttttgttgagtttgttctcaaatctcagcgcatatactgctgctcgttgatggtgcagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaacagctgtgagtgaaactatgtgcttgcttgcttgcttgttgttggagtgattaagctggagttttgtctggtttgggtgtgtgagaccagtgagatactgtgactgtcgatatcaatgttgatgaatgatttatgaccttgtttatgctatggtaatagtgagctagtagagtgtatatgatttggtgacatggtattcgctatgaaagttttaggaagtgaaaggctcaaattaacatttgagctattcttgggagtaggtctaaaattttagctgaaacttcagttaaaatgctagatcctataaaaaaaatgagtattttttattaaacccacatattaggtctaagttacacaaaccacaattattttagcatgtaacacataaagctaagtattatacttctaaagtttcccaaaatcacacaattaaccattttgacatgtacctatatcaaaataaacaaagcacatttaacatttatatggtggataaaatgttcataaacgtgcgattgtataagttaaaagtatggcagattaaagtcaagatgattaataacatgcttttgtgaaacgctcggatcataatgcttgaggttacggcccacgtaccaaagttcctatggtgtgaaagttgaatatagttttatgaaatttactaagaaaaaaatcacatactcttttgctggcttgctgcctcccaaatgtgcatcctatcttactataaagttacccccactaaatccttaagcttaacatacaaagataccacatcatcatccactaacaatcatcacatttaaacatcatgcaaacatgctatatctttatagtttttataatttaagagcttttcaaatacaaacatgttaaattatcatccaacataattcacataatgtttaaatgtatatttattatgttttatgatatcctatatacttatatagtttatccttacttagttagtgcttaaatgattaatctatggtccaaattatctttttccttttttcctctaattaagtcatatcacatcaattatttttagcctttagatgattaatctacggtccaaattatctccctacttttcttcttccaaaaagtcatactaccttactttttacgtttgaatcaccattctacatactatttaaatttaaattatcataaaccatattaatttacttaatctgatattatctagctatcttacacgttattttttttattattatcatactaaattcccgcaacaatgcgcggggtttcacctagttacatatagatgttcgatacttttcaagacaacaaaaactagaaaaaaaaggcaatacatgccatgacattaacttgtataaagaattttacatcgcaaaacacatggaacatcttgagaattcaaaattgttttatgcaatgataaacctatgtttgaaagtacttgtacgattcatttgtttaattttgaccgtaaataatttttatatggttaaactacgatgacaagtttcatgtttatatttaggatgctacacactttgataatacacagtattctaaaagtgaggatcagcttggctacttcctcaattttcatttgcacacatttcaaactactaattgtttcgtacagaaactttttatagtagttgctccgcaaaataaaataaatttatgtttcaaatttttaaatataatttctaaatggttaaactaggatgaaaaaaaagacttgatgtttatgtttgggatgctacacacgttgataatacaatatttttaagtatatacaaatttcttatgggaaaaatgaaaatggtaaagtttgcagatgaaaacttgtggaatttttttcatttttaaatttatcttttttaacatttacagatatattatatcagcagaaagagtacaaaaatagaccctgccgccctccatttggg

SEQ ID NO: 30823 - DNA, 24448 bp, Oryza sativa
  unsure (1)..(24448): unsure at all n locations
aatattaaaaaaataaatttaaaaattcaaaactcgtgtccatagaagttgggctgggccgtaggccaactcggcccacaaaaaccaccgcctcgtctcgtcgcctcgcctccgcttcgttcgccacccttccttcgattcgcgccgccgagagttctgtgtctctctcttcttctccttccctacttcgccgccacgccgtgcaggtggagatgggaggcggcggcggcggcggcgggaggaaggaccgcggcgaggggctcggccgcgcgctgacccggcagcggaacaaggccgcggcggcggccaaggagaggggccacgcgctcgccctcgcccgccgcgcgcgccagccgctcgagtccgtcatcgaggtcagcgacatcgacgccgtgctccagcgcgccgcagaggaatacctcctcctcggtggtggtggcggcgacggtgccggcgacgtcgccctctccgcctcgctcggctccgggcttatcgatctgtaacatcttaaacgaactttttttgttgggtatcctaagtgttcgacgaaatgtctctgaagcgggttgctcattcgggcgcgggcgcgggcgctcctttgcgatgcagggatgggacggtggagacggaggaggagaggcggtggctgcgggaggagcaggaggcccttcacgcgggcagcctcaaggtgccccgccggtgggtgctcaacagcgcttctctttcttctcgtcttctaaattttgggtcagtgatgtataggtggatgtgatgttctcgatttcagaccgccatggactccccagatgacggtggaggagctcgacgccaacgagaagcgggccttcctggagtggcggaggaacctcgcaaggttggtcaggtttcattggttattatgctgattcttgtatgtcttccaatgtttgttgtgtttatgtgccaaaaaaaataatatttggacagctacttatgcttggttatgaaaatttgggatggattcctttctacttctttaatttagatattacactggcaacaagtgaaatgttggcctgtatctaattgtgtacaatatatcctttttccttcttggactaagaaaagttgaaactcgtatcttgaatgtgtgcgcagtgagcttctggtgcatcaaagtcaagcatgatgttgcctatcgttctgtttatttttatataccaaaagattctttttttctcctgcagattggaagagaacgaaaaacttgtccttaccccttttgagaagaacattgatatctggagacagctctggagagtacttgaacgcagtgatctggtgagtgcgtatgcatgagaagactatgttacagttcaaatatggacacgttactactttaccacatttcatcatatatcttttttcaacattaaaacttgttccctattcaattgtggcctatttgaaatttctgagttgcttagcagctaacagcataacaaatgtatcctgtagttatattatagtctgttttattcattatcctagtagcttttaattttctgtccaactgtatgttgcttatctttgaatgagctgacagttctggaaattatgtggaagtgcttgacttctgttttccttctttcttgaagctggtcatggtagttgatgctcgagatcccttgttctaccgctgccctgatcttgaggtacttattcccaagattccagtatttttcttttgactactctttttgggtttaagataaacttttagatgattggtaatttacatatccagcctcttgcaagttgcaactactgattataaccttattacattctatggttatctggaagcattagctgaatgcccatttaccatgaaaatttcaggcacttgaatattaaaaccacgatattggatatacagcatattcagtagtcccacatctcgttgcattcattcctagacacgttagtgtttaagattttaagttgctcaggcactggcaaatcacaaaggcacaacctgacgggcgcgatgatacaactgtaaattcagtttaccttcatatcgcagatgttgtcctgtttgatttctttgttttattgtctgccaacagcataatgcttaaatacttccttgcgtgtgtttctgtgctgatagcatgtggtgctagggttagtgtaattcattagtttctggtgttccctctttgtgataaatatgatttgtaataatagcatagaagagatataactgtgtaagctttcactattgtgtggatctttgcagttttgtgttgtcttctgacatgtctttatgtatgttgtaaggtatacgcacaggaaattgatgagcacaagagaacactgcttcttgtaaacaaggctgatcttttaccactgaatgtcaggttagtaacaccacacaagcgcatttttcaatattctaaatgcctttagtgtctgcgatgatccatacagtaatttctcattgaaaaaaaaattgcagacagagatgggcagaatactttaagcaacacgatatcctttatctgttctggtctgccaaagctgctactgctgatttagagggaaagaagttgagcagctattccatggaaaactggaatacagcagatcttgacaccaagatatatggccgggatgaactcttggtgagattgcagggtgaagctgagtatattgtgaaccaaaagggagcattaagagctgaagagggtcatgaatctagtcgttcagattctgtctcaacacgacccaagcatgtggttgttggatttgtaggctatccaaatgttgggaagagttcaaccatcaatgctttggtaggccagaagagaactggtgtaacctctacacctggcaagaccaagcattttcagacattggtaatctcagaagaactcattctctgtgattgtccaggtctggtcttcccttccttttcaagctcaaggcatgagatggtagcctgtggtgtcttgccaattgataggatgacaaagcataggggcgctattcaagtggtggcaaatcgtgtgccaagaaatgttctagaacagatttataaaatcaccctgccaaagcccaaggcatatgaacaactgtcccgaccaccaactgccgctgagttgctgcgggcgtactgcacatctcgagggcatgtcagtcatgctgggctgcctgatgagactagggctgctagacagattctgaaggattacttagatggaaagatcccacactttgagcttccccctggtgatacagattctgaaactgacccagaggaaaccactgaccttgaaggctcagatactgcagtaggtgccacagcagatcattgtgcttctgatgaacaagatgaggaaatcagtcaagctgatccaaacattagtcatgtactaagtgaccttgaatctttcgacctggccagtgaagtgtccaagaactctacaaagaagaagaaagaggcatcctataagcatcacaagaaaccccagaggaagaaggatcgttcatggagggttggaaatgatggcgctgatggatctgctgttgttcgggtgttccagaaacctgccgtcaattttgctaccgttacaggttaatgtttttttgcggcactctgtgcgacttcattctcttttttagcttacggtaattgaagatgtcgttgaaagtcaaactacattttatccattttgtttcatcttctgctgtttgttatggccatctgtaattctgtattggaaatttggaatggtacgcaatgtggctatttttcgatgctagctttcatagcatttgactgaaaggatgaaaccttatgaatgttctattaggttatgaactgagaggtttgttacgatcagttgcaatgagaggatttctctcaaaaaaaaaaagaatgagaggaagataatttcgtacaacaatatagaggaagatatttatacgacaatattatttcctttgttaaaagtgttcgatacacaacgtggtctgttgaattaacgcagatcatttttccagtttgcagacacatgaaggcagtggctaaaacgaacagcggggattgcctgcagtactgaggtttgaagcatgaaagcaaatccattaaggagaaaaaatatggcaaatcacattaaccgcaccaaattttacttaatagaaggtttgaagtatgggtttgggtccataaaaagaactccgatgccactgatctgaaagttttgaaggagcaacgtttagcaattagcattgcaacaagaatgttatgcacttgaaacttacgcaatccatatatccaattcactgccctgctgaaattcatataaaacgcggataatttgctagagagtagtagcgaatcaaatatcactatcagttatcacaagacacaagttagcaaagtaacaatcagatggagcgcaatcgcttgtcaattaaacagaaactgcattgcaatgtacgcaacatcagcacaggagctcaagcatattgacacatggatggagagcaaatatataggatgatctattgaaaaagctattaataatccatgtcagttaatctaatcaagaaaaagctattaataatccatgtcagttaatctaatcaaaacatcacattattagagcatgagatctccgtataattcagaactcgtgtatagtttccacccaaaaatgaatttgacattttcttggagagatccatccccctctccatccgtctcatggatcaaagtttaactaattaatccttgaaaaaaaaagagaaaagaattcacaatctgaaacgcctcagatcgatccctcaaaaaaaatttcttctcaagatccccaccgttttgaccaatcaggccgcgacatcttgcttctccgggaccaccgcttcctcctccgcctgcttcttctcgccggcagcttcttcctccgttggcggcggctgctgctgctgcgaggaggaggcggcggcgtcggaggaggcctcggcggcctggtctgccttggcggcctcgaggtcggcggccatggcgcgctcggcgctgaggatggggtggtagtactcggcgtgggcctccatgcacttgtggagcgcggcggtgacctcgtagcagcgctcgacgacgtcgtcgccggccttctccgcgtcctccacgcacttctcccacccgacaaactcctccctgcacccgccgcccttcatgaagaggcagaacccgcactccccttcctcctccccctccgcatccccctccccggcggcggcgtccaggatcaccgtctccccctcctccgccgccaccgccgcccccgcgtcgctgacgggcgccgccgcatccgccgtggtgttctggggctcttccttggccggtggatcggcggcgggttccgcgggttggggaggaggaggaggagctgaggaggaggcggcggcggttgccatggcgggttagggtttttggggggtgcggagagatcggagtttcggcgacgagacgagatgcttaaaccctttgacgaatcaggacggtgttagtggttggtcctacgaggactattagtagacttggcaggaagtgtctaggcccaacacgacgcggcgcgtccgggcccgatttggtttcggcggtggtcagaaggctcggtttcgcggccggacgggggactcgactcgaatccggatctcgaggttccgtttaggcaccgataacggctacgaaattgaaaaacaaaaaagttacacgatagacgaacatgcaccactgcacatacaatatcacactcacatttccgcgaattcatcctatagcacatgctctaagaaataaaaaccagcggtacatccctgatcccactgaagtcatattaaaaatttatctatatgtatgtaatattcgtgggcaccagtatttaaactctagtaggtgttgaattattgagcgctgccctagtattaatcattttaaatttgagaaatagaataatatattttttaaaagcaactttcctatagtctttttttagaaaacgcatcgtttagtattttaaaaaacatacgtatttttctatttattgttgatattgtaaaccctagtcctgacgcaatatagcctgctataggcttcggtatggttttttttcccatgaacgagtacatccctacgaacagacagcctgtgaaattttgttgcgtgtgttgagtgctatattgtcattctagctgattccagttcgttacaacaactcatattttgcggcctggagcaaagcacagatcgaattaacaggtcaagccgtattttagagatttccaagtggtctcttaatgtattcagcatggctgaatattgcttgattggccatgttgacaaattcgtgatttcctggtcagacaccacttttttgcttcatgcaggtcagctaccaccacttcctcagcccacggctttcagagtatgaagaacacttgcagccgcctgccaacaacaaaccataagaacagtcgttaatttcattgtttattttattttacagctaggtaacgggttaatttcatgcatggtataaaagcaagtataatagtagactataagccgactaaatgctgaggtggagaagaaaagagagaggagaagcggactgtaaacttacagccagcttagacacaagaaccaataaaccctgtgagagatacaagtgtgttctatattaattataaagagctaactattttatagacaggctgaaagaaaactataaataaccttatagctaacaagtcggttgtattattagcctcgctctaaaaagggttaaagtacacgtgtttcatgagtttattccaggaatactaattaagaaatgagtatgcactaaaaggagtccccggtagaaaaataatgacatttatagattattgaaaagagagcatatatacgatgatgcgatgtattattttcataaccaccgtaatgaactacaagtactattacgctaattattctttttaagaaaacagtacaaacttgtacacgctcacaatacatacaccctcacctataattacacatttaatatttcacctaaaacaaaaacaaacaagttactattagttttgaggttgctgttgggcataccgcatatgcagacgtagtagtattagtatctccgttacaatgcatttgcttgggataaaggtggtagtgaatagtaatggattgttcggtaaggctccagtttcaggctctagctctaacaattttttttttggctgaagtctaaccaaataatcacaactcttactcctattagaaaagagtggagtgagttaaagtgctttaaaaaataaactaaaacgagtggggtccagtcgctcgcaaactgtattctacacttcatttctaaagttaagattgctaagtagaccctcacaatttgccaaatgaaagctggcggtgtgcggcttgggcccagtggagttgaaataacgcgatgtatatctgaaaaaactgtaagtgccggccttttgtcttatttgtggaaataagacaaacatcatttttacaaatgaaaaataatttacgaaaaaaacttttatatacatgtcttaacagtctaaaagaaagaaagactaaaaaataaactaaaataaaaaaaacctaaaatcaactttaaatttaaagttaaaaatttaaattttgactgataggtttacgtataagcgaagtgaaaagataagatcggcaattaaaacgcatgttggttctcggggtagggaatggaaagtgatgcacggtttaagccacgtcgttctcacaacattctgcagggtagcgtgaggcctccttgcctcccgtctctcgctctgctctgtagtagtagtaggactgtaggagtactagtgattgctcagcgcgtcagccagtgatcgaagatgtaccccggttcactccgagatgcacgaggggagggagaaacccccacgtcagtcctgtgcttgccattcctgattccattcttttggctatgtttagatctaaggtgtaaagtttgatatcacatcggatacatgaaaaccgtaagacgaatttattaagcataattaatctgtcattagcaaatgtttactgtaacatcatattatcaaatcatggcgcaattagtcttaaaagatttatctcgcaatttacacgtaatctacatattttctatttatatttaatactccatacatatgactaaacattcgatgtgatagggtgtaaaattttaccagaggatctaaccgggaccaaatttgtcaacgccgatacgagaagaaagagcacggaaatagtatttcaactccaatatgcgatgtggtttgaccttgtcaacgtccgacactgaccaggtcggggatctttctgtttgggacacgacgggcgcggcctggtccagcacactgcagcaaagaggatggttggattggaattggatccatctcacgcggcagctttgctttatctgtggctgccaacatcagcagcatgagccgccgccggctccgttggttcaggggacggagacgggcgaggccaccgaggctgtgacgcacatgggaaacataactctgccttcccctttcctttgttttttcttctttcttttgggctttccaggcgtggcgtttttgcgtgtgcgtcctctacgtctctcgatttcacgttcacgtcgctcctgttactactagtagcagtattatgtagagagagctgtttgttatctgtccaaagacgatggtgcacgagagcctgggataaccacttctactggaaaggaacccctaaaaggtgagtgagagtatctatcgatcgctcattcgctcgtacggcgaggtgctgggtgctggtccactctactcgtctttgctgttgtttatccaaagtgatcttgtttgagctgtcacggctaattcaaagctttctaacatagctgagatgaaatctgaatttatgacggattattccacacatagatgatagatttcaaatcatttttaggctacggccgtgtttagaccgtgtttagttccccctattcccaactttccatcaaatcacatcacatcaaaaacttttctacacataaactttcaacttttttccaaactctcaactttcttcaaacttccaacttttttcagaaactaaatacacccttagttcacccccaactaccccaaacttccaactttccatcacatctaaaatttttctacacacatactgtatgtttagttcctgaaaaaagttggaagtttgggaaaggttggaagtttagaaaaaaagttagaagtttatgtgtgtaggaaagttttggatgtgatgtgatggccctgtttggatccaagggttagagttagtttgagctagttggggctcaaatagccctaaaggatccaaacatgaggggttagattggggctagtcgcatctaacccacaaaaaaactagcccctccaagagatgcttattggagctagtttgagtggggcccactgtagaagccacttttctctctctctctctccccgcatcggatccccatctcctcccaatcccgcacggtcgccgtactgtagagcaattttttcctccgctggtcgtcgcctcctccccgatccacgccgccaccaccactgatccgcgcctccgctgccgatccgcgcggcgcggcctccccaactacctgcaccgcggcctccgtccaaccgcgccgccgcctccaccgttccgctccgccggccaacctcagcgccaccgccagccccgagccgcaccgcctccgtccaaccacgccgccgcctccaccgttccgcgcagccagccaacctcagcgccgccgccagccccgagccgcgcctcctccgtccaaccgcgccgccgcctccaccgatctgcgccgtcgggcaacttcagcgccgccgccacccccgagccgcacctcctccgtccaaccgcgccgccgcctccaccgatctgcgccactgagcaacctcagcgccgccgccacccccaagccgcgcctcctccgaccatccgcgtcgccgcctccaccgatctgcgccgccggccacgcatggacggtgacggcttcgacgacctcaacgtgtgggctacgcagctgtcggcgagcggccccgccaccgctccctctgccggcgctggcttcgacctcaactcacaagcgccggcagcggaggggttcccggggcttgggatgtacggagccttcctccagggcgacaacgacgagctcctcactagccgtggcaggggctccagcctccctccctatcgccaccgcgtgtcggagccagagagggaagggcaactctaaatctgtcaaggcgactgaacttgggcggctcctccacggcaggcactggtcacggaggaggaaatggtggcgccttcccaggcgggctgtcttcggggagaggcgggcgcgttcgacagcgctcatgttcggtcgccgcggcacctggccgccagagccagcgcagcaacacggcggtacgtgccggcggcagcggccagcgcctaccgcgtccccgggcaccgagggcagcaaggagtgccgtccgtgggcaagcatccggctccggcgctcccttcaacaatgaagatgaagaattggaggatgatgtggaggagtttgcgagcttcggcggacccccggtgagccaagctagtcgagcccaatggaatgaagttaataatgcttgcttgttagatttgtgcattgagcggcgtagagtaggcacgtataatggtgcacaaatgagtggtgaagggtaccaagccatcgtcgacggcttacttgatagaagggggttggtgtatacccattgccaggtgaagaaccaaatactcgtactgaaaaccacccactctttctggcgatacttgcaagcgcacatagggttggggaggttaccagatggaaccattgatgttgagtcttcgttctggaaaatacatacagaggtataagcagccaatctgtgtattctatttttcagtttcctagtttcaaattgtccaatgaactgatctctcataggactgacttactgttgtagttactaactttcagctattaagtaggcaaaaatttgacagtacgctgtataaactatactcttcctttatgatagtacagtactctgtaattcaggttatatgagcatgtaatttagttttctgtgcactagtatagtacatatatgctcatccattttatttatcgctgcagaagaaaccatacctaaagaggctgcaatgggatcctccggaaaacgaggagttgcttgatcaactattcagagggtacactgtggatggaagcacagcctttgtgcctggagatgattatggtcaggactaggggcaagaggatgaggaggagtttcaaccaacacctattagtacaagcagccagaggagccaaaagggcaagatgccattaagtagcacttcaagcactttgtccagtccagtgaagaagagcaagagcccaatgcttaagattgtgaaggacatagccagtaccttcaaagaggctgtcatagtcaacactaagcaaatgcagaaacgggcaagtgacaaggctgcattttcagtcaagaggtgtcaggagctggcatttgagtgtggtgtagagcaaaccattgaatctgtctctgctatgtccaagatgttcgaaacagagtatcaaagggagttcttctgtggccaattaactcctgaccttaggttgggttacttcaagaaatggtgcaaggacaacaatttggagtagtagatgtcttgctctcatatgtctgtagaactatttatttgtgtgttgaacctatcatctctgagtcagaagttgaactatttatctgtgtgtcgagactattatctgtgcgatgagactattatttgtgtattgaaactattatctatgtgtgttgaacctattatctatatattattttcgaatgtngaccnaattgtacatgtgttgaagcacgaagaagatcatggccctatggttgaggaagcagaagatgatggaggcagcacaagtgaggatgagattgtatcgatgtgccgcaacaatctagtgcatgcagagaatttgatcgtgcaattgggtgctatcttgggtatgtactctgataactactttgtgaaactacctaagagggtcaatggagattctggtatggattgggtcatggatacactagcccgagatgcccaatgctacaacatgtttagggtagagagagctttatttaacaggctacataatactttggtccagtcttatgggttgaagtccactacaaaaatgacatctatagaggctcttgctatgtttttaatggattgttggttcaccacagtcagttagacaggctgataactgtttaaggaggtctttggatacagtaagcaggacatttaacagagttttgacatgcctccttaggttagctcatgacataattgtacccaaggacccaaccttttcagaggtgcacccaaacttggaaaatccagcattttggccacacttcaacgactgcataggagctatagatgggacacatgtgaatgttgtggtgcctaagagtaagagggttccgtacttgaacaggcacaatgaaaccagtcagaatgtgcttgctgtttgtgatttcgacatgagatttacctttgtgttgtcgggatggcctggttcggcacatgacatgagagttttcaaaaatgctgtgagtacttatcatcacaaatttccgcatccaccaccaggtttgttacttgaactatcttgcaacaatccttatccaattgcacttgttcatctaagtctcattgcgtgcctcactttcacaatatgtagggaagtattatgtggttgatgcggggtacccaaaccggccgggctacctttcaccatacacacgtataaggtaccatgtcgcgcaatggaacgatggaccgccgccacaaggtatgaaagaaaccttcaaccatgcacatgccaaagttaggaatgtcatagagcgatcttttggagtgttgaagatgaaatttaggatcttgttgaacatgccaagttttcctgaagcaaagcaaactagaattattgttgcttgtatggctcttcataatttcattcgagagatagggaatttgatgcctgtgatgaggatgaaaattataacccaatgcctagttctgttgcatccgaatggccagcagatgaacctcttgttgaagatgcccacatgaatgccttccgtgatgaattagctcaagctttattttatggagtgtaattttttcttgtctagcttcatttgtatggactaaactacctatcgcgtatgttgagtgagatatctcatttgtacggacaaataaaatttttcgtgtttcggatgcttggtttgaaatatgatttgtttgtgtcatttgtgagaggaaggaagccacacatgagtcttccacaccaaatccggttggaaaggagccaaatgattggaaaagtatatttattgtcaatctaacccttccatccaaacacctctagggctagagttagttcagggttagttgagagctagaaactaactctaacctctaactctaacccttctatccaaacagggccgatgtgatggaaagttggaagtttggggtagttgggggtgaactaaacacagccataaacttccaactttttttccaaacttccaactttcccaaacttccaacttttttcaggaactaaacatagcatacattcttttcagaggtccgggctagctaattccttggattattgtgagtaattcttcaaaccaccaaatggtgtgtttttttttaaaaataatgcttttttaaaataactttcttaaaagtaaaatatcacaagtttcaattgtccagtatttagagtcaaatttatctttctctaatagtttatcttgttttatgtgtggatgataagctcgactgactctccgaatcaatcaccgccttagaatactttgaagtttgctcgtgataattcatttcctaagatactggataaaaaaaatttggacctctacatctagcacagatgtacatagtcatcctcgtgataattcataagctataaagtatatataaaagaacatgaccttaattttagaattaactaagtgtttttttctttgtggttttacttacagtcttgtcttttgggcattaggacacatggaatataaaaagagcacaaaaaaattgtttatgtgatgaaaaccaattttttttatataaaatccttatttgtccataaaagttgacatgatcccttatttacccctcattttcttaatgacttgtgggttcaggatttgcttgtagtttctttttaggatttgtagttttttccttattattactccctatgtttttaaatgtacgtcattgtggatttttaatcttgttttcttttcatgcatgtacaagcaaacaaattgttacgttgcaccacacgtctatacagtaacatcgtacttctctttctttatttagttttacgctcgctcttctattttttttatttcatgtattatattcgtgtgttttgcttgtctcgtattgcaaacaccccaaaaacctctctctatgcaaatccaatatatttttgagaagactgaccatccactctacacatgcttactaacttatcaatatgtttctaagtcaattgtcgggctggactatttatgggcttgcaactaagtggtttatggaccgaagcatccaagtatccaccaaatagtctagtggataatccgcattcgtaaagtatcagagattctacatctgtacctcactatccgaattcgatcatatatccaccgaatttctgaaaacatcataccatatcatcgttttggagtggatcatatcagcatttccgtaccttctctcggtaaacaactaaacacagaaagggatcatctaacgtgaacttctcactaaatatagaaatggatcatccgacgtgaactttctaatactaatatatgagcctcaccacttacatgatccaggtatacgtgatcacggatcccatacactaaacacgtatccggatccataataataggcgtttgaacagcaggtggcagcatcggagaggagagtggcatttcgaaacggggaggccacgacggtaaaaccgctgcgagtaaaaaccaaaaaaagccgttcttaattgaatcaccatttcctctcacacacttctctcctcctcctcctgtctgtctcctccaccccacctcacctcgccgtcctcctccctacgttggggtcgccatagccggatttgcgcgttggccccccgacccctcccggaattgccaactcctcctcccccttcttcttctctcctctcttctgtcttcccttcccccgcgccgcgcgcacggcccggccggcctcccgaatccccacgcaattcccaaatctcccggggccaaaagctttgccgccgctccaccaccacccaccacttcctccctcccccctcccctccgccacgatcgcgcccagcccgagccccaaaccacccgacgaatccgcccccgcgggattctctccgccgccgccgccgacgaggaggacgccgacgacgacgaggagggggaggaggctagggttccggcggagaattcgcggccgcgggcggcgcgccgcgtagggggggccacccccgcggcgcagctccggatctcgaggcccccgaactctaggaggggtggggtggggggctcggcgatggacgtggactcccgcatgacgacggagtcggactccgactccgacgccgccgccaccgccgccgcctccgcctcggttgctgcgcaaggaggcttagcgagcgagacctcgtcgtcgtcgtcggcctcggccccgtccacgccagggacgcccacggtagctccggctcctgcggccgcgggagccacggggcccaggccggcgccggggtacacggcggtcagcgctgtgatcgagaagaaggaggacgggccgggctgccgctgcgggcacacgctcacggcggtgccggccgtcggggaggaaggcacgccggggtacatcggcccacgcctcatcctcttcgggggcgccacggcgctcgagggcaactccgccacgccaccctcctcggccggcagtgctgggatccgtacgctttctatctagtatcatatatatgcctaataatttctgcttttttcaaatgtcgattggtcgtgtctcgtggatattaagcgacgctcttgggtgatcatgatggcaacctggagctatttttattcccagtttgcaatttcattttgaaatgaatttggaggcttcaggagttttactgagaaatcatttgctattttgtgggtaattcgggtcggtctatacctcgatggctggaagctcatagctggcttgagcctttaccatcagaggatttaaataggcatagcatcatttcagacaccattttgacttaggaattgcgcttgagctgtttctggaaccgaatatcattggttgaattagtgaagatgggtgctgatggctgattccagatgccatggtcatgggagctgaaatgttcgaactgtttcatatatcagtcgtattgcataattttgaattcttatttttgaacgtatcccctgattcactgggcatgcgctttcatggacctctcatctaaagtttctaactatcttcaatgttatgcttagcaagttggaaggaacatttactgcattctagattttgtgtcatcgtgttgcacattgtatgacagtaggagaaaccttttttttttttgtttttccttttggcaagttaaagtaggtgagcggaacttctaaggcacgactctgatatgaaattgaaggttttcttttttgggagctatattattgctgatgtaatctatttaaagcatatatacaaaactagttgctccattgtgtacaaaattgttttcggttaaaaaaatgttatctggtatacaatgctatttttactctccagttagtcacaaaggtggattattcattgatctctccttggtttataggtcttgccggtgccacagcagatgtccactgttatgatgtgttatcaaataagtggagcaggtaggatattccataaatggtttccaccttcttttgagcatttaatcgttgcgttgctactttggttgactttagcaacttttgttttagagtaacacgattattttgttggtagcataaagcaactcagcaaacttatttaattgcgccaccactttggcaggcttactccacaaggtgagcctccttcaccaagagccgcacatgtagcaactgcagttggaaccatggttgtcatccaggtatttctatattttacctgtggtttctgagatttattacctagtgcttaattagtatcagaaacaattacttcccaagtaacctgttttatgtactctttgattgtttacataaattttatggaggtaacttctaaatatggtttgtttttgtttcatcattcgttgcaatgcagggtggcattggccctgctggtttatctgccgaggatcttcatgttctagaccttacacaacaacgaccgcgatggcacaggtaaactattattctgtactgtgagtgtggagttgcatttcttcagcacatcttctgaggtgctaatgtttctatgtagagtggtggttcaaggacctggtccaggtccacgatatgggcatgtcatggccttggttggacagaggtttttgttgacaattggtggaaatgatggtaagcaattgctcccagatgcacctgtcaaattcaaactagagaacctttgcacttggatctatgctgaaatggtttctataatgggataatttttattctctagggaaacggccgctggcagatgtatgggctctagatactgcagctaagccatacgaatggaggaaacttgaaccagaaggtgaaggaccgccaccatgcatgtaagtttgctagctgaaacacattacagtaatttaattattgaggatggtgacgtaaagtttaatagcaattcctggggaggtatccattatattacattacttaccatgtgttgcatgttacttcattaatttaatatcaaattatccacaatgcaaccagctatttactttcttggttcagaataacatacggtagcacagttaacccaccatatttcccaattagttgtcaggcatgaccctcaggttattttcctttattttttttactggaagtagagctagaactaggtttggcatccttttgctaagtatactgcatggtgttgttgttcaggtatgccactgccagtgcacgctctgatggtcttcttttactttgtggtgggagggatgccaacagtgtggtaagtaaaataatcaacttatataaataaagataataaatagtctagtaaatatttcgctgatcaaaatatgtaaagaactaaaactaatggaattagagacttgaatgtataacacttggctgtcaattttaccatctcagtgattggatgtcatactgttgtaacaaggttctatatagcctgtgatgtgaggactgcaattctctctagattacaccttcaaattttgtatctaaaatattgaaacagcagtgatgtggcaattggtggatttccatgatctgaaaaataagaaagctattactttgttatcagtttcatctcatgtagatcaagagaaaatgaacataattatgcatggcatatgggcatcttgtcatgtaacttacacagacatcagttgccaagtagcaaatattgagtgactggaactacaagtagcaaatatttgttttctataacaaagatgtctagttatccttatattcggcaagtaaaatgatactccccctgtttcacattataagtttatagaaaaatttaacaacatctgcaacacaaaattagtttaattcaagctaacatttaatatattttgataatatatttgttttgtgtcaaaaatattgctaatcttttttttataaacttgttcaaacttaaaaaaagtttgattagggaaaaaaaactcaaaatgacttatagtatgaaacggagtatattttagtcacaccatactagttgtacatcaagctattttcatttgagatgtcaatttgatttaaattactaataattacctgtagaagttcaatatcaataataggatttctctaatgtctttgtatacatgttacttctgtaaacccatcagccgctggcaagtgcatatggtcttgcaaaacacagagatgggcgatgggagtgggcaatcgcccctggtgtttctccatcacccagatatcaacatgcagctgtaagctgttctttcattgttttttcatctaaaaggtgtacccactttggctcttatacaatgcttgattcatctgttgtttaggtttttgtgaatgcacgtctccatgtatcaggaggagctcttggaggtggtcggatggtagaagactcctcaagtgttgcaggttctagttttaatcttgaaataactgacatatttcttaaggtattcatgaaataccttaagaaatatcttgcactgacattaaccagaagaataatcttgagatgaaataatgtagctcttttagtttgctggatgctcagcatataaaatacttagtttttgttggtgtatgtgcaatatttgttatcttaataagatctagattgcagaaaagcactcagatacttgaatagtttagttgctttcagcattggccactcatgcaccataactacacttgctaattatgttaatctatatgactgcatgtgagtattacaaaagcatttcctgtctttagcctttttttactcatcactctgtgatgacattgccagattttcttcctttttttggtagcattgagattctcttgtgttgaggtataggtaattgttggtttcctctagaatgacaatatgcactcctataaatttcttataagttgcacgattctatctggttcagtgctagacacagctgctggagtctggtgcgacacaaagtcagttgtcacaactcccaggataggaagatatagtgcagatgcagcagggggtgatgctgctgttgaacttacacggcggtgcaggcatgcagctgctgctgttggtgatcaaatattcatttatggaggtctacgaggaggtaagaaaacctgtttgtttagtattatgctataggctttgagcctttgctgggccatcaagtcatcattgtacagttcagattcaagttatttgtggtgttatttctgatttgatggggataacttggccccactgccacatgatatgcaacttggatgccacatgatatatattatagttggcatacttttcgtttggatgaaaacttttagtggactggaaattgtcaagtttgacatttgttctcaccgttggattttatgcaccttcaatttgctttctaacatcaaacgactgccattgtaggggtactgctagatgatcttcttgtagctgaagatcttgctgctgctgaaacgacaaccgctgctaatcatgcagcggcaagtgcagcagccactaatgtacaaagcggaagaacacccggaagatatgcttataatgatgagcgagcgagacaaacagctccagaatcagctcaggatggatctgtagttcttggaactccagttgcccctcctgtcaacggtgacatgtacactgatatcagccctgagaatgctgtgcttcagggacagaggttattttcaattttttttccctatgaatatgtcctggtgatattcctatggcaagttactattagttttgtaattgctattttcctaaggtttcaatattaatttctctacaggagattaagcaaaggtgtcgattacttagttgaagcatcagcagcagaggcagaggctattagtgcaactttagctgcagtgaaggctaggcaggttaacggtgagatggagcaattgcctgacaaggagcaatctccagattccgcatcgaccagcaagcattcaagcctcatcaaaccagacagtattctctctaacaacatgacgcctccacctggggttcggttgcatcatagagctgtgagtagtctgtatgcagtttgttacattgtctgcagttcatttgtcagtttttttttatgttataatattgctgtagatacttgtctttctagcgactaaaaacaattgtattatctcttcattttgcatcacatgaggtgatatcctctatttttccttttacctcaggttgtagtggctgcagaaactggaggtgccttaggtggcatggtcaggcagctgtcaattgaccaatttgaaaatgagggaagaagagtcagctatggcacccctgagaatgcaactgctgcaagaaagttgctagatcgacagatgtccattaatagtgttcctaaaaaggtatcatggagaatttggtccattcaactgctttggcactaggatttagtgatgcagaagctgaatgcacaatatagccatgattgagaaaagacttagctagttactacgcgtattctgaactacttaattactttgttctatctgctgcgatacttatccaggtgattgcatctctattgaaacctcgtggttggaagccccctgtgcgaagacagttcttcttggactgcaatgagattgcagatctatgtgatagtgctgagagaatattttcaagtgaaccaagtgttctgcaacttaaagctcctgttaagatatttggtgatttacatggtcaatttggtgacctcatgcgattgtttgatgagtatggtgctccttcaacagcaggagacattgcgtgagttcttgctttgagaaactagtaatcacacactttttaaattttgcttcaattgtgatattttacttgccaaattaacttgaaaagccttgttattaatgtgtttaatgaattatcttaggctatctatacatactccctccgtactcgtaaaggaagtcgtttaggacaatatttaagtcaaaccttgggaatataaatcatgaataactctcaagttgttgagtttgaaaatgtaaaaattatatgaatagatttgtcttgaaaaatattttcataaaagtatacatatatcacttttcaataaatattattatagaagcaataagtcaaagttgtgttttggagaccgtgttgctgtccaaaacgacttcctttacgagtatggagggagtatgtacttttcttttcttttttggttcagaaggtatttccccacctttcttggtcttgtgctgatccataattttgtatgaacctgcagttacattgattatctcttcttgggtgattatgtggatcgtggccagcatagcttagaaacaatgactcttcttcttgcattgaaggtattaagctgcctacttaccttgatgccacatatacttactgtgttgtgacgatttattaaaatcgtaatatataaacaattgtacatttcaggttgagtatcctcagaatgtacatttgattcgtggaaatcatgaagctgcagatattaatgctttgtttggcttccgaatagagtgcatagagcgaatggtaatctattttattctgcatctcacgttacaacaaaaccttttcctcttttgcttatgaggatgttatttgctcaaaaaacagggtgagagagatggtatttggacatggcaccgaatgaatagattatttaactggcttcctttggctgcacttatcgaaaagaaaattatatgtatgcatggtggaattggtcggtcaatcaaccatgttgagcaaattgagaatcttcagagaccaattaccatggaagcaggctctgttgtccttatggatcttctatggtaaaacatttcaacaataattgctatttaaccttccatgagcatttatttatgtgccatgttcagatgttctctttatgatgcttataggtctgatccaaccgagaatgacagtgttgaaggattgagaccaaatgctcgaggccctggccttgttacgtttggggtttgtgttccctaaccctaaccttctgaattcgtcttccctttgttgaccccctttgttctctgaagctaacatttgctgttcatacagcctgatcgtgttatggagttttgcaacaataatgatcttcaactaattgtgcgagcgcatgagtgtgtgatggatggctttgagcgctttgctcaaggtcacctgatcactcttttctctgcaacaaactattgtggtatgaattattctaaaatattcttttttcaaacttttttgctggatttctacgattgcttgacatggtatgctcacaggtactgcaaataatgccggtgctatcttagttttgggcagagatcttgtggtcgttccaaaactgattcatcctttgcccccggcaatcacatcacctgagacctctccggagcatcatattgaggacacatggatgcaggtaatactattttgttgcaaagatattcctgtttgtaaactaactggtactaccaccttcctcgtaacacggtaacatttgaaatgaaattcaggagctgaatgcaaacagaccaccgactccaacaaggggccgcccccaagtagcagctaacgatcgaggttctcttgcctggatatagtagagtggccagatattgattaatctgatctatatatgaagtctcgatcggcgcgatcttgctatttttatttttttctgcacagagtaaagtgatttgtgtttgcgagacagtggcccacagccatgccaaaaggtaaacatttaaagtgagcaaggtagtagataagatggatgaacagatgatcatcctgaacagcgccgtccagtccaagctgtttcccgaacacgacagtaaaacaattcaattcacagagattatctggagatcgacgaggcttcacttcacctgtatatactcggctgctggtggataggcagttgtatgtggtttttgcatccaattggaatggcaaaaaggaatagtgttattgtactagctattctttcctctctttttttttttcctttctttttgggatcttgagttctgattttgcaaggtgcttctgacctgctggagagagaccgatggctggtgttcgtggtccagtcgtgtataatagccttccctcctgcta

SEQ ID NO: 30824 - DNA, 8939 bp, Oryza sativa
ttggtttactagaaggagagagatgtggtgttactcagggtgggtgtacaaaaattcaattatatcttgtttggctccgaattgaattcgattcattcaattggattttgggctatatgttttagtgtgcaagctaatgatattggtttggatatcgtagaagctacactattgattcttatgggctatttgacacgtttcattgaaggcgtacacatgattgctccatttctttgtgaaaaagcgcacgatctgaaacaattactctgaccgttcctttgtttacaaacatgaatatgcgaacagacttaaaatttcttaagcaaggtgttgttattagccacagaaatactttgaaacatgaaacagttagtgtgtactaattgtaccatttaaaactagactctgaacatcgaagtacatccaggcctcagtagaaaaaatgtaattgaggctaattcatgacgcacccgacagaaagctagcagtagttaacactaaattattactattttcttacaagatctctcatcaaacaattttgatatcgtgctggtagagccaatacaggcaatattcgagttgggatctagtatccccaaaagccaaaaaaaaataaaaaagaaacagtacaaacaacaacattttagtcccggtaaaagattgttcagtacagtcccttaatccgtatccctagtatacaagaaacaaaatttctttgcaccacttcgcccatggcgtcaatttggcataatccaagggcacagcacaccagggatatatataactcgaggatgtggcctactgactgctttctgcctcagggggtcagaccgctaagcccaagttagatttaagtattgactatgaacgaagacatagtgcgacaagcgagtgccccatgtaatatttggtctcaacgtttcttctgatccttcccagttttgttatcctgagtgagcatcctgggagcgatggccatcgccataagctcctggaacagaagcttacacgcgtagggtatatgcacctgtcagtaggtagcagtgtaattcccgttattgccatagtagttattacttctataaataggctttagattcatagtaattaacagtacagagaagaaggaattatacttacttggacaatgtcggttttgttcttgcaccctctgcactcaaaggaattcttcttgagattagcaatagcaataagcccacacttctcgcatacatggactctgtacgcatcactctggtcaaataacctttccttaaggaaaaatgcagcgccatgagcaatcatacagtccctctccatctctccaaaccggagaccaccatcgcgtgagcgcccctctgcaggttgtctggtaagtatctgcacaggaccacggcctctagagtgaatcttgtcatccaccatgtgcttaagtctctggtaataagtaggaccaaggaaaatcatggcagttaattttcttccagtgtgaccgttgtacatggtctcgaatccacgcatctgataaccacatttatgaagtgctttgctgatgttatccacctgaaatttatgtaacaaattcagattattgcaggtttgaacaataaaagaaaaagtgattgattatcacataatcttgggactataactagattataactgattgcagtaagctaggggttgaacattttcttaaaaacaagtagaatataatcaagactaagtctataaaagattactcacagtaacatcagtgaaaggagttgcatctccttcttttcccatgtgagcagcaactttacccataatacactcaatcagttgaccaatagtcatacgggatggaatagcatgtggattcacaataatatcaggtgtgatgccttcaatagtccatggcatgtcctcttgtgtataagtcattcccacagttcctttctgaccatgcctactactaaacttatccccaatctgtggtatacgaactgatcgcattctaaccttaacaaatcttaaaccatcagcatttgttgttaggagaacctgcacaaaagatagtagacttagaagtctgttgatttcagtgtcataacacagcacagaaacataagaggcggcggagggaataacagacctgatccaccatcccactttcactgtggcgcagcgaagtactgtgatcacgctttgtgtatctagtagcttgcccttgggcatcatcttgtggaataggagatgtcttcccaataatgacatcttcaccagatacccttgtaccctgatacatgaatatatatcagcacatctattatgtcgccatgataaagaaaagcctacaataatgttctctacttactggtggtgcaagtccatcatcatctagtttatcatatgacccatgacgcattccctgcaaggaaaatttcaaaaaacattagttcataagaccgacaaagataaaatcttcaatgaatctaggggagcattaccatagtattctccctatttggacggccaaactcctctttgacaagagtccccatcttcttttcctcatctctgcatatgaaggactgtcaggctacaagcattggatggaacttataaagtatacagtgtaatgtcttcatacctgtatgagcggaaaaacagagatcggaagaatccacgatctattgaagattggttcataataaccgaatcttcttgattatatccagagtagcatgcaatagcaacaattgcattcttcccaaatcatcaaagcaaggtattagtaattacatcacaaaacaaatgcagaacatgaagagaaagcaaacaaggtgtcccgcggttaagattgttcacttacaatgccagctggtaactgtctgaagtgcaaatgttccatagcacgagtagtaacaagaggcttttgtgggtagtatagcacataggccaatgtgtcctgaatacaaagttggatgtttaagaatcaaatctatacgaacagaccaagaaagcagacagatggcacactcaccattcttaactgatagttggtaacatagattcccattgcttgttttcccatagcagactgatatgtattacgaggtgactgtacattcaaaggaatgaattagacatgcttaaaaagatgcagcatacaacatcgcataatgggatgtgttacctggttatgatctggaaaaggaataatcgaggcacagacaccaagtatcaatgaaggatgaatctcacaatgtgtgtaagtttcagagtacgcctcctctggattgtgtcttgcaccaataaggtcctgaaatttatttatttagattatactagatgatgatgatgataaacattttggcccttttcacacaaaggcaaaaggagttcccatggaaggtaaccttaggtgccctacaaatagtcaatttggcatactttgcatgacagatcttacttacattaatggtcatggagatcatagtagtttcttcctcttcagtatctatgtactcaataaatcctttcgcaactaagtcatgccaaccttcctcaggtgtctcctggataaatacaccatagaataatacaagcacataagaaacatagatatatgtctaaactgtagtaaaaaaacctaggatacagtagtaaatgccagaccctttgctgcaacgctcggatatgtctctttttaataagaagcctttggttttcaacaataaacagtggacgactgcaacgcccatagtctgtataaagtctgagttctttaagacgaatatcacgaaccacaccaacttcagtgttgacatcaatctgaaaattgacaaagctcatcatgtaagtctgatctgacatgttctaggttaaacacagaccctcctaaaatagcatgatacaagtaaattccatcctcgacttgtccaatcttaatacactgagcttatatatgtttaaccaactgcagaaagcaatttacacaatactaaaagatgtcaagcaaagtatgtcaaaagaatgcagttaatttcctacacactcatctattcaccaatttattgcctgcagaattcggccccatcttccaaattattcaagttaagcacggcacatacctgtcttctcaaacgcctaagagtcttcaccaacaggtcagggttcctgtgaattccaacccaacaaccgttgacaaaaattttagcagcttgtggaatgacggctggtgatatctcctgttaaaagataaacacagaccaaaatcagtaattgttgcaaaagaccccaaaatataagacatggaggggaaacggagcaaaaccattatgttctgccaaaggaatgaaaacaaacctcaaaattttctgtgccccactcctccaaaaattccaaaataggatttgcagcagaaccaacagtgatatacaccatcaatgcaagatttttaaccaaaccacaagcctgaatacaaggcataataaataaacgtaagcacagagccttcctccaacataccataactacataaatgtcaattacttacttgtccctcaggtgtttcagcagggcacatcattccccaatgagaattatgcaattgccgaggttttgccaatttccctattaagatcaacacaatcctcagaatcaagtctcagtggataagtaatgtatgaaattgagaaaatttgatattgaccttcacgcccaattggagagttaagcctccgcagatgagataatgtagatgcataggtaaggcgattaagcacctatacgcaaaagaaaacaaggaatgaagagcatggattcatacatttgttcgctaaaccatgttggaatcagtgaaataaaaacatcaaatgttcaagaaagagtacccacctgagaaacaccagccctggtaccagcttggttagcctgtccccagtttccagtagcaagggaatacttcaacccactagtaatggttttggctttaatagcaaattgcagattgacttcctttccattatccacacactggattcaagaaaaacatcagttaatagcctccatggctgagtaaaagaaaaggagggtggtttagaaagggaaccttttgcacatatgacctcacatcccttgtcaactttctgaaaagctgtatttacaaggaaaaaaattagaacatttggtcccacttcagaaaagagactcatcactattttagttctgacatatcggagacgaaccattctaaacagtcctccaagcaatggacctgcaagatccagtcttttgttgccataatgatctctgtcatcttcagctcttcgaccaagagcgcacatcagcagacgatgaataatgtacctgcataataagtatacacgaatcagccattctgctttcaatcgaactacagcaagcttttactttcttaaagataattaaacacatgcaatttagaacgcatagtcgcatacccaaagtagtacgcctttttggtttcacagaattcacccacaccaacatggggtaacatttctttttgaagtatctctttggcatacctgcagtagccacgtagtaagtaccaacatagtaatttaacttttctagcatatacagaggtaactctctgccaccacatacttaattctcttttctttagttacaccaacagtagctccacgctttccaatgtaatccagagcaaccttaaaataggtgtattaaagctttagaaagatgaaaccaaaattaagaatcataaatttactagttcatataattagtttagttccagttgaaagctgtatgatgtattcaaacagctaaaaatacctgctgattctgaatgacgaaagcttcctctaaagatgggcgtagcaattccatcatttgtgtatcagagaaatcatagcatatgtgctctaatatatctttatcagcaacaaatcctaatgctcggaacacaatgatgatcggaatgtctgcacggatataaggcaaagtagcacgtatatattgaccagatgaaccctgcatcacaaggaatatttaacaaaaatttagggtaacaaggaaaacactaatgctcattaagaatacactagtaaatagaattacttttgttccagttggaagtcatatgaaaatatttttacactagtgctcattaagaatacagacataaaaacacgtgcacctataacggttaatttcgaagcttgtatatgattactcacccctttcgcgcctgccctagaaagcatccgcacaaacatactactagcaggtctattctggttctctgccatagaacggacttcagccacgtatgcgtatttattaggctgcctcttcttaaacacatagacatggttggtgctcatcttctcctgggcaataaggactttttcactaccattgattataaaataccctccttggtcataagggcactctccaagttctgtaagatccttttcggactgttgaaacagtgtgcaataactagaacgcaacatgataggaacctgcaggagaagaaacagttagaaagaaaactacataaaagggcaaagtatccagatatgttaattacaacctttccaataaagacttttgggtactccatagtttctgtaacctcttcacagtcatgtccttttttcataactctgtatgatacatcaacatatagtggcgccgagtatgttaggtttcggagccttgccgattttggaaataaagtagctgtctctccatcagcttctgtcatcattggtttactcagatagatttgtccaaagctgatcttgtggagtgtctaaagaagcatacaagaccatgataagtatcagcacaaaagcaaataataattgttttcaactgaaaaaaacgacaagattccgtgttgtgacactcgcaatatccaggcccgaaaataagaaacaatattcagaaacttgcataggtaggtcagtttattttattttacttttgtatatataaactctactcagtattgttactttttccccagcatgtgaagggtagcaagagataacattcatcctcagtacttgtcaaacagttttcccttttttgtggatattttttttcttgaaaactcttgtgtggatattttcactagtcattgctaaaatcccagcagagattactatttgtaattctagtttttattgaggttccaatcgcctaaaaggatttcatatgttgcaagaggaatcggagcttatcattgaactgagtaggtcccgtcttgactgcaacaataagattatgccacctatcatagcattctagctaagacataccagttcttttaatctttcttatgacccttgacacttcagcaaaaacagaagtcaaagacagtttttttagcataattcagtgtatagttctaaacagtctgatataagcctatgtcatacaggcagagtgttgcaagtcactctgaataacaaaatacccatatttattacaaaaggagacattcagtttctttccccactccagtatagtcaagtgtcttacatttactggtaagatttcttgtatgatatccatctcaaaatatcaaataggcatgcagtttcactacattgctccaagagaattttacaatagtgtataattgcatatacatgactatacatctcagaaggtcaaactagacatgaagttctacaccactgttcccagaaattttttgaatataatttctgtgagtactatgttatataacaaaactgtttgctgaaagaccacagttaggattgcgattaacttctgtctatccaacatcaattccaaatagttgaacataatatcagcacaaacaaacaacacaagccatattgacactctgcttctgctaactcactagtgataacttggaactgcagcaacgcaaagcaatgcacacttcaaaactcattgtaagctttgctagtggcaacccttgtgaatccaagagttctccactccgacccgcacaaaaaaacttgaacaaaactcctatctcaacactagaataatattagccaagactatttcaccctgaaaatccagctcaaccatcaaccctagcgttcaagttgctattgcattttaaaattcagtctccaatctgagaaagctcctcttaacccttgcaaaaccctaactgccatctaatcaagcagctagccagtgaaagaacaggttaagagacctgccccctcgccattaccaaggtcgccaaaccctagtatgccttaagccgtgcaatcgcccgcccaattcagaggagcaagcaaacagcaaaagtttttttaagcagcaacagcattcgctaggggtggtgaggggggcgcaacctcggcgaactcggcctggcggccggggttgtgctgcgactcggggcggatctcgatgtcggcggactcgtcgacgatctcctgcatggtgttctggatgaactcgtcgaaggagtcgagctgctggcgcacgaggcccttctcctcgaagtaggcggagatgacggcccaggcgtcctcctgggtgatctcctcctcgtcgggggcgtccccatccgcctcctcgtcctccatctcctccccgccgacggccccgtactcttcggcgccgtacccgccgccgtggtgcgggtggtggtgcccgcccatctccatctccatcccctcctcgtactcgtcgtcctccatggcggaaaccctagccccctcgcctcgaggtggtgggagtgggacgcccgccgcccaacaccgagcgagtaggggcggcggaaggaaggggaaaacgagtgaaaaaattttggaggtgatttggtccgcaacgcgatatattggagcgcggccgaagctgggcgtagcgaaagccaagtcggtttgggaattttgggtggggggggggggggg

SEQ ID NO: 30825 - DNA, 12197 bp, Oryza sativa
ttttttttttggtaaattttatcagaaagactaacatatagcactgtgatgtatacttcatccgtctcaaaaaaaaaaaaaagaaaaaaaaaagaaagacaaaccctggtttccgtgtccaacgtttgaccgtccttcttatttgaaaaaattatgaaaaaattaaaaagataaatcacgcacaaagtattaatcatgttttatcatctaacaacaatggaaatactaattataaaaaaaatcatataagacggacagtcaaacgttgacacggaaacccaggatttgccttttttttggacggagggagtacttatttgaaagacaaatttggttttatagcataaaaggaaagttctcattttttgtattatagtattgcaagttcacgcttcactttaatagcacctaatttatctccgttcccgttaaaagcacttccgtcactccaccttgtcttcatgttttctttgaccgcaattggctgaatatgacacttgaattgatgctcttgctcttatgtggattaatagattgatcgctctcatggtctcatttgatcaagctgaacaacaagaaaatcaattatgtcgtcggacagtgtcgtactgtcacctcagcagttcctgctattcctactgaaggtggctggactcaccacgcccatctcctcccttgcatggcctaatcgttgggctgcaacctgcatctaggcgatgcctgcacgcctcgacactgacacctgcgaatcgtacgttggtgatcgaggcgccaaggctgctcggcttcatcaaactccatccattgtgatccttttcatgtctcccacatagaaaatacgatattaacttgcatcatttcagtagaaattcagctgtatcaatgtactgaaacataaattcattaattcacagagaacacaatcagttgcatcaatacactaagctgttggggagctgttgcatagccgagactgctgcgtagccaccgatgaaggatgaaccaactccaatagccgacctgatggacgaggagttgtcgctcttgacatattgcagccacggcaggagcgtcagttgaggggtgaacagggacatcgatctattaatccataaaaagacatgagcgtcaattcacgtgtccaattcaatcaactgcggtcaaagaaaacgggaagatgaagagaagcgacggaactgttttcaacaaaattcgaggtagagttgggtgcttttaaaatgaattgtgaactctgggtgctgtaaaactaaaaacgacaacttttgatgctataaaaccaattttgcccatttgaaatatttgacgtgaaaatataggcatgttcagtttggtatcactttcaaccttaccaaattttagcattaccaaaaatttggtaagtcaacaaactaaacatactttaaccattactacttttttactaaattttggcagttccagaagatttcggtagttctataagctttcatcttgtaccgtaatttggcgaaggcatcgaaactaaaaggaccttgatgtcgcctagaggggggggtgaataggtgttcctaaaaattatcacaactttatagtatattagagtgatgagaactttcaattcaaatcggaacttccgatatgggattggaagttccggtcttaactgaaaagttcggcggataacggaataaacactagctatgaacttgtaactcgaacaaacaaaatgtatatgaaacaaaagattacaaacaaggtatctaaacaagatataaggtcaccaacaatattaattaagcatgcaagtagatcgggtcaaaacaagctcaagcacaatatgagagatggtaagaacgagcaaaccaagagaggagacacgttgatttgtttcccaaagttcggatccacggatcctacgtctccattgaggggccacaagggccgggtctatttcaacccttacctcacgaggttgcacaaatgcactcctcggtttcactcttgatctcttcccttgcagaggcgaaatcgaagccttcacaaactttccgtggcacaccacaagcttgggtgctcaccggcgacgtctagccgtctaggagaccttagtccccaagagtaacaaacacaatagaagatttgctttctatgaactcgagtgctcaaagtatggagtgaagttcacaagctctcaacttctcaatctctcaatccaactctctccccttctcaaatccctctcacaaagatgcaccacaaaggatggagtgaagctcactagctctcaactcctcactctctcaatctaactctcttcccttctcaaatccccctcacaaagaggcaccacaaaggatgggaaatggggatggctatttggctttggatgtgtctaatgtcgcccaagaacagcagccactcaaaggaggggtggaggagtttatatacccgagccattcaaaaactagccgttggaggctgaagcatctaggcccccggtgttaattttggtaattaatgacaagcgctaattgtggactaaccgttgtctttgagctatacattttaagttaggtccacgtcatatgtgcgcatggatgattatcgatggattaaaattgacggcgcaaagcaaagggaaagaagaaggtaaaactagcgctttaatttagaattgatcgaggtgtagggcgatcaaatttgctagtttatttttagtttcgccgtactattaagatgggtaatgacctagcaaagagatgattttaattgccacattaggtcattatgcatttagacatgtgctcacatttcacacacacacacacacacacacacacacacacttcactgggttcggcctgaccaggagcggtcagaccggccacatagtggcggtctgaccggcgtgccctgaccgacggcacatgcgcggtcagaccggtcccctggaggccgggatggtgctgctcgggatggctgatacagagccgacggagctgtattcggtcagaccgagccgatggcggtctgaccgagccgagaccggtctgaccggccaccccatgtcggtctgaccggccaggccgatggggccctctgatagggctacaacggctagttttctagccgttgcagagtagcacggtctgaccggccacatacctccggtcagaccggcagagcacagagttgggggatttcgcccccaacagctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacatcgggtcattgcttgttactctcggaggttgccgcctcctagacggcttgtggaggagttgcccggtgacctctctgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacatacttgagatcatatcactctaggattgcaaaacattgacataggagtgtgatttactttcatagagatataattgagccactatcaccctaggtttgcaaaacataacttagttgattagttagagttcacccttaccaagcctagcaacttaggttagatttgattaggtgttatttagttttaaatcgcctattcaccccctctagtcgacatctcgatctacaagtggtatcagagcttggtctctcttgattgggcttcaccgcctagagagaagatgtcgaacgaggtgaaccaagtagggaaggctcccatgtttaatggcacaaactactccacttggaaaattaaaatgtctactcacctcaaagctatgagcttccatatttggagtattgtggatgtaggctttactatcaccggcacacccttgacggagattgatcaccgcaacctccaactcaatgcccaagccatgaatgccttgttcaactctttgagccaagaggagttcgatagagtgagcaaccttgagaccgcatatgagatttggaacaagttggcggagatccatgagggtacaagtaagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagagccctaccggagaagtatgagacccttgtcactatgcttatcaactccgacatgtcaagaatgacacccgcaagcctcttggggaagatcaacaccaatgacatgtacaagttgaagaagaaggagatggaggaagcctcaccttccaagaagtgtattgctctccaagccgaagttgaagacaagagcaagagcaaggtgaatgaagtcaataaggacttggaggaagagatggtccttcttgctagaaggttcaatgatctcttgggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggccttcattggggaatgagactcaaatgaggagagtgattgatgattgtgatgatgtttcctatgatgagcttgtgagtatgtttgaggagctccatgcttatagtgagaaggagattgtcaagttcaaggccctaaagaaggatcatgcttctttggaggtcttgtatgagaagctaaagacctctcatgagagactcaccattcctcatgagaagcttaagtaagctcatgacaacctcctttccactactcaacatggagctcacattgatgttggcatatcttgtgatttgcttgatgatagtgctacttgccatattgctcatgttgcatcatctaacatttctacctcttgtgatgatcttatggatatgcctagccctagctctagctctagctcttgtgtttctatttgtgatgcctcacttgttgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcacagtgccactcgttttgtcaagagtaatggtaagtattgctccaagtgtcgtgaagttgggcatttggtaagtgattgccccggtgataagcctcctaagacatgcatgttcgattctcattatatgcttaggaaggctcataatggtagtattgttgctagatatgtgggttcccctatactcggtggtaaaaagaatgccatttgggtgcccaaagctttggtctctaacctccaaggaccaaaacaagtttgggtacctaaaagagcttgatcttcttttgtaggtgaactaccgcaccggtgggagccattgggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgccttcttcccacaagaagttattgtttctagccttcttgacaagtcttgtgtgttcaaaggttttagatatggaaatctttatttggttgattttaattctagtgaagcaaatttgaaaacttgtttagttgcaaaaacttctttgggttggctttggcatagaaggctagcccatgttggcatgaatcaattgagcaaactttcaaaacgtgatctagttgtgggcttgaaagatgtgaagtttgagaaagataagctttgtagtgcttatcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagaggaaaaatcgtacattgattgagatggcaaggactatgctagatgaatatggtgtttctgattccttttgggcggaagccgtaaacaccgcttgctatgcaaccaataggctttatttgcatcgtctcttgaaaaagacttcctatgagctaattgttgggaggaagccaaatgttgcctattttcgagtttttggttgcaagtgttatatttaccgaaagggtgttagactaaccaaatttgaaagttggtgtgatgaagggtttcttctaggttatgcctcaaatagtaaggcataccgggtctacaacaagaacaaaggtattgtggaagaaaccgccaatgttcaatttgatgagactaacggctcccaagaggggcacgagaatttggatgatgtaggtgatgaaggcttgatgagagctatgaagcacatgtctattggagatgtcaagcttattgaagtggaagacaagccatccacctccactcaaaatgagccatctacttccgcttcaccaagtcaagctcaagttgaagtggaggaggagaaggcacaagatccacctatgcctccaaggatacacaccgctctttccaaggatcacccaattgaccaagtgttgggtgacattagtaagggtgttcaaactcgatctcgtgtcgcttcgatttgtgaacattactcatttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacggattggtggtgagaaacaaggcaaggttggtggcgcaaggtttcacacaagttgaaggtttggactttggtgaaacttttgcccccgtgacaagacttgaggctattcgcatctttcttgcatttgcatcatgctttgatataaaactatttcaaatggatgtgaaaagtgcttttctaaatggtgaaattgccgaacttgtctttgttgaacaacctcccggttttgaagatcctaaatatcctaaccatgtttacaaactctcaaaagctttttatggtttaaaacaagctcctagggcttggtatgaaagattgaaagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaatcaagcaactcaaggatgggacgttcgtgagccaaaccaaatacatcaaggatctactcaagaggtttggcttggaggatgcgaagcccaccaagacacctatggcaaccaacaggcatctcgaccttgatgagggaggtaaaccggtagatttaaagctttattgttccatgattggtagcttgctttaccttaccgcatctaggccggatatcatgtttagtgtttacatgtgtgcacggtttcaagccactcctaaggagtgtcacttagtggccgtgaaaaggattccaagatatttaaagcattcctctactattggcttgtggtacccaaaatgtgctaaatttaagcttgttggctatttcgattcggattatgccggttgcaaagtggatagaaagagcacatccgatagttgccaaatgcttggtagatcccttgtgtcatggtcatccaagaaacaaaattccgtagccctctctaccgccgaggcggaatatgtttcagcgggtagttgttgtgcccaattgctttggatgaaacaaaccttgttggactatggcatatccttcaccaaaaccccactcctatgtgacaatgatagtgccataaaaatagccaataacccggtccaacattctagaaccaagcatattgacattcgccatcacttcctaagagaccatgttgacaagtgtgacatagtcattagccacataagaaccgagaaccaactagccgacatctttaccaagcctcttgatgaaacccgcttttgcaagttgaggaatgagttaaatgtcatagatttctctaatgtggcttgagatggtgcatcatggttgcttctttttgcatattgtatatttgctcttatttgctcttatgctttggattttttgccatttggttcttcattgtgaaaatggagcatgtcacattaagggggagttttgcactcttgcatgtgctctacctccctttatatgtgagcaaatcaactagtggtgctagtagtattttcgaatgtccaagtcaacataagtcaaaacttttgcaaaatcaatgaaatttgaaaactatctcttggaaaaagtttcaaaagggtccctatatgttttccaagcctcttattgcaagaaaaatgtattttagatgaaaatggctttttggccctcttttgaagaaactagaatcttatttttggccaaaatgagattcaacctcaaaatgagtttgagaaggaatttgagaaaagtttcaaaacaaagttggtagagaggaggatttgaaatgtttttggtattcaaatcatattcaaaaaccaaatatttcaaaagttgtttgaaaatcaaattcgtccaaaaactcctatagaccataaaaggtcacctcctagcactcaagtgagttttgttgcaaatcttcataaatttcaaatattatgaatggttggcaatatttcaactcacacatttcaaaattgctccaaaaatcaaatttttgttggattttattgtgtgggggttgccggcttatgcaagggctgtgcacagccggcagggcgctgcccggtctgaccgcccatatagggccggtctaaccggtgtggacgaggcggtttaaccggccgcatagggctggtctgaccggccgagctggtgggcccagggtttttatcctcttcttctctatcccgcacctacctcttctcttctcatccccattcatccccaattcgaaaaaactcctcctctctcctctcccaaaccctagccacctccctccaccaaatccatccggttcaaccgtcaaaatcactctagttacaccgtaagtgaatctcctcctcttcctctctctatcccatggatttgtttgagtttttattgagtttgtgatccatggcatggaaccctaggtgaaggaagaggtgttcttcgatttgcaccaatagagggtagtttcttggtgtgattcgactccttcaaccggtaaatcactctccctcttgtgcattctctcaaatcggtctatttcaatttctagggttaaggatactttccccattgcttcaatcttgatgaaatagacctacaccttgatgttcatgttccaatcttgtgcaactttgtcctagcaatttttgttagaatcatttgtgtggattgtggaaggattcggttgtgctactgtcaatggcggtctgaccggccgaggaccgtcggtctgaccggccgtgagccgccggtctgaccggcctatggccgtcggtctgaccgacttggggcttgcggtctgaccggccttggctctcggtctgaccgcccctgacagacagcactcccccttctcccacttcactatgtggcttctaaaattgttgcttatccatcctttgctccttgtttttcagctatgcctccccgcactcgccatggttgtcgtgagcccacgcccgatcccgtcagtgagaatgaggaatcaagcgaagatgagtatgttcatagtgatgatgaaaatatggaaaatgttcagggtgatgagatggaagtaagtgatgatggtgatgacaatgggagtggcaatggtgaagatgatgaggcaagtgatgatgggagtcctctcgattccaccatccaatttgtgcttaatttgaggaatgctcatcaatacactatcctccgtcaccatgatcaattccggaggcctaacgattgtaatgatccaagatttcatatacggttccaaaagtccgtgtatgaacaagtgtatgccaacaaagccttcgcctaacacaagtggatttcttggaggcacattggtgagacaccggagtttgaagatttgcaagagatgttccggaccgttgggattgatagaattgtcaccatgaagcaaccttttgatgaagatctcatccggcaattctatgccaccgtatgggtgtccagcgattgtgatgcaatgaagtggatgtcggggacccttcgatgctctatcaaccgccgtgaattcaagaagctcttgcacattcgcttcaacaacggggatgaccttcatgatgagcacacccacaaccccttctccattgatcacttttctcagttttatgaagaagggggaaggcacacatatggaaaggtggtggatttgagggctctcccaagtgtgatcaaccgcatagtaagggccaccatcctcccaagatgcggcaacaatgatgacatacgcggagttgcttggcatgtcattgatgccattttggatggtcgtcggtttgatgttatcaaccttatgatgaagaagattgccatctcaaaggggactattggacaaggaatctattatgctccctgcataatgaggttgattcaaagcaagttgggacaaattggtcacaatttaaaagaacataaggagtacaagcctcgtctccaactctccactcctagagctcctcgtgtgcgccaaccaacttttgattaaggtgcaagctcaagtgcagcccctcctcctcctcatgggtatgatccaagtgtttttttccatccacaatatgcttactttggaatgcaacccaacgagtacttcaacccggtacttggggctattaataccctaagtgaaagcattcaacgcttgtctaccgggcatgaagctttgcatgaggatgttcgtggcttgcgcaccgatgttggcaacttgaatacttcggtgggaagattgcatactagggtgggtgtcttggattctcgagtccaaactttgagagtatccaagcatttgtgtatcatcgtcgtcgtgatgctcattatccttccacttcggcgcgtcctccttctccaccacaagaatgaagacctttttggtacttgatgccaaaagggggagaaaagtgtgtttctatgtcttg

SEQ ID NO: 30826 - DNA, 270 bp, Oryza sativa
atgttcagctcggcggagctcgcggcacaagtgcggcggcgtggacgagctggagatctcgccggaggagatggggatgtacgtggacctccacccgctgacgaacacgacgccgtacaccgtggtggagaccatgtcggtggcgaaggccgtcgtgctgttccgctccgtcgcgctccgccacatgctcatcatgcccaagttccaaggacccgaggtcagcgccaaaacacagactgaattttactccctggttacaagacgatccaa

SEQ ID NO: 30827 - DNA, 430 bp, Oryza sativa
gggggtggcgtgtcactgcggcggctggcgcagccggaggccctggcgcgcgggatgatcacgcaggggtcggcgcagctgcggacgctggggcggtcgctgcggacgggggcggccatggcggtggtgttccaggaggacctgaagaacacctcccgcaagatcttcgacccgcaggaccggctgctggtgcgcctgaaccgcagcttcgtggtctcctgcatcgtctccatcgccgtcgacccggtgttcttctacgcgccccaggtgacggcgaacggcggcaacctgtgcgtggggatcagccgcgacctggccatctccgccagcgtcgtgcgcaccgtcgtgaacatattcttcgcggcgccgatcgtgctccagttccggaccgcttccatcgctccgtcgtcccgcgtattcggccgcggcg

SEQ ID NO: 30828 - DNA, 11234 bp, Oryza sativa
  unsure (1)..(11234): unsure at all n locations
acgtccaactatacattatttattaaggggtattatagtcttcttctcttaaccatattacatgctaaacaatctagaatgacatgtattttgggatggaggtagtatgtaatatatcactttacgattgtgtaagtttaaatttaatttctataagttataataaaaataataaattaacgtatattcatattcaaaattattatttttaaaaaattgtagaagttaaatttgagcttatgtgtttgtggagagatatattatgtacattattagatttttttttcagattgttttaactattcattaataaacgagttcaaacgagtgaacgtctattttccagtgattaaaagagctttccaacaatttacatgtgtttttttatagatcgtgggggcatcgtggtacttgctgtcgatcgagagggtgagcgattgctggaagaaggcgtgcaacgagttcccgggatgcaacaagatctacatgtactgcggcaacgaccaccaaaaagggttcctcgagtggcgaaccatcacgcggcagtacatcaacgagacgtgcgagcctagggacggcgtcatgcccttcaactacggcatctacacgccggccgtcaggtccgacgtcatcaagtccaacgacttcacctccaagctcctctactgcctctggtggggccttgccaacctcaggttcgacaattttttatttttgccgcaaatactatcgaaattgaaattaaaagtgtaaattgcttcgcacagaatagattgtatcatatttcacttacaccgggttttagtacttatgttcactttgcattagggtatatccaaatgttttttattttgtatactagattgcgtcatatgaatgaaggaaaattttataaatcacgagtaaatgatttttttagtcgtcaaaaatgaatactccctccttccctaaatatttgacaccgttgacttttttaaacatgtttgaccattcgtcttattcaaaaacttttatgaaatgtgtaaaactatatgaatacatgaaagtatatttaacaataaatcaaatgatacgaaaagaattaataattacttaaattttttgaataagacgaacggtcaaacattcttaaaaaagtcaacggcgtcaaacattttgggatggagggagtatatcgcagtaggagtctctcctgctatttttaatcgtaagaaaaattaatttagaccacgtttcacaaagtcatccatattttataaattttaatgaaatttctaaaaatttgatgatgtatatcctggtgctaagtgaaatttgtttgaaggcaacaacctgatgtagactgaaaatatgtgctaaatctgatgtaaagtgaaagtagaagtgccgctttatcaagtgcaaagtgcaatttactcaaattagaaacgattcctatgagaatgttgagaaatttggtgtgagaataattaatttgaggatggatgcagcacgctggggcaagggctgcagacgagcatatacacgggggaggcgctgttctcgatattcctggcgacgttcgggctgatcctgatggcgatgctgatcggcaacatccagacgtacctgcagtcgatgacggtgaggctggaggagatgcgggtgaagcggcgcgactcggagcagtggatgcaccaccgcctcctcccccaggagctccgggagcgcgtccgccgctacgacgcctacaagtgggtcaacacccggggcgtcgacgaggaggtcctcgtcgccaacctccccaaggacctccgccgcgacatcaagcgccacctctgcctcggcctcgtccgccgcgtcccgctcttcgccaacatggacgagcgcctcctcgacgccatctgcgagcgcctccgccccgccctctacaccgagcgcaccttcatcatccgcgagggcgaccccgtcgaccagatgctcttcatcatccgcggctgcctcgagagcatcaccaccgacggcggccgctccggcttcttcaaccgcagcctcctcgaggagagcgacttctgcggcgaggagctcctcacctgggcgctcgaccccaaggccggcctctccctcccctcctccacccgcaccgtcagggccctctccgaggtcgaggccttcgccctccactccgacgagctcaagttcgtggcggggcagttccgccggatgcacagcaagcaggtgcagcacaccttccggttctactcccagcagtggcggacgtgggcggccacctacatccaggccgcctggaggcgccacctcaagcggagggcggcggagctgcggcggagggaggaggaggaggaggaggccgccgcgatccgctcgtcgacggggctcaagaccaccatgctggtgtcgcgcttcgccgccaacgccatgcgcggcgtccaccggcagcgatccaggcgggccgacgaggtcctcatgatgcccatgcccaagccctccgagcctgatttcggcgccgattactgatcagccggcaaatgcatgtgaattagcgcttatgaaatgggtgtaaattgtgagtaaatgttgtcggatttagctgtgcagtgcagtactccctccatttgatagtcatatttcatcttggcacacagactaaggataagtaattctacttatcatctatttaaatgtgctactagtcattcctcgtaaacaagtgattcattaatatttacatttctcaatgcccatgtagccaatcatgtgtggaagaatgaagagtcatgtattaaatccaagaaagtcattaagatgataagttgttggattgaaatatacctatcaaaaataaaattttcagatttggaaatatgactatcaaaaatagatggagggagtactacagtgtgacagtgttgatcggctttgcgtaaaccggtacttgatcaaagctagaaatattatacccaatcttgctttacataaacaggtgtttctatcttgttagttaggggatgttagacacacaattgagcaaagtttatcaagctcatagtaaagtttcttagtatttctctacatcagtacgactgtcaaggcaaagtttatcaagctcatatatagtacaggctgtgaatcaccaaactccaaatctgcttgaggcaaatgtaatactccctccgtccctaaatatttaacaccattgacttttttaaacatgtttgaccgttcgtcttattcaaaaacttttgttaaatatgtaaaactatatgtatacataaaagtatatttaacaatgaatcaaatgatatgaaaagaattaataattacttaaatttttttgaataagacgaacggtcaaacatgttttaaaaagtcaacggcataaaatatttagggacggaaggagcagtaactattaacagctcaggacttgagcaaagggttctctggactgaaggctgggaaccaccaagctccaaagctgcttgaggcaaatgtaatagtaaccctttaacattgtatcttaagttaagacggccatttgaaaaaacaaataaaatggtactaacttaaaacaagagattactttgtaagctgcttgaggcaaatgtagtaactctttaacattgaatcataatacatcgatttgaaaaaaaaacaaataaaatgacaacttaaaacgagagattactttgtttgccctcatgtatggtccaactatctttaaggtcaccaataggcaattgggtgccaacaccataactgatggctgccgctcccgtcggatggcctaaacaaccaaagaataagccaaaatttaaattttcaaacttaattttgagatattttcaatgtaggttctttttcagcattggattttaagttaccaagaatacatatataaaagttttacctacaaattcatttttattcgttttggcttattaggaaaaaagccaaatgatgggggcctaggtatggtgaccatggccgtggaaggagccaatccatctaaaggtaccagcacccatgttacaccaccagccttggcattgagcatgacagccatcttcatagcgaatccatgaagtcaccatgatagggacctcctttggtatttctctgtattcctaattcccgtaggaatcatggggaattccatccaattcctatgatactcaaatgtcctattacagtgttttctttccatttctacatcccaaagaataagaccaactataaatttgaacaaatgcattaaaaccaactccatttcattatctaaaaaaaactccatttcattatttatttgattgaaaggatcactgtaaactttggtatgaggcttttgccaaaccatggcttaaccaatctacatcctcgaggtctctttctaatgcaacagcgatgcccttgcatattccttccataaatcatattacctggttctattgattggatcggaatacatccgagtgaatcggaatatagtgaatggtactggtaaactgtacaagtgtgtgcatcaattctcttttgggtgtgcatcttgcatctagtgatacttacatctgatctcttttaggacatatgttgtaaacttacatctgatctagagccttttcttccgagcagttggggcatgagatgcaacagcagtagcctgtgctgagcatgagcagaaaccacgcagaactgcagttacagcagccagagcgaatggaacgtacagctgaatcagcttcggtgttgttcttcctgagcccagcatctctccgaagattgcagactgaagaaaatgcagccaatattagaaacaaatcaagaagactcatggtataataagacgctatcaattatatcacacaaagattggttgactaatgaaacaattctgaatgtagtagaatccaatagatctactccagcaagcaattagggaaacaagtagcatgaaagtggagtttccccccaataactagccaaatccatctctcctatgccgtgctcgatcagatcacaatcatcctgtccgatctaagaaggcgagaaacaatcgagagagttcgttaccatgtaggtgagcacgtagacgcccgccatgatgtaggtggcgccggaccagggccggcgcgcgaggatgccgtagaggttggcgacgcagaccggccagaggaaggcgaggtcgagccaaacgaggccgcgaaagaaggacggcgggtcggcgacgaggtagtggccgaactcggcggcgaaccaccggtggatgccgacgagcggcgccgggtagaggccgcgagggaggacgacctgggcgtcgaacagcggcgccgccaccgccatggtcaaggagagcagcgccaccaccgcgtcggccgccgccgtgacgaagcccatttttggtcgctcctgcccctctggagccaaatgagtactattaaggggctgtttggtttccagtgacttattccaagtacatgtcacatcgaatgtttggacactaatttagtgtattaaacatatactaattaaaaaactcatttcataatattagactaattcgtgagacgaatcttttgagtctaattacgccataattttgataatgtgatgctacagtaaacttttgataattatggattaattaggcttaaaaagatcatctcgtggattagctctcatttatataattagttttttgttagtctatgtttaatactctaaattagcgtctaaacatccgatgtgacatgggctaaaaaattttagccctatctataacaccccctaatttcgatgagaaattatttgttttaataatctacagagtcaaccctttttcactagtttatggtaaaaataattttaatatctgcagtactaatagtatatttgcgtgaatatgctttagtatacaaatatttttttatcaatgtatgccgtttactaattgtttttaatcaatatattctaaaagtatttgtttattaaatttgtactaacaatcgtctcaaccgcttgatttaggtagttagaagttatataaaatctagatgcactcatgacataacacagtgagtattaacaagaatttagtaagaaaaagttagtacgtatatatatatatatagccctttccattttaaaactatactccctccgctcaaaaacctaaacatatcatgattcgttgtactaaattaaatggcatctaattttatgtttgtttttttctaacggaaagactataggagtatgccttataaaaattggtgtaggcttacatgtattttttttccttgcgtaaaatataatattttttaccttcaaacactcaacgaagtctatttttcatcttgaactataaaaccaattattcttcactttgataatggtttcagaggtgttctttttgttaccttactaaccatcgtgctattatatgtcatcatggttgctaataagacattggctatggctccacatttgaagctgttttctttttcaccgtttcttctcgcagtaaagtgattagagggggagatgtgaggagacggaggaaagcaaatgtatgatatgtaggctccatgcaaatgttagtacttataatggcattaaatagtgttgtgactttcaacatggcaaagaccactgctaaaatatatcttgaggtgaacttgtctagttttaaagatttacggtgaaaataaacatttttatatttcagggtggaaaacattttttttctctgatacgatggagaacatctaccattctttaaaatgttcccccactaaattacaaccatatctttgtagtaaagcatcctttgaaatatagtaattctaaagaatcttagttcgaaattgtctttaatacctattatcggatactttgagagatctgagatctcccacattaaccagaagatctaagttactgattacgtgaatcttattatcgtgatagtagatggtactgatagtttcgagaatgttgtaaattgggttaccgatggatcaaaccccctgtcattgtcgcatgcatgcaatgtaggtagctagntatttcttctccttcattcttcctctnttaaaatattttttctaaaatatttatccgatctacgatccaatcacaccattgtatccgttgcaattaaaactttacaacaagataacatattattatattatattaaaagaaaagcatacgtttcaaactgttaaaactcaatgttttatatgtgatagtgatatattttaatgtgcgtcttcaacgtgtttcaaaaattcccgaagctacttgttactaccctctctcctctttcttcacctcattcatgcatgcattagtgagcttcaaaacgatttttatgctaaactacttatccaatttatgatctgatcacaccgttgtatttgttataattaatctttataacaagatatcacatgattatattttgatgaaagaaaaacacatgtttcaatccatcaacacttattgtttcatatgtgatagcgatatgtttcatcgtgtatcttcaccatgtttcacaaaatttttaaatgtttcagttactggtttttttgtttcaccatatatataacttggtgtttcaatcgttggtgaactggaacattttaccgaccgattttttggtgaactggaatattttactgaccggttttttggggcattggacacccaatgagaagattcttcctgatagttcgtgttagacaaacactatctggccctagtttctcaaaaataacttttgaaaaatggaaaacatgaagttctacattcatcttggactcgtaattcagtgttttaattagcaagctgtagttaatatggactcttattttaatgtaacactgtaatttaaaaaataaccaacatgtttagcatataattaaaattttaatactatcaatgcaataaaaggatcgatagctagttggtctaatctatcaatatgttatatcataacgatatctttaaaagaagctatcatattcactacaaagactagaaatcatgacattaatcagaggggaaagcaaaaaaatgtaaacgttagattatcatgggtctagaatgttattgtaaacaaaatgcatgccaataatgacaaaaattaagagttttatattaaatccaattatactttccatccaaataacagctatgtagatagtaagatacaaagagttgtatataaaaaataattaatttttccaattcatatagaaatcataattctatttatagaaatagaagatagagttatgtaccaaatctgattatacttctattcagcttttttgtaaaattgcgatggataatctgttagctcttgtgaaaatggtataaaaactctagagtttaaaaggagtattacacatatatatttttttacaaacacagtgtaaatatggacgctcacatgcacacacacttacttctataaacatacatgcacattctatctttatgagcgattgaacatcccgagagatttagcaaatatattaagattggttgagtcatttttttataccacaaaggatatatattctacttgtgctgttgtactgagtgtatatgggcgctagtatatcaattgcaaagtcaataatatagggcttgttcacttttgttgcccaaatcaactataccagattttggtaatgctaacttttgatacattttggcattatcaaatttcggtagtgttagatttgtttgtttctgaaagttcaagtgccattaatttggttttggtgattaatgacaaatccaattccatgagactaatattgttgtaagcatttctttgtctagtctcatatggatatgaaagtggagtgtgtgagaggtgattcctggacttcatatgagttgagatagaaatgttcattgatggtggacctaaatcacaaggatgaaatacatggagatcaagctatatgtatcactctttctctccatgtacatattgatattttcatatataatatttccacatgattgacatgtgcatgtgagactaatgttttgtttgagtcttatctcttatttagtctatttacattgagaacgtggagatgatgaatgtatgtttttattttaatgactatatttgagaaatgccttctattcttgtataggataagctctcaatgtgtcatatcttgttatgcatactcttgcttcacacaaatattccatatgcatacatttagggggagcaaatcctacaccttagttatgcatgtatttgatccaagttattcactttcatttaattgggatctttacatttgagcatatatttgagtatatgacacttgtggtgttgattaatactcatcatttattcatatccttttatacatgtgattggttagtcaacatgtggaggttgacaactggatcattgagactaataatttcactaagttaattgagaaaaataggttccaaggattgaaaaggtgttgacgctcaagtgatatgattacacctaaaataccaagaataacaaagcgaagatattgaatatgtgggatacgaagtggctactatggcaagacggtgaagggcaagcgatgctcggtcgcgatggaccatgcggaggtgaagggcaagcaaggggcttggcgccgaagaaccaaatccagtggtgaagggcgagtgacggctttgtcatgatggaccgtgtgagaccatttgaagctacaaataaccgcatcaatcatttgaaaaatatatggtgaaacggttttggcgttggcgtcccttaagataaaggaaggaaatggaaacaaggcattcctattggtataattctcttcctatttatatttgagtataggaatgatgtactatttagagggatgcaacgtcgatgcgtttgtgtatgtctcggtgctcaaagtgacctatcatactactaccttgagagaaacccaagctttaacctatcctttgagtggttttagaccttgttcttggttgagttgggtagtcctctaagtgagctttccatagagtccaagatcataaaaaacggactcccaagcaaaaagttatgattgttttactctgtgcttttcggaagttccgaaaaattatcggaagttccgaaaatcatcagaagttccgaaaatggctgcgaaactgagttttgcttttgtaaattttcggaagttccaaaaactcctatctttgcctctgtaggatcgagatgtcgactagaggggcgggtgaataggcgatttaaaactaaataacacctaatcaaatctaacctaagttgctaggcttggtaagggtgaactctaactaatcaactaagttatgttttgcaaacctagggtgatagtggctcaattatatctctaagaaagtaaatcacactcctatgtcaatgttttgcaatcctagggtgatatgatctcaagtatgtctctagaaatgtaaattgcacaaatgtaaatgcgacaatcaaatgagacaatgagacaagagattattcaccgaggttcggaaactcgccggtttcctactccccgttgaggcgagcccaactccaccgctcaaccacgaagccaccgcacgcccccttcgtcaaggggtgggcaaggcgggagccggcacacagagaggactacccaagcctcgatcactcggggtagttcttccttcactccgaaggtggtgaactccaaaccactcacaaaccggtgccgggcctcctccacaatcttctcggagagatcaccgggcaacttctccacaagccgtctaggaggcggcaacctccgagagtaacaagcaatgacccggtgtggagatgatcaagtgccacactagctctacaatggaagcaaatgcacttgactcttggctaaacaaccctctaacacactagatggatgaacacaaagctcaagtgagtgtgagagaggtgcaaggggtgttgtagcgcccgttccgtcgtggcgcctagcgggaaaattatctcttaaaaaccctaattgcgaaatttgtttctttgcttgttgtctagtgtccgtgccatctcaaggtctcaatccgcgatcgatcgtcgagatcaattccgaatccaattccttccaaatcgaatccctccgcaaaagtctagtttgcctcccccgggttcgatgggccgaattccgctcggcccatctcttccccgg

SEQ ID NO: 30829 - DNA, 4273 bp, Oryza sativa
gcgagagctccccgctcgcaaagccggccccgagcgccgatgttcgcccgcgcgcagcgtggtttcccgcccgagccgcgtcgtctgcgccgtccgcgtcgcccggtcccgctgcccagccgcgccgcccgatgcttcccgcgcgcgcgtgccgagtggtcgaccgcctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaagccgcgcccctcctccctctgccgcgacgctcccgctccccttcccctttttcccgaatcggcaaaggggcaagcccctttctccccctccttttcccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcatttttgcctccgcgccattgccgccctctgtttcgccatcgccgatcgtcgttgcgcatgtcggaggagccggcacgagcaaggacgcggaagaggacttcggccgcgccctcttcttcctcttccccggcccgaggccggagagattactcccgcaccgtcggcctctcgtcacagcgccccgtcccgcacggtagtgtctccctccgttcttcctcctcgctccatctcctccccttagatttcggtagtagctcgagtagcctccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttccctcgccaccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcaccgccgccacccgccgtccattcgcggccgggtcgtcgtctacctcccgccggcccgcgtggcagccacgtaggcgccacgtcggcgccagctcagcctagaccgggtcgagccgaccccggtcggtccctccccgtgcgcgcgttccaccgcgagccgtgaggctgcgcgtgggcccgccgcatccgcgtccaccgcgagccgcgcgcgtgcaccgcgtcccttccccgcccgcgcgcgtgcgtcgcgtgctccctccgcacggtgagccgagccgctgataagcgggtcccacccgggaccacgcgtggtgagcccggtccaccggctccctctctctcctccctcccgcgcgcgcgcgcttgggccgtcttgggccggccggtccgttaagctcggccgagccgccccaaatctcttgggccgcaccatagccacccgagaaaagtctatattccctccctcccttcttttctttttcttttccaaaaaaagggatttaaataaatccttttcctttagacaaaaatccaataatcttagaaattcaatatcttcccaaccgtaattccgtttgactccgttcaacttctaaaatttcccaaatcttgagatctatctagtggcacgcttagaggtctttaataggctttattttcgccgtttgttgagttgttccgtttcgcgtgtagttccggagcccgaagacccgcagtgcgaggatttcgagcatcaagctccggatcgcgagcaaggcaagccacctttgaacatcttgagcctatatttgaaatttaattatattgcttgcgaaatattatgcattgataggatcacactaaatctgttgtcccgtctgcaaggcagattgacagacctacctaaattgttgcatttgatcctttccttgttaattgttacaccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacgatttcccgctctcgcacttaaggaccgatttccttggaatttcatccaaacataaggcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccatggtcatgggcggatgtgaggtgattcctagcgtagttttgtttgactactgcttgtgaaattgctgttgtgaaaaggggattcgatgtttgaaaaatcagcagctgacgggatcagctaggcccgggtggccgtttgaaaagttgttggcccgggtggccgtttgaaaagctgttggccgggtgccaatcttgtttcaattctaaagattgatgcattgcacatactccgaccggacgagacgcactgtctcatccgagtcgtttgagaagcactcacctagtcgttttagaaaagagttcaaataaaataaattgcaaaaataacagcctttccttgaagcctgcaataaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacaggtgtatgcaattgaattgggtgccaagagagccccttgctgctggtgggggagtatttatactcccacccaccaacactagccgttgggggcgaaatcccccaactctgtgctctgccggtctgaccgtaggtatgtggccggtcaaaccgtgctactctgcacgggctaaaaaactagccgttgtagccctgtcagagggccccatcggcctggctggtcagaccgacatggggtggccggtcagaccggcctcggctcggtcagaccgccatcggctcggtctgaccgaatacagctccgtcggctctgtatcggccatcccgagcagcaccatcccggcctccagggggccggtctgaccgcgcatgtgccgccggtcagaccggccttatgcgccggtcagaccgccttcttgcggccggtcagaccggctagggcacgccggtcagaccgccactatgtggccggtctgaccgctcctggtcaggccgaacccagtgaagtgtgtgtgtgtgtgtgtgtgtgtgtgaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttaccgtcttctttccctttgctttgcgccgtcaattttaatccatcgataacccacccatgcgcacgtatgacgtggacctaacttaaaatgtatag

SEQ ID NO: 30830 - DNA, 308 bp, Oryza sativa
ctgggccttgactaccccatgtcctgtagaacctgttgaacttatcaaaggtgaaaatgagtcttatgctgactggcaaaagagtcagagggacaatgctcctctcgtcatgtcgtatgacattgaacaaaagaaatggtccttagccaacaagaatgtttggctgtggtaaagaacacgattgagcccacaatattaggctcaattccagagtgtgacgctgtctcagagtaccttgaaagaataaaaagtcagttcactggcttttcaaagacttatgctacacagctgatcaagcagcttgtgac

SEQ ID NO: 30831 - DNA, 692 bp, Oryza sativa
ttttactagcgttcttccttgtactatatgtagaacatctttgtggtccagcaaagagtaccggccggtactggtaccgctcggtaccagtacacatctggccgttcattcctgtatgggtaggatggggaatagaaattcgctcggcgctcgctcggtccttctccttccacagccgcgcctgcgccctcaatccatcgtccccaacgcgcttctttcggccccacacactttccttcgcagcccaacgccggaaattgattaatgttcgaattgctatggagagatttctttagtaaaattgatttctccttctccgccgctgcccaacgccgcccaaccctaaccccccatatcatcgtctgcgtcgtccttcgtcgctcctcggcgcaagggttcaactcgaactcgcggcgcaggagcatgtacacggcgacagcagcgcagaggataacggcggcggtggcggcagagcaacatgggagtgaaaggcaaggagagcaaatactagggttcgagcgagctgccagccccgatccatccctcctgatccatccagcagcaacgcgaagttacaataatacccttccaaccaatttgtctaggcggtaccgcatcagggacattcttggtaccgggcgttaccaaacaatcccagccgttggatcaggccagatccaatggccaacatt

SEQ ID NO: 30832 - DNA, 257 bp, Oryza sativa
aagccagcgtgggcaacggctgggcttgtagtgtagctttcctctagtcgacgcatccaggcgagggtgggcgtgatggagcggggcgggccctgcgacggcctctgtcgcttccggattcacctaggcacgagaggggactgcccgttacccgctggggacgggggtgaaacctgagtgtggtgtgcttggctagagggggttatgcgaagggtcctgtcacggcctctttccggtatgtcatggtggcatgtcgg

SEQ ID NO: 30833 - DNA, 164 bp, Oryza sativa
ggcgccccctcgttggccacgcgcaaatgagagaaagagagagaggaagagaaagagagtgagagaggaagagaaagaaaaagagaggggtgaggatatcagagagaggaaagagagagagagaggagaggagaggaggggagatgaaaatttttgaagtggtg

SEQ ID NO: 30834 - DNA, 1954 bp, Oryza sativa
  unsure (1)..(1954): unsure at all n locations
tcaacttttataaaaaaaatgcccttgtgttgcaacaggtgaagtctattttaatcttattattgttataaggtttagctgcttaaaacctaattctgaacaaacatgtaactatttcatttgacatttttaaagtaataagaaactcttacacttttaagcctttggtctttttaaagctatgagacactcttacattgattaaccaaagaggctagattggagtagcttattcagagatacaactctatataagccaaaaagtcggcttaaaaatttaagccaataagcctatgcattgtcacatccggaaaaattttctaatcaaaattccaaacgcttacatgtgtgtaaaccctcgtccacgaatcagccgacgcacacaataacaaattgataatagagtacaattattactctaattaataagcgaataaaatgttattacagaggtagatagttcctctgtcacgcccggaatttctatccaaaattccaaacgcttacatgtgtgtaaaccctcgtccaggaatcagccgaggcacataataacaaattgataatagagtacaattattactctaattaataagcgaataaaatgtcattacagaggtagatagttcctctcaatcaataaagttctgagcagtggaaaaaaaaaagaaatagcgcaggcgactcctctccataggcagcttgaccagggctacgcctaatcatccacaccatcagcatcactgtagaactcctcctctgatgaatgattgcaaggtgagtatatgacatactcagcaagccacgcagcaaatatgcaagtgcacaggataacaaaggatggcatagtatagtctcatttgcataaatagcatttaataaatatttcagagtttaataaaacagcagagtagagtattaatttaacaatattaatccaacgctatacagcataccctgttgcataggcccaaccgttctgaacaaccaatcccagttgcacagttctatctccaaaccaggaattaaccattccaaaccaggagctaaacaagttattaccaagtacagncatcagtgttacttatggnntgagaatgtggtgcaaactcaatcacagaaagacattgttagacccgcccataaccgcgggcacggctatttgaatagttcaaactctggccagaggtgtaccactgtacccacaaggcacaacctcaacatcatgtcaaccatgcgtcgcgatacttgacaagtacccgaatagagattgtgacaataccctctatataatataattcaaagcagtgcactgttcccggatcataatcacccccttataaacaaggtatggactccccagcgacccccgttggcttatctccgccacttcacagtctggtgctctacgatgaaccatactatacagaaagtaaagccgttgcccacgctggcttgtggttggcatggtaaatgtttcacaaccgaaaatcgtgaaccggtccttaattgtcatgagcacgaccatcaaaaccatatgctcacaacccaccattatcaggttttagttggcaaattaattacttaaccaatcatgattaaccatcatgatctatcattaagttatcattaaataatagtgaagcataagttattctagtagtgtgctaatgtttctaagcatggctaagcaatcatatctaatatctagctgaactaatatgtaaagctcaactagtcaaattataataacccacggtatcaaagaataaagtaatcaagaacaaaaagggctataacaaaacaataggttatttccacccaatgacattcaaaaatatatgcagtagttgaatagaaacaatagctttaaacaggatcaacatgctcaaagggttgtttgggatctgtgtgacttgtcttgctggccttggaactcttcaaactcttctcctgc

SEQ ID NO: 30835 - DNA, 1280 bp, Oryza sativa
caaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggcgagatctaatcggttcatcgcgggtccacggcgaccggcaacgatgatgtcggcgatgacgtcctcaccggcggcggctcgaacgcgcatgctcgccagcgaacgacggcgcggcggtgcaaacggagggcaccagcacgtagagggcgacgcggcgatccttaccgaggcacgaacggcggcgagcagcgaccggacgatgacggcgacgaggaagaagcggcggcgacggtcagctcgacgacgacggcggccttccaacgatcctcggcgacgacggaggggtggacgaggacggcgacggcttggcaatcacgatagcggccttcccgagcgacgacgacgaccggagcgacggcggtgctcggctaaactcgcggcggcgacggcggcgcacagttgaacgcggttagagcgctacgagcggcggcgagctaaggcgagggtggcggcggagagaggagggctcgggggtccttttatagcggctagggggcggcgaggaaggcccacggcgctagagctctaccggcggtggaaggcgaaggcgagggaaagttagggttcgggagaagaaaacgaatccgaatcaaactcaaatccgatgatttccaaaccgaattaggcgacgattccaaaagagaaaagatagaggagatcaaggggatcatttcccctctattgatttcacaggagaaggaaaggcgcggccgaattggaagggcggcggcggcgcggctcggctagggttcgggcgcgaggaggacgatgggtccgacaggtgggacccacctgtcagcggccaagggcgcgcgcgcgcgggcagctgcgggcagactgggccgactaggccgggaaagagagagagggcggttttgggccgactttcggcccaaagccaaaaggaggatttttaaaaccttttcaatttaaattattcatgaaatgcaattccatttattaaaaatacttccttggttcaaataaatcccagaaaaatctaggaactatagaatcaagcaaagtatttaataaaattttatctggcccacttttatattggaatttattatttaaaattagatcttctcttcta

SEQ ID NO: 30836 - DNA, 25500 bp, Oryza sativa
  unsure (1)..(25500): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttaattaatcctggttagttatgttaatcatgatgtgttagtgcttgtttagcttcttaattaatgttggtctctatcccgtgaggtgagaccgtgaggccccactggaggaaaagcttgggggcacatttttgcattgtttcctctttttgtgttttcttttgagtttgtaatcgtcttgtttgtagaacgcgtccaagtctacaagtccagtcattttaattattgacttgattattgcaaagttttctggatgagcagctgaacttcacgcgtcgaaggctctgtttgttctgggggacagaggcgattgtgtctcgtttccgcgcgcacgcttttcaaactactaaacggtgtcttttttgcaaaaaaatttaattatgaaagttgctttaaaaaatcatattaatccatttttgaaatttaaaatagttaatactcaattaatcatgagttaatggctcacctcgttttgcgtatctccaaatctcctcaatccccttcttctcaaacacaccctaagcctgtgttcgagcgcaggagaaagagagaaagatagttttgttttctgcgcgcacgcttcccgaactactaaacggtgtgttttttgcaaacaatttctatagaaaagttgctttaaaaaatcatattaatctatttttgaagtttaaaataattaatactcaattaatcatgtgctaatggctcacctcgttttacgtatcttcctaatctcctcaatcccctctttctcaaacacaccctaaggctcttctcgtcattgtgaaatggggtcaaaacacagtcaaagtagtgggacacgagtttgagggttttctttcttaaaactgtggcaaccaagtttgaaacctaacccaattaatggctctctgtttgatattgtattgattggaatgatagtggaacaaacgactgaaatatagtgaagtgtaggataacaaattatctctactattttaaagaggtacttgtcccacttcttcataaaagccgttcccttccatctcatcttccacttcaaagtaaaaacattttctctcccgtaaaaatcattcaccctaaaaaacagacttcttaaacaaaccaacctatataaaaacaacctcatcaatccaaatcatcagtgagcagcaccgcataagacattcatccgaatcatcccgagaagaacccatgtcttgtcgtcttacataatgatactagtacagtactacccatcgttaacactcaccttaacgacttcctgtcagatccgaatatcttgtagtacatttgcagcatattttacgcctcctactcctgtgtgatttcttttttcctttgctttattttctcagctatgtccattctacgtgtaaaatgactaatatgtatgtgtggccaatcaataagaggaaaaaatggttcgccaaaactcctcaatttggatgcacagcaccaatttttccatcaagtgacggcgcaaggttcctaaatacccgttgattttgattttttttataaacgttcgaccatttatcttattcattctttttgtaaatataaaaaaaataaaattaagtctagctaaaagaacattgataaatcaattcaaaaatttttaaataaaaaaagtgatcttatattgaaaagttaacagcgtcgtatattaaaatgagaggagtaacaaaataaagttgcagcttaattggaatgacgacatacacactcaaaatcgacggtcttgggttttcacatggataatattggattatccttggccctcacaatcgaacagagcatgacggttctaacttctagtatgcactgtcatcgccaaaccaactgctaaatggcgagcgtggtcattaatttcctcggagaaaaaaaaagttactactccaaacgagtcagtttcgagtaacttgtggtttttaaatccaaggacttaactttattctacactaatttagagtattaaatatagattacttacaaaactaattacataaataaaagctaatttgtgagacaattttttaagcctaattaatccataattagagaatgtttactgtagcatcacataggctaattcaatagattcgtctcgcgaattagttcaagattataaatagattttattaatagtctatatttaatatttataattaatatcaaacatccgatgtgatagagacttagaagttttagtcccatctaaacaacatggccttatttcctccaaacgagacagtttcgacgccataattgtttcctcggggccatttttactgcagtctgcagagcagttaccgccgtcgacgtgaagttgccagccatggaaggggcgtgcctccgcctcgtcgtgaacccgcagcaaccgacgacgctcctcgccgtcttcctcctcctcctcgtggccgccgccgtcgcgccgccgcacgtcctcgccgccgaccacgtcgtggggggctccatctggtccatccctcccaggcccggcctgtacagagcctgggccgacaaccggacgttcgtcgccggcgacaacctcggtgagcacaccacatacgcacatccaaaatgtccaatcatcaccagtatttattcaattattctggtggatggataatacagtacgtgttgctactacattttgctgggtggtgcagtgttcaggttcgagacggggatgtacaacgtggtgcaggtggggaggcgggagttcgacgactgcaccgccgacgacccctaccgggactggaccgacggccccgccgtcgtcacgctcggctccgccgccgtccgctacttcatatgcaccgtcggcaactactgctccctcggcgtcaaggtgtacgtcgcctcccagaatgcgccctagatgaaccattccgctttgcttcttctgcagtttctcattgatccatatcacagtttctgatccatcatatcatcatcattggtgttcgtaaccattaaccatttcgctatccattcagtatcaaactatttccaagaaagcaatgtgtactctgtgagataacagaaaccatgaaaacaacaaaggatgaacagcaaaggaagaaatgcatatttagatgcacaactctacgagtctcacggtgcaagcatagccatctgaccacaaaaaatgttgagccactgcacacggtgcagtgtcagttgtagcattcacaacataccgagtttctttttaggaggtaaaactctacgagtctcacagcatagtaaaacgtagccagctattactagatacgagtagcattttttaagtcgcaaacaaaagggatacagtcccggcttaaggggtgtaaaatcagcttcactatcttcatgttcgccgcaacgggaaacagagcacaatcatctttgggtccaaaaatttacggcaaacctttgcgacgacgttgatttgtgaaccaatgacgagtttcctagatgacatactctgcttactgttgcgcgcactgaactctctgggcacctccaggcatctcatcgtcctcatcatacgcctcctgagcagcttgggctttcctgcgcatctcttcctcaatgttgttgacatcgtgcatcgtggtctcctcgcattcatctatctccatttctgtcagctgggatgcaggcttcggtggaagcacagcctcgagagccttgcattgttcaggcgccagggaatcagggaactccaccgtgaaatgaatgtagagcttccccttcatgaaaggcctctggtacattggcattccctcatcgtttattgccttgaattggtctgctcaaatatatgagacaaggattaccgacaagtacagttgcataaatactacattgctcttaacatctacaaggtcttaccaggcttaacaacttcaccggggtttgacttaatgagcagctgtctgttgtccagatgtgtcaggacaaattggaaaccacaaagtgcttcagtcagagataaggtgtgctcataaaagagatcatcgcccttccttttgaacttggagtggtccttctgctggaggacgaatacaatgtctcccgtaacggtatcaggctgcaagtaaaacattcttcaatatagttctggtcattgagtcaatctatagaaactaccctaatagatgaaacaatcataccgcctcatcagcttcaccagggaaagtgatcttctgattgtgttgcatccccttctcaacgtgaacctccagaaccttcttctcctgaataaccttctcgcccttgcagcctgggcagcgatccttctcattaatgctctctccagtccccttacactcattgcaaggctgctgcatctgctgtatcatggaaggccccagctggcggatggtgattttcatgccagacccctggcaacctgggcacctcatggaagcaccagacttggaacccttgctgaaatgaacagggagtaatgttcaagagcaggattgtgaaaatgcatagtttactatgctagggcaaaccagacttaccccttgcacttggcgcagaggacattgcgggaaagagagagcttctttgaagtaccattgtaaagatcttctagagaaaccttaagcggatggatcacatcctctcccctcctttgccttctgcccctgctgctgccaccacctgtgctcaaaacataaacaaacgaaatttcattacatcaacaaaacaagagattaacagagttcaacacaatcacacaggaaaatgtattgtcttcaaaaaataccaccaaaagaaggtccaaagaatgatgaaaagatgtcaaatggatcaacatgggatccgcctccacccattccttccttgagggcatcttcaccatattggtcatagatttcacgtttctccgggtcactcaatacctcataagcttgtgcaagctccttgaactgagataaaattaaaacaaagatatgcctaaaattagcctctttcattctacagattatgaatacatggatgactgaaaaagcagtaaacaaaaggaaatatagttgtgatcactatatggatatatgctatattcgccattccatgtcgcattcaataagacaataagcatttgttgactccaatatgcagtaacaaaatttatactccctccgtttcacaatgtaagtctttctagcattgcccacattcatatagatgttaatgaatctaaacacatacacatgtctaggttcattaacatctaaatgaatgcgggcaatgctagaaactcttacattgtgaaacggaggaagtatcgaactcagaagtattatgataaggagcataagaattaaaaacaatatttcatcatgtaagatacagtgctaaacataaaggggcagagcaaaatctaataggatttaaacagacaaaatactcccaacatatagaaacatttaattgaaagtcacattaccggactacccaaacaagcgcttttcctaaacaattaattagcaagtggatttgaatcacagctagaatgagtagtcctatgatcaccaaaggatactttgcctgaagaacaatgccctaatgctaccagttttaaacattccagtacagccgttactcaagatgttatccgatgcgagaattaaagatgcaatcaatggagcatttcacagctaaagatgcttcgctgaggcagaatgagaacaacgaaatatcttacagggtcagtataacaatacaacccagcaatgagctagattcaatggggcatttcacagctatagatgcttcgctgaggtatggcagaatgagaacaatgaaatatcttacggtgtcagtataagattacaacccagcaatgagctagatggttctctgaaaatgaatactatctgaacacaaacagactttgtaagtccatttcagctagctaatgatcttgatagataaccacaacgcaaattaaaaatgatccagcaaacctcaagcgcagcggaaaattcttgggaagtaactagcgcataaaacttgggaaaacgaacatctgaattctgaaagcacttaaagatcgcacggatcgctgtttcagtggtctcctctattggttctattgtagcagaagaatctgcacagtctacttgatgttacgaatccagtctattgttccccccacaaacccccaagatcatggccatgatcgcatcacaaattcacaattcacactaacccaccccctcagcaacaagtaaaaccgagcaaatctttgatcgcccgcccgctcgccgcccaaattccccccacatgaaccgcagactgcaaatcctaccaggcctaaagtaacaaaacgagatgatgttccgcccgccccccgatccatcatccgcgacgggacgggatcgaaccagatcgcgtcggatcgagaaagggagcaagcggccctgagatccggtagaacggaggaggagggtgggggatcgggatcgggctcggaccttctcggggtcgccgcccttgtcggggtggttcttgatggcggccttgcggtacgccttcttgaggtcgtcctgggaggcggtcttggggacccccaggatctcgtagtacttggtgttgtcgctcttcttcggcgcgcgcccgaacatcttggccccgcctccgcctccgccgacgaaaccactagccgctcccgtgccgccgcctccgcgccgccgccgccgccggggaggaggggatgggggatgcggaggaggaggacgggtcaaagttggtggccggagctagcggagtgggaggagagaaagagggtttggttaggtcgatgcgccagtgctaatgtagggagcagagagtacgtaacctgtatagcgaacgcgtatttcgtgttcgactgggctcgagatgggctgtttgttgctgggcccgggcattgaggcacgtgccgttccgtgcgccgttgccagattcctttatcattgagtttttttaccgttgagatggtgcgtatggattttcactttttctttaagtcagaattatctctatccctacgatctctatctctactacttaaaaaattcgaaacatttctattcgtcgttcgtcttataaaagttcccctttcgttgatctttttctgacacggagtatttttctttcattttttgtatggaaattgggtagcgggtacaacacggcgggtttgttgttcgctagaacacataggctcttggcctagtggtgctccttgcataccatctgtgggcttgcatggtctggtcatgcttgttgcatgccatctgtaggcctgctagcccaagtcccatggcaacgacgagtcttaggccatgtttagatagtactaaaacttttaagtccctatcacatcggatgtttgaaaattaattataaatattaaacgtagactattaataaaacccatccataatcttggactaatttgcgagacgaatctaatgagcctaattaatccatgattagcctgtgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccttaaccgatcagaaacacatggacccatatgacacacgataagtaccatgcatgttaactctctcctgccggtgtcatgtgctcatgcttcgactcagttccaacagcaacctgcacaagtgccatgtagaacaattatggacgtcaatgtagttcatgtagtgatttgcatcgtacaaatgcagataaacttttaataatttaatgtgtctcgcacaaagtcataaaataggcaatttcttgcatcgcatagtaaaaaatgtataggttttcatgaaaacagtaacccaatcggtacctttttttttttttgaaaccgaacccaattggtacttttgtcctcttatgattttaaaagttggtatttttacatcttttgtttcaattgttcttaatatcttctttgtgacttttggcggtcatacatatcatcttacggtcatatatatttaatggtatattatgttgttaagtgtaacttaaatcaatggacagtggtgtaaagtaaaagtatatgctaaatggctaaatatggtgtaaagtgtaatttactcttaacgaaatggtcaacggtagacgggtttgccttttcctctttttctagaaggatttttttttaagttggattacacaagtagtggagcgctacatgtgcgaggaaggaaaagtggaatggacaaaactccacttttaaaagtatatgtcaagagctatgttatgtattttttaatcttagggcttcactttattgctaaaatattcttcctaaattttggtagaagtttgagagtagaaggtttaggaattaggtttaaatctaggatttttttttgggatggaaggggtatttgatatagcttcaattccatcttttctagagctgaagtccaaccaaaccgtcatagctcgcttaaaagacaagtggaacatgttagaattctctcgcaaaataaactgaaaacgtgaggtggggttcatgtcaaaattaaaagttgggagctatgccaaatactttatccaccaaaagattttttttacaaaagaaaattttaatctattattggatgtgaattagggcatgtttagttcgtgaaaagaaatttttggatgtcacatcggacatttgaccggatgtcggaagggtttttgatacgaatgaaaaaactaaattcataactcgcttggaaaccgcgagacgaatcttttgagcctaattaatctatcattagcacatgtgggttactgtagcactatggctaatcatagactaattagactcaaaagattcatctcgcgatttcccctctaaccgtgcgattagtttttttaatctatatttaatgatctatgcatatgtccaaagatttgatgtgatgttttggaaaagaaattttgagaactaaatcaggccttactatatacatctactcctaaattattattattattattttcaaccgagagtagtacaatgggaatgacgctggtaacgtggttataaaatagtctaccgaatgcttgcggaggcggaggaccccggaccccggtgtttacactgtagacgctccggacagatagtctaagagcaggtacaatagcatgctataagccaactataaacatattttaaagatataaagaaagagagagaagagcagcggactacagatctgtagctagccgcagcacgaactttaagacgtaatgtatgtatgacaagtgggaccaagtattaatagtatagcaagtaactattgtatgaattggttattacatttgctatagataatttggagttagtagtgggctatcctattaaacttgctctaacgtgcgagcagaagctgtcttttacatgtacatcagtacttgtacagtttacaatactccctcccgttatcggagtatatttattttttatttactatgcaaaaggttatgtttggacaatggacacgtgtgcgggtcatgcttccataaatgactttttacctactccgccacaccttttactaccgatggaactgagttttactggtgggtccgtccgagtttcattttttactactaccttttctttgccataaaaaaataaaaggggaaaatggcgagccaccctgccgcgtggggcgtctactattctttctctcctctcgctgttcccgacggaggaagggtggcagtggcacgcacgcacgccggcctcgcctcagcctcgcctcctcgcgcgcgcgcggccggacgggaggcacacggtgcgcggccggccggcctcattcgctcacctcgtaagccttcctcctccctcctccgtgcggttccatgatgcggcgaggcgaggcgcggattggggttggattggtttcttttttttttctcttccaattattgacttcgatgctgcgtgctcgccgtgctgtgctgtttcttccggatttctttgatgcgcgctgcagtgcttaatcgagagggttttttttttgtttttcttcgaaagggtttcaaccgaaataccgaatccccctctgcccccaaagctggtttcgtttgaggtgtagccgcatcttcctcttttctttccttttttatttttgggtgagggtttggagtgaatcttctatcttgcttttgcttcctgtgtcgaatgcttggagttcttttgctggaaaattcttcatgaatatctagcaccatttgcagcttcaaagcagtacgggctctgttcatcggtgtaatgcgttcgtattttgcttccttcaaatcttcatcctgtcttgcattttatatcgcccgcattttctgaagttctctgagctaatgtggagtcggatatggatttagggtgatctgatttgatgacggtttttatggtttttttcttttcaatctgatgcgcacaatagtttgtgcacggacaataattaagctaacggttagcaattatagcatttggtatcaacattttcattacgagtttcatgccagtctagatggtactgtgtacttgtaagttctcagtgacaacgagaaacagcagaaggatgactacttccagtaaaccacttaatcatttagattcagtccgatcaaaaaaaatcatttagattcagtgattttctgtctgcttcgatgagatttagtaaaccacttagattctgtattgcatcgccgttaatcattttatttgttaatcattttatttcataatttcttgtagctatgctttttttcttttcatggttcatgtgattatgtgaaggctcttgaatattttggtttcttgtttcaacaagttgtgtgtgttagctcttcctctactattgctatccgttgcttgaagttctggcaattgtgatgttgactatcagcaagttcctttactatacacactatttgttccttttcataagtcttaagcagaaggtacgattgctcatttgtatggtaagcatttcaatattctgaaatgcaggtcattgaactatataaaaaggttgtttgtcatgggtatttcatcgaagtggtttaaatcactggttggtataagaaagcaagaaaaggcccggaatgcagaaaaacaagaaaaggcacaaaatgcagagagctgcgaaacagtaagttatggtattcaccaagattttgtatcgtgtaattatgtagcaagtacttgttctgatcgactaagtctggagtaatgattgttttgtctgtcttcaacttttttccttttttttgtttctagtgtttagagccagcttgataggtggatattctactgttttttgtcttcctctgtcagaacatgacaaatcttgaagagtgagcaaaattgcaaaagagtagatggtttaccagagttggttcggcggatgccacacaagtgctgttgttgacatgtcgttgtcacatgcttgttgcacaactactcttctgagtgcccaacacagattatgtggcaatacctggatattaaatgttctgtattggtgtagtaaatgtttgggctccttacaatatgccattaccatcattgttctagtgcttgtaaccctcctcacctatgaaagaaaaccaaatgggtatattggagtactgttgtggttgctttggtttttagtgtcctactggtctggtaattacagatagaggaatgactgattgttttgtgtaaccaacaaatgattgcactgctgtttattccttgggtgtctgtctttttttcttgacttcttttcctttattctacttcgcaatgcattactatgcaaatgcatcagccactgcccactggagtgttagctatttatttaaatgtagcatgtctaacttgcttggattaaagaccgttattgtagttgtaataggagtattcatgctgttcattttgtttacttccattcaattaaataaaattttaaattattaatatgatatatattgtagtttagtatcgtagtatgtgtttcatgctgcccttgcccaaagtatcactttataagcttgatttcaaactaccagagtgcattagtatgttttaagttttgagaacatattccttcttgactctttttgccactgctgtacaagttggcatgaactgctgtttttactgggctgtcttaccatcatgacaatgtattaaaattattgtagagcacccctgctgctcagttgcttcacaaacggaaacattctttggatactgaacgtgcaatcttagtagaagaacttgcagtgcaaagtgaaccattgactgatgacaccaacacgcagacagtttcagattccatttcttcagacagtacattgcttggagtacatatttctcaaaccgaagagcataaaactaaagaggatgtggctgcaacactcattcagtctgcgtttcgagcattcctggtatgctccctttgaatatcactatgctagataactgatagcatgctgtctctggtctctgctctgcatgtatagtaaacacactaatgagtgtgactgtcttcatgttttgaggacttatccaaataaacaatgcagaaattgtcagaatgtgataagagcaaatgtattatatttgaacaagataatccaagaaaaaggagaaagtattttagtacttagaggttctagttaatttttcaaatatctagaaatagtcacatgaaactgaatcttcatttgctaaattaaacttaggaaactatccagatgtagtcgtttgtgtataacatagcatagactatgaaagcaaaaggctttagtaaaaacatagctcatgattttcaggcttccttcatagtcttctgtgtttgagaatttgaactttttgttgcatttatgattaccaggctagacgggctttacgggcattgaaagaaatagttatactgcaggcccttgtaaggggtcatatcataagaaagcagacatcagaaccccttcagtgtatgcaagctctagtaagagctcaagctcgtgtcagagcaagacaagttcgtgtttctttagagaaccaagttgcacggaagaaggtccctgaacaagatgatcatgagaatcatgttcgagaaattgaggtaggtcacaaatcctataaaagtcattatgacaagatactgagacctatatgcttggatgtcttttcctctcctgactctacatatcttgacacataatctttcttccatcgtatagattatcaccttgttataaatttatcgagtgatatgatactgacatgtaaattttgctcaacactgtggataaaaaaatatttctgctccctccctacttatttgaagatggcactttttttaatagctatgttgcaatggaaatttaaaaagaaaaccccactgtacactttaaagccctaaaaattaaaataaaatcattcctatcgtaaaatcttcatgtaatatttatcatcattttgcacctcattttaagataaaatttcctcactattttacttggggttaggaaagtgacacaagtccacctacctcactattttagggacctacatggcagtggtggtgggtggtggcagatttaccactcaccactaccattgtggtctttctaaaggagtacagaaagagagcagatcatatattaatccgactttcaagaaaaccaaggaaatcacattgtcttcacaggacaggaaaacaagcaaaagtaaaccaaacatttggtacttgacaacttcaaaagatcccctggcaacaactccaaaccacgactgcctactgactaaacaccatgatagaagcttcacatcacatcagggagatcatttgtcttcacttctctcactcacatcatcaatcttgtaacccactcgtccaatgcctcctttccttcctctttttgcaaaagtacgctagtgctgcacaaaagacagattcataagcaacatgcaaagccaattttactaacacgatctcaattacccagtcgatcctagtaagccataatgatcagcagatacttgccagcagccaaactctggcaaaaccccctggcctcaaagacagagcaccacttatgtcatagatgatcacattatgacgcaacacatctctgacaacacaccacacaaaccttgctaagggtcacaagaacagggtgtgattgatagtttctctctttgaacataactagcacaactcactcccctccactttcttcttggggtgtcttttcttgttcttttcttcttttctttcttttctttcttctttttcttttcttttctattaactgaacaacacattgagttctatcactaacagctaggaaaagaaaatgtttgagtttcaaagatattctacttttccacacttccatcatctcttgatcaatctcccctccaaaagttagcaatccgtacatagattttgaacaataacctttttctgctcatgaggccaaataaatctgtcaggatccccatctaaactaatctctcctatcagctctatcaatttgcttaaatctagtcaaccctctaaatattgggaaacactttttgtgtttgaagatggcactttttgtgtggaaacaatatatgttaagaaacgtgactatactattatgcaagttacaaacaattccttgcaccataggattggcttaagtttcatgcctataccattctgggtaaagccagacctcaacctggctagatcatggtgcagtccgtaggggagatgggatggtgatgagcactggcgaaggaggttgtagcaacaatggcatcagtgccattgtactgcactactgctagtatcagatggatttggacagagtggggaggcagagggtgggttgggattaagaaaacaaaatcatgcattactgctagtatcagatggatgtaaatggagtgaggaagcagaggatgggttaggttaagaaaaaaaaagcttggggttgacttggccttgagtcgacacctatataatattcagcttttgtgtggtttatccctaacgctttgaatgaatagtgggttatattcatccattaactgttctttgtagcattggaataagtcactgcctgttgtaccaataacttacgtgtggaaaaatagaaccaagtaatatgagtgggataaatatgtttcttggcagacagtgttttataatgttgtttacttctgcaacaataaatgcaggaacgctggtgtggcagtattggttctgttgaagaactgcaagctaaagtattgaaaaggcaggaagctgctgctaagcgtgagagagcaatggcatatgctttgactcatcaggtaattttggatggtatacctatatacttctgtacaaatactggttgagagttggtaagtgaggtaaactttgattagtagattagtagtctagcactcaatgctttgttaaatatgtgtgttattatagtcaattagttaggaagtcaatgtgataatcaagaaagatagttgtggataatggattttatctacttaataattggtgggtaactgatatttaagttacttaatgacagtatgttacatgtttactctggttgcaatttattcaatatatctatctaaacatagatttaaaaagtgatggtctgagtgaaataactgttgtgataaataacagtagtatcaaatactgatttcatatgtatttatgtttacctgaaatatatcattttttgctagatgctgcttatctatataattaaccagtaacatgaatgacgcctcatactttttgtgggctagaagtccctgcagtaatcagtgaaataaaaaatgatagaaatcatctcatcgaatgagaaatggagaaggactgctacagatatagatagtacaactattacagttatataacaagtattactatattttcagtcatagcatttcagttgtctagtgaatacaattgtatctccaaatttagctgttcggttcaaagtgcaatttttctagtcatatgatcatatcatagtaaactgcagaaatacacttatctaggtgttgctcgtgtcattcttttcactgtgaatctatatgtttatcggataaatcacagtagatcagactttttagatgccctctgtaatttttagtttcaactaatgatcatggaaaattatctgttgcagttgagaacttaagatttgagaatgctcttatgaatataacaacactgcatgtccccacaattctgtagtccttttcaatatacgtttagctctggagtcattaagttatgccttttgttttggtcagcgacaagcaggttccaggcaacagaaacctacaactccgcaaggacttgaacttgatgacagccactggggatcaaactggttagagaggtggatggctgtacgtccatgggagaacaggttgcttgacagtaacaccaaagaaactatgccactgtgtgatgataagcaggatatggaaacaaagtctcagatcacaccaaaggggaaagttcaagtttcaagtgccctttctaatggttctaacaagaagaaaggcataaaccataaaaaatcatattctgatgtaacttgtgcttcatttggacggtcgccaaatataccttcaacatctttgggatcatgcaaacaaaagtcaaagctttcagatgaagctttggaagaagtcagctcccagccaacagatcttgcgtctttgtccacatgccaaccaaaagccaagcttgtgcaagcgaatactccagtcaagaagtggttatctctgccaactaatggtaaacacaatatcgataacttatacatatttttttttctcggttttgtagtagtcttgttattggcaataattcagaaatctgttggacattatttggaacccttctctcctaaggaaaccatatactgtagactaccaagtagtgtttgctgcgagagttttttttttagtttaaatatttttataccactaatttaggtgttcaaatggtgcaatttttttccatattccattggcaagtaagcgtcatattacaaaaacattttttctgcaagaaggttgtacagctctttagttgatcagctgcttgggcccttgccgccttaggtttccattctcattctgattgttgtatgacttccatgtttgctatgcatcattctagaaacttgcttctcatctccttttgctttcatgtatttactcgaaaccaacaatgttgtaattcagcaagccatttattatgtgtgcattaacagttggtgggggagcagcaaagggcgcgaccaacagcaactcgatttgcagatccaccagtgccaagtctgatccaaaaccacgggcaaatgcttctaaccaatccaggaagcaagttgagttgcaggcctgattgcacattcccctttccctctgacttcggtaagtcatttcttatttgctgtcctccagctgtgcatgctacttctatgtacataatttttttccaagaaaagaatactgtatcttagatcttggttggtggtgtgtttcgtatttttcttgtgcacggttgtgggtatgtcgtgccatatttttcttttgcatttccatcagtttttttaccctcttgtatgttgttgtgagttttgaaagaaggaactatgttatgtctgaaaagtgtggtcctgtgcagcattgcagctgtctttctttccttataaattcaaatctgccccttctttattgttaaccctttgccaccatgatttgttcattgtctcattgataatgtgtcatcagatgcacgcccgcatataaaatcagtgtattttaagtaaccatactttggtgtaaacagcatgtgagatattttagcagccattcttttcctctaaaatacctttgatccctaattgcctcatggaaaggccattcacatttattctgtttgacgtgggccgtgtacgaattagtactactactatagtactattggcatataaacagaatgtatatggttgagctctgctgccctccaatctccatgattgagatctcctttttttttttttatcaagtgtggtgtgtggaagtttcttgtgaagtgtgatctgcacctctgcaaagcatcaggctctgttgctgctacatctttggggtgcaatcatgcaggtcaaagatgaatttgcagatctcttttatgattgaacactaataaaggtgagggttgcctttgggtgtaaaaagaactagcctttccctgaccctctctattctgttgttatcatgtgctgtgtcatgtgtattgtctgcttgcctcctctccatgctgttgtgaggatgttaacagtggagtgctgggtgcatgaagttcagatgttcagtttgttttttacctcggtaaaattcttcagtgttagtggagaagaaatgctggattcacatatcctattcatataggggtgaacaaaaaattccgaactcgtggctcggattggctcgtggcaagctcggcttgaaatcgtagtcttaatgagtcgagccgagcaatttagcttgtaagtttaacgagctagctcacgagttgctcgttagtacaaaatatccatatcttcgtatacttagcgcttcttaactagtgcttaatctttaattacatcaaattatttatatttagtgagtttttttattagtttctgtttatttttatgttaatacttataaaatgcaacaagtatatttgtaattattaatatgatataaatgtcatatagctcgttgacgagctagctcacaagctgagccgagctagtcttttagctcattaacaatagctcgttaagataacgagctcgttatccatccatacatgtatagcttcatttgctctgtttttctggtctaaaatgtgtcagtttggaacaatgaatttatttaccataatgtgctgctttgttgtgagttgtgaccactagattttttagatggcaaagagccaaagaggtaagaattgcaggaggaaggaatccaatgtgtgtttaacagtttatcatcttcgctggtgccgagggccaaccaatgggatcttggaaatatggggctttgcatcgccatgacgctgtggctatgcctttggttggggttgggacctcatctggatcagatctactcctatcctgccatggcatggtgctgcatgttttgacgttcttttaaaatggcctctctctctctctctctctctctctctctctctctctctctctctctctctctctgttcttttttaaccggcctctcgtctactacaaggccatgtttggcaaatgggataggaaaatgatttcccacccatcaaaagatatctttaaatcctaaccattcattctcccccttttatttaatcataacccttcattcatttcccaatcccaatcccacctctcatttcccattatccaaacacaccccaagtgtggatcttttcgttggtaggtgtgatataggagtacaggtatagtatgcgtgcacaggtagagacatttgtcctcgcggtacaagaagatggaacaacaggtctcacattttaaagagaaaggacgagtgggctcattatgcaactctgtgctaactatggatgaagattcaccaatagactggaataatgttctccttgtcttatttggctttcttcttttgtttggtgtggttgctttaatttagactacactcttctagagtcctagactataataattggctgtagctattttgagcaaaggccgggatgctttcgttctattctgaaaaaaaagtgggctcattattttttatttttgagtaaattgtactttacactagtaaaacacatccgttttactttacaccagattgaacatatactttcagtttatatcagttagcttcaaatgagtttcacttagcatcaggatacatcatcaaacatataaaaatttcatcaaattttacaaaatatgaaagaaactttgtgaaaagtggtctgaattcaaaaagattcataaggttcactcgtgatttataagatttttttttcagttatatgataaagtccactacagagtgaaatattttgatctatcctagcgcaaagtgaaaatatgtgctaaacttggtgcaaagtgaaacaatatactcattttttttggggggggggggggtaaatttcacgaaaccttagatattatgatttgtttcaagtaaccctagattttagggtagaatgtttcaagaaacccatgtttacatcaaagattcataattccattattttatattatattataagtatatgttcacgtcattagcctcaaaatacatatccctcccatgtaatttataaacacagtacaaagtctctaataatgaggtttattggaacattttgcctcaaaacctagggttcttcgaaacaaaccttaatacctagggttttgtgttatgagtgccccaaaatctagtgttttgtaaaatttattccttttttatttgaattgaggccaattatcagtttcacttaaacatttcaattttaggagggctaagagcatcaccaacagaatgtgaataatccacttctttttttaattattcggtttcctaaactgaaaataggtagtgaaaaaacccatctctccaagagagagccttaatttaattcaaaaaaactaaaaggtaggcccatactgaactaacaaccgaaaacaatagtgagcttctgccccaatagtgctcgctccttgatgtggcccctctacaagatccactgccgggagatcgatggatagagaaggcgcgcgagctaattttgggagcgagccctcgatatacgcggggatgagagtgactaaattttggagatgattagggatactgttggattgttttttttcaactaaaatcttaaaaaatcatgattgggaatggaataggggtactgttagtgatgctctaagttttaccctaagggctaccatgaattcacagttctccttggaaaagtgaaaaaatgaattcgcaactcagctccaatcatatattagagggaaagaaatgagaagatggtttagtacaatttcgtaacagaagcaaatttcaggcgaccgtcacttggaatctagacactcccttgcctaaaagagtgtagaaaagcatgtgaagacgtcgcttctattgtattgcaagcaaattttccctttgttttttgagatggtattgtagccgtaggcaagcttgtcatcattagatatcttgcctagaaaaaaaatagctaagcatgaatttccacatatcttttatggaaaaaaaaagaacatatggcccctaatcgttgacgcaagtatataccttatacgtcacgtgattttactagctatgtcatgtgagcacattcttaggccaatccacttggcacctgtacagagagaacaaagcccgcgagactgaatcaacaaaaggacaatatacatttgcttatgaattattatgttaagagtaaattgcacgcatgatgcaacaacttggcaggtgggtgcaatttgatgcaataacttgaaaaatgagcgttctagtacaacaacttggcaggaatgtgcaatttagtataagaactttataagtgatcgtataaatataacaacttgcaaggtaggtacgattttgatacaataaatgaagaagttatgtgacaacttaattatttaaagcattttttatataaattcaaaatttcaaatacttattttgacaatatactagcgtggatttatataaatatatttatatttttatcctaataattaataactgaaagtcaattaaactggatgtagacattatttcggttgatatttcagaaagtgaagaaaacaaaaagagtaaagtgcaccagcggtcctcaaacttgtaagggtgtatcatctaggtccccaaactctcaaatcgcatttacaggtccctaaacttgcttagccgtacattgcctgtccaaaccccatttgactcggtctgctcgctgacatggcttgccaacgtggaggggaggagacagccagggtggtgcattatgcattaagccccttattttttcgccagccctcagacgataaatcccccactgtttcgcttttttttccccatcgagctgagccgtgaaaccctagggaggctcgattcgtcgcctccatcttcagttcgtcgccctcttcttcaagctcggatgcggggcatccaattggttccatttggcgtatctagagtgaagcccttcaatttgattggcgccatggaagggggctcgagttcatcgtcgacgaatcggcggaagggaaatgggcgtctccctctgattaagtgcccttgttgcgattgtgagacaatcattaggcgtgcggctaatacgcctgagaataaagggcgcatattttacacttgcccttgccatcaggttagttcttctcttctataatctgtgttgtggtggaaaattttcaattcgcatcggtttgctgaggttaattttgtacattttttgcgcagcgagatggaattggatgtcgcttttggtactgggaggaacaatatgaggagtacttgattaatactgggcatcttgcatctcgtgctgtgcatattcagagtccatgttctgctgtgcgtgttcagacaaatgcaatggttcaacagggtgcacaaccatatattgaaaatgatgcagagcaaattgctaagcagattaaattgcttgttaggaggatgaacttgttgatagacattggtagggatattgttgccttattgagatgtgtagtagctgcctgtgtggttgttgcggtgacaaatatgtatgctttctttaggagtggttgaaatgtgtaatgtgtgaaatgcactaaaaatgcatggtgtgtgatgaataaaatagccagtttcttcaatctgcatctttgtgaatgttgggtctatacaaattttgaaggaatgcttgttcaattcatagaatatttgaggcacaatattgcaaaggcaaaatgaggcacacattcagtaaagaggcagaacatccatttcagatactttcagcacttaagtatcacaaaatgcaactataattctggcaatcagcaagtagccatgcacttgcactacagcatgcagctgatatagcatatttttaatccattatatacatcacagtgtgttgacaaccaaaacaccattttttgtcagattgtcactaaacaaaatatattcccagctaactaataggcattaatttgttccaatcccaggtgcaggcttcttttttgatgcggcacttgcagacttcttgtttccagttgtggtctttcttttcttcagtgccactgacttccctaatttggtgttggttgtaagaggagctggccttgctgatggaatgttagacatgataaaggcaggatctggcaatgggccttgttgttgagatagcacagaactttgatttggctgcaaaattcagaacatatatacatgataaatagtttgcaatgacaagtagtttgcaatgtgagattgaaatgattgaaaacaacattacctgatcagccatctgactaaaaacagtgcttcctagctgtgatagtagttgagatgaagtatgagaagcagcaatatgttcatctatgacatcctatatataccataggtcatgtagttcataagacatgcaaaaaaaacatgtgcaacagaggagttatgttcagtgatattttacctggttgataacatttggttcttgttcaatgatattttgttgaatctccattgcaagtgattcttttgctgtggcaaccatcctctttgcctcctcagaactgatgccctgcttctttagtttacaaccccctgagttgtgattttcttctccacaatacttgtagtgcatcatcactccatgttttgtcagctttggaccatttttgccaattacttcatatggtgcctttctcctagactttttgggcctgccagccttcttctcatacacaggtggcttaatctcaggaccattgacattttcccatttgctcttgtcattgcagggccaaatgttgaaaccataggctttactgaatgcatctgtagtgtagcaattagggagaatactttcagcatttatcctctcatgcctaagacaggatatggcatgattacatggaatccctgtcaagtcccacctcctgcaatcacaatacatagcattgatatccactatgtactgatattccctttcatgcacttgaaatattccctgcccagctggtaatgcataacatgtattagctgcatctgcatttttcagcaccttcttcctaattttggggcagattaagccttggaactgatcagccaactctttttgtttattgaaatgcctagtcatgagttgtccttttatcttctctagcatagtcaaaataggtaattctctagcttctagaatgtatttgttaaaaacctcgcaattattatttagtaatatatcacacttagggaattctgagaagaaagctctgacccatgtgtttggaggcaacttttcaagccattcataagcactcttgttcaaatttctcatcacatccatatttttgttccattcttggacagaagatgacctagcacatgcccacaattgattcttcagtacttctcccttaaactgaagctgaaagtttgagtacagatgcctaacacagaacctatgttcagactctgggaagacctgttggacagctggtattaaccccttctgcttatcagtcattatagtccaaggatatgtgttttcgatgcctagatcatttttcagtgtctccaagaaccatttccatgtagccagagattcaacctccactacagcaaaggcaattggatatatacagtcatttggccccataccaactgcagttagcaattgtccaccatactttgtattaatgtggcaaccatccaaacaaatcaatggtctgcaaccattgagaa

SEQ ID NO: 30837 - DNA, 1131 bp, Oryza sativa
gcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaaagatgagggaatacaaatagagaataagatgatgctgggcgataaggtacgaccttaaatgaaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatg

SEQ ID NO: 30838 - DNA, 2777 bp, Oryza sativa
tcattgttttctattcttacgtatgttcattagtacgttacctgtacatacgtatatacggggatggatgcatatgtccgcgcagggtacaggggaggactaaaatcagtttaatttgttttctttttccggtgtatagtaaggtattagtttctttttaaataaaatacatctgatctaatctaatggtccaaattatcaggtccaccgatttaagtgaaaatcgacggtgagattagacattgccacgtggcagtctaggagcgtttgtagaagtgccacgtggcggcttgagagcgtttataggaagtttaatggacttttatttagtatataatagatagatagatagatagattgcagatggaaatgtcgatggtaataatatgtcctggcatgatcaacattggcaatttcattttcaaaatatgaccacctaatttttaagtgaaatatttataatactttgacaatatgttttattatttatttttttataaaaaatacaaccatataattttaatccattacaatctaatcgtttgaaagtactttgttatcaaaagtgagatggccgtagttaacagcatcagtaatttgaatggtatattttatttgacacaaataagtgcaataatcatagtgcacaaatttaacatgcaagctccaagcacaataatttaagggtgattactatcgtgaccttgacataataataaaaaactacttaatccggcagacagtaattcatagaagtagaacttaagtgtaaaaacatggaaaatttgctgtcatgttatcgtaactgcactatatggctatgtaatgtttgaaccaaagcgaattagagcaagcatgctgacttatttagaataaaagcgtatatgcattctagctttgagaagcacatgcaacgcggtgaagttagtttctgtgaagatatatcaaatgctcgtcgctttgatttgccgtgccttagatctatatctgttgtagctgccaatgagattagttaagaataatactgttctagatatgaatgtgttttcactaatgtgtaggttatctgtttgtacaaagtataatatgtgcgtacgtactttcttcgattagaaagatgttttcaattcttatggataagtagaataataaaccgtacgggaatcaaagaattatgttgcgttgatctaggaactcactgtcttttcttgcatagcagaaatcgggtcattagtttgaaaaacgcaagagacatatatactacccttttaacaaatattaaccactcttggagttttcacaagagtacaaaatcggctgctacccaagcatttcaagaaatgtattacttgtgatgctaaccctgccaattcagattctataagcaaatgcaaacatgctgtggaaaacaaattctgaccagcggaatggagaagaaagagtaggtttacatttgttagaacaaattaaaattagatactgacatgtgagtcaattgcttaagtcgaacaaaaaagtctccctccggtcaaattttatgacattttactgttttctgaaacgattgcaactgcgataaattttatatacttggtttaatcatatgaaatggtacatgtgtgtatttttgccatactgaaaagtactcttatagtcttaattataaacttattagactttataaatctattctattaaaaaagtaaaatgtgataatcttctctctttatatattgaaatttagatttaccatcgtgggagatgcatgctagtgaccttacatgaccacacatgtcattggcatgagatggtaatcgcgcaattttcgatcgaaacaaaggatatatgatcaaatttcccactaaaacaaatatgattttatcgtcaaaacagtaaaaagaatagtcaaatattcatatgtagaagtacttatttccaaaactatggcactcacatgtggattttagtgacacatgatgagccacaaccgttccacatgagtaattaactaacttggtccttcaatagcaataagaatttcctaatgtaataattttcacagaagcatattacaagtacgcctaaaggagatctcttacggactaaaaaataatataaacaatgtttaccaaaaactagtcagtcaattcaaaagcagtgagttagctatattttgcatttcgatgtttgtgaagattaagccattttttttctttctgaaaatagcttttttttttcatattactcatttgaacaacacttccctgacatgcataaatgccaaggttttcattgaacatgggacctaacaagataactgaacaataactccgtactactataaacgtacacacccatcaaaccctttactaccagatggttcatgcttgatctataaaagggaaataagaaagattggaaaacgatggggatatggaataagattaatcgagtagttgtgtaagaatcagataaccgtaagagtgagaggtatcattcagagttgagatttgagaatgataagcatcgagaaaacaagcgaggggagcttgaagcgacatcgataacccaagcttccggacggtacacgatccaaaactcatgacgaacattcggcgagaatcagacaaccgggcggctagaaagtgggatggatgggtgatagaaaatgcaagatgagttagcacagcttcttttctctcctttggaggccctacttgttgctatccatcctaacgttttgagaagttttttttttttggggggtgggggggggg

SEQ ID NO: 30839 - DNA, 5467 bp, Oryza sativa
ttttttttttctaaaagaacgaaatttccactagtgtcacgatcgaaagacgaaataaagattgctcatttgagcattcggtccatttcctgatgtgcgtacataaatgctcattcacaattcagtccaatcaatttgtgacctgacaaaattactgaacaataaattcaaacacacaaccacaaaactttgcactacatgataattcatcctggtctataaaatgacacgaagaaagatatattagacgatgaggatggaacaagataaatcgaggaaatgcgcaagcattatggtgttgttgtgtgcatctacagttggagcccataccagaattatcattaaaatgttgaacaagccagaagcccaaaatgcttttccgttcgattacgcttgtaagttcacggttacttgaccgacctcgtacatttaggaagaactactctccgagggtgcttaattttctcatcaggtggtcgtgccgctcgatatggccaataggccaatcgtgtgcccctttcccatggctcccccttcacatgaaaccagatagaatttcaaaaacaattaaaaaataataagttttaaaaggataatagaaaataaaataaaaattaagtttaaaaagaaagtagaaaaaagataatatccatatgtatagattttacacatagtaacaaatatattgtaaactttatgcacataatagaaacattttgtataaaagaatatttaaatctgaatttaaatcggctatataaatttttagcttataaacattgggtataaggtgcgtaaacttttgatacacaatcttatacgaaaagaaaaactatgcagtgaaaaaagggaaagtggtgaagaaaataaaaaaatcgctcagggcaaccgatggctaattattgattttgactcctcgatttgaatccaattcgtggaaattatagcaatagctactagtataggaaaactacaatgcgggataccgttcggacatggcagtttaatggagactactatgatcactccctccaatacatacataagtcaatttgatttttgtgcgcaatcaagtgctcatgggcacgtgaaacacggacattagcagctaaccggcatacggacacgagcagcttactgaggtgtgctgcagccctccctcaagtgctcatgggcacgtgatacgaggaggtgggccacaccagtacctaagttggtaacatcacggtatgataaagctgcacaaatcaatacattcatttgtgcatactcacggtgagaagacatggggctttctaatattacatttttttatctttatcgttcatctctttagaaattttcttttctcattccggaaatgctataagatggtattccgttcggaatgatactggttaagtatcaagtccagatatatctaaggtattatgtcctgatacctaaccggtatcaggtgatatctctcaggtatcagttgatacttgcaaggtatgatgtcacctgatacctggtaggaatcgcctaatacaagataggtatcatctgataccgattagatcggcatcaaatgatatctcacaagtatcacctgatacttattacgaatcaccttatcctagttagtactactagaatagagggagactatagaaaagtataccgttccaatggaatagctaatgtacatgatatcagcatgataccagagagataacggatctggtacctccggtaccaaacatgataacccataggtattatcagcctcattggatggcatattatatgaatatgccaaatggcatacttataaacgaaaatcaagttgtgaataaaacttttatatatgtgtttttagcgatccaaaagtaaaggctgaaaaataaacttcgatgaaaaaaccccaaaatcagctccaaatttaacgttgaaaattcaaattttggttgataagcatatgaatatgccaaacgatggggacctatatctgatacctaggtatcatgatgacatcagcatgatacctcataggtatcagatctgatacctatgtatcatgttgacatcagcatgataccgaatatggtgtctccggcaccaaacatgatactccgtaggcatcagatttggtacctaggtatcatgctgaagtcacaattggaacaatatattgatctgttcaaactcaagggagcgctcgatgcacgtggggagacatatagatttttttgagagccatgtacattgatacatcacgctagctgagtccgtttttatccttatccatatcttgctcagggaggcggaggtgtcattcaattatcccatttggacggaatgccgtacactagtcgttctcagtacagtatagcacaggcatgtgggccctacttacacatgataaacccactttatacgttaattagatgacagcctggctagtactaacacagtcccaaattttggaagattcgatttttgacgattggagctaactgaaaatttggttgctaactttagtatcaaaaagccgtcgcagttcagttgtatctgtagttaattacactatgagcctcactttggttagattaccttggtagtgaactactaatcgagacataatttcaggaaaacttgttcttaaagttggataaaaaataatcttgttatgtgtttcaaaagctctgtttttctaaaaaaaaatgaattcagcacaggcacaacagtcccatacatgcaagcaactaattaaccagtttcatgtgcgtggtcacacccggacagttgagctcccaaaactagtcacaacatttggtggcactgatctaaatttccaattttgattttttaagattatgccaaattctttttcttttcaaaaaaacgaaattttcactagcgtcatgattggaagaagaaataaggttgctcatttgagcacctttctgcttatgtgcatatttttgaagataatggataaaatccagcttttacttcaacgaagaagctatagccaattatatcgtttttctaaaaaagccaaacatgaaagtatatgggaagacaactataaccagccagatacaacttattcagatgctggtgtgcatatataaatgctcattcacattcagtccaatcaatatgggaccagagaaaattactgaacacaaacttcacactgaaaacatacacccaccaaactttgtacagcatgatatataattcatcctcgtctataaaaaggcacaaggaaaaagatcagacaatggggatggaacaacataaatggaggaattgtgcaagcatcatagtattttttgtgcatttccagttgaagcacatgctctagttattatagaaaagaaaatcagagtgccacgagaatgagaggtattcaggaaacaagcgaaacacaaacaatgcgtagctgccagttactcttgcaagtgcaggatgaccacatgactgatcaccaagatttggtgagatggacaaccatgtgtggaggtgactgatcaagatcgtctgccttcactccttgaaagcaggagcatgcagtcagcgtttatccaccgtccaagcaatccgtcggctcgggtcgctcgtgcgcttaacagacgataaaaccagcaagccagagtagctgcatggcgtgaatcagagcacgttaatagagttgtggagggaaaattgagcatccctgctctgttttgcaccggaaatacagagattgagatgcaatatgagcacagccattaaacagtgattttaccccttcaaaaccgaaaagttgcaggatattaatttgttatattgttccaaaatttaccctcttttttttcctcaaaaattgaaattgagcacagacattccacgtgactaattaaccaatctgctccttcaactctagtatgattttccatatagtttagtaatttcaacagaagagtacacatacgcatgcgggagatttcttactgactataaaaataatgtaaacaatgttttaccaaagctagtccatcgattcgtcaacagctagttaactgtatttcccattttgatgtttgtgaagattaagccataatttatctcaaaacaacaaagtttgaacaccgctttcctaacgtgcataaatgccaaggtacattcagttgattcaacatgggggcgaacaagataacagaagaatagctccatagtccatactgtacagccaacacacaaccatcaaactctccactaccacactattcatcctggtcctataaaagggtgtcaagaaagattgtacaacggtgcggatgaaacaggattaatcgagtaattgtgcgagcatcatagtgtcataagagtgaggttgagatcgatattcagttaagatctgggaatgagaagcattgagaaaataagcaagaggaactcgaagcaacagtgatcaaccaaatatccagattgaagacgatccgtctcacgacagacatttggtgagagctagacagcaacatgaagatatgtccatttgtacggtagcttttgcatgtgctgggaaatgggacagtaatatgagtttgatggtgataggaaaagtaagacgatttggtacagcgtcttttctctccttttgacgcacaacttgtttatcctaacgttttgagaagatggatccatttgtagaagatggatccatttgtgatgctcacccggttaatttggcctacatatatatgctcaccatataaatgccacacaaattttcaggtggaacagtgaaaaaatactgtttggataaagcttaatccacggttacatgttataaacagtaatataaatgattgcagcatatatggtgattccatttgtattcatatactttgatttgattttttttctgaagagagaacatacatatttaaataaaatcgtattttcatatgtagacttttatttgaaactttcatttcaaaaaattatatttacctaaacagtaaaaatctatatatactcattttttaatctatcagagtactttaaaaaaataaatctgtattgaacgatgtggaatttaacttacacgtgatgagcctgctttgttagatggaccgagtcgtaaccgagacccaatttcaatgaaatttagtttttgaaattaaggtaactgaagatttttgttatgcttttcaaaaactagtttattgtaataaaataaatcgtgcacagccattttactggtagagaaaccatttttggtcggtcgacccaaatccacagtagtcccggttccattaaaaaccgggactaaaaatgatttttagtcccggttaataagaggaagatctttaatcccggttgttgttctttagtcccggttgataactccaaccgggactaaagttcatttttagtcccggttgattccatgtcaggccgtgtcagggctctaggatctttagtcccggtt

SEQ ID NO: 30840 - DNA, 6868 bp, Oryza sativa
ggactaaagatgcccatctttaatccaccaaccgggactaaatatcgatttttagtcccggttattttgaaccgggactaaagatagcgatctttagtcccggattcgtagtcccggttggaaaaccgggactacaggggggttacgaaccgggactaaaaagcacttctccaccagtgtttgatgcgactaattagcccaatttccatgcatagtcatgtacagactgctgagctaagttataataattgtaaaccatatatatgagttattgtggttcaagatacatatatagatctacctgggtgttaacatgtggcatataaccaacataaaatagttatgcagttgcagaaaatcatgcaaatagcagattttagataatccaatttgcaattgtagtaaaataagaaaaatataacttagattgttgctactcacatactgtagatcaaacaacttgtaaatttgaaatctatttcagaactaataagaatagtggacattgtgattttgtgaacttttagtcatgatcgacgtacagggtaatttgtcacatgccaattaagatgaatgtgcttttgtgtaacttgggttacactccagtgttttatgaaatttattctaatacatttatccttgtgacatcatttatgtaattccttttttaaagaagtaaagattattcttgtactattattcttgtacagagggttcttacgaagtaaactattataagcacgccacatagcggcccacattttaatgccaatgagctatttttttcatttgcatgtttacgaatactctggcaattttttttctgaaaaggtcgatgtgttaacaaaaacatttgatcaatccttacccccaagtgcataatgtataacattctgtccatggaacatgggacctataacgacataactaaacaaaaatttgcactgaaaacacatacccctgtcaatttttccactggtcgagtatttatccagttgtataaaagagaagcaagaaaggtctgacaatgaggatggaacaaaaattaattgtggtgttgtgcaagcattagagcactggcaattttttttttacttttttagtgtgtgcatgtgtagctggtgtagatgcgatacttatcttgagaaggttggagtaccatgagaatgagaggtattcagatgagaatgagaagtgagaggcactgaccactggatgtgttactaatcgataaagcttgcatgtagaagagtttctgtgtcaacgtgctttaattttgggagaactcctttgctatatatataattgtattaagcacacatgttctgcctccatggtttattcataatttccacacaaaactattgataaaatagtgggttcatatgtttattagggttaaaggtttagcctatgcctggtgataatcaactttttgttcagatttatgtggatgatatcatctttggttgttcgacccacgctttggttgtagattttgctgagactatacgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgttttggatcctgatgaagatggtgaagctgttgaccaaaaggaatatagaagtatgattggatctttgttgtatctaactgcttctaggccaaacatacaatttgctgtgtgtttgtgtgcacgctttcaagcttctcctcgtgcttcacatcgtcaagcggccaagcgaataatgaggtatttgaatcatacattgagtttggaatttggtattctacttcatcttctatatgcttaagtggatattccgatgctgattttggtggttgtagaatcgataggaaaagtactagtggaacatgtcatttttatggtacatcattgattgcatggtcttctaggaaacaatcttgtgttgctcaattaactgctgaatctgaatatgttgttgctgctagttattattcacagattctttggcttttatctactttgaaagattatggtcttacttttgataaagtacctctcttttgtgataatactagtgctattaatattgctaagaatcatgttcaacactcacgcacaaagcacattgatattcgttttcactttttgagggatcatgttgagaagggagatgttgaattgcagtttttggacacaaagttgcaaattgctgatattttcactaaacctttggattctaatcgatttgcttttcttcgtggtgaattgggaataattcattcttttggcatggtttgagggggagtttgtacctcatagttttatcaagcaataatatgacaatgagaaaaattgataaacgagagctttgttctatacatatggtattttcttgtgcatgctagcaatacttcgaaggtttatttgtctctagcatagcttgtatgtattatagtcttttcatgagatttagatttttgcttttaagggagatgatgcatgacacttaaattttatacttgaattaagcaaatatgcaatgttgatgctagcatatggtttgatttgtaaatgctctatatatatgctttattgacttgttattcctcaaatagctttaattgctcattgtgaaaagagaataaaaaatataaaaaaatgaataccgaatccttgaaaacagtcttgacgacaaggatgtattctatgtgagcaaaataatgggtgccgaatctctggaaacagtcttgacaacagggatgtacccggaatacaagagaaaaatatgagcaaaaaagctcaagaaaaaaaaagttcaaaaaatactcttggttattttgtgctaaaggttatttgagaaagagtgataaatgcaataggtatatgtgtttagtgtttatttttcaacctatgtgcttgttaagatgttgcattataaatcgtatgaaatcatgaattttgattgttgatccaagcttaattgtaaaatatttggttcatggttatactttaatgcatgtttgttatgttctagatgggttcatctcctttttattgcaaatcatgacttgatatgctatatgtatgctaagctcttgaacataattcctatgcttgatgaaatcattgtcaaaagggggagaagagatgaatttttgtgaagcaaggtgaaaatttttgagaagagatgagttttggagttgttgagaagagcatgttgtttttggttcaattgggaatttctttctttcaaaaagggggagaagttttcttttggatttttgagcacgatgtgtacatttgtacgaagtgtgctttttaccatttttgttttttattttttccaaacaccaaaacattttttatgggtttgccaatgtgttcatcaaggggcagattgtaaaatcaaaggtgtttttgattattattctgtgatgaacaattgggcattggagattattagttttgatatttggaatttattcacgaagtgattttggagatgattggatttcacaggtgattgcaggattcgtcattttatgtgaccggtcagactgggctctggtagccggtcagaccggcatgtattgcacggtctgaccggcccacgctgtgttggttgtttgtttggatatccgtgattatttcataattatggcttctagatgtatattatacgtatgtaatactgttgtttgctactaatgagtcaagttggagatagcttggtctcagaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgcacatggttgatggagattccatatggcatacgatggaggtattatatgcgtatgggatgcggagtcgaatttggaaggagtccaaatttgatacgattggttatgtaaagtttctttcttatactagagggtttcctaaggtgtttaggactcttagtatgagtttgattcgtggctttaggctgcctacctcggatataaatagagggggagcgtgaggcttcctggtatcgcttttgagagcaattgagttgagttttgagttagggtttcgagtttagtcgaaatttttgtaaggagtgctgttggtgcactttgtaaacacagagttaatcaataaagtcgtcatccactttaagagttcttcgatttgagttcaccgggtttcagcggtctaaccggcaatataccagcggtcagaccggtggcatacgggcggtccgaccggcggcggcgataggcgtggcaggcatctcggcggttcgaccgatcgatctatatcggtcagaccgacagcatccacttggtcagaccggcagatcaatctcggtcagaccgacttccgtcgaatttgagggtaacttttatttccgctaaaagtttttggtttttgggtataccaaccattcacccccctctgattggcttagttcttgtgtttccatcctacagttaaaaaaatatgacgtttgactttctttattaacttttaaaacatttactatcaaaactagtcaaagcattaaccaatttccattgcgttacgcgcagacagttgagctttcaaaactagtcaaaacatttggtgagtgacccaattttcccattttgatttctttggattatgccaaattcttttttccaagatgaacaaaattttcattagtgtcatgaccggaagaagaaataaggctgctcatttgatttgataatggataaaatccaacatttgcataaaaagatactatagtcatttcttatatcggtttttttaggaaaatccaaagatatgagaagacaaatttaaccaaccagatacatcttattcagatgctgacgtgcctgtaaaaatgctcattcacattcagtccaaccaataaacctgacaaatttaatgaagaataacttcacactgaaaacacacacccatcaaacttcatactaataacaattcatcctcgtctataaaaggatatgaaagaaacatcagacgatgaggatggaacaagataaatcgaggaactgtgcaagcatcacaatatttttgtgtgcatatatagttggagcacatgccagaattatcttaagaaaactggagtgtcatgagaatgagaggtattcagtaaacacatgagaatccaaaaatgtattactgttcaagtatgcttgcaagttcagggttatctgactattctcgtactgattcggcaaacacttgtccaagccagttgtaagtgttcacaactttgtgtgacaagttgacaagcacgatcgcagcacctaaacgctttacggtgatatagagttgccaaccacctcgatctagccaaaaggccaaatcaagatgggttttgtagaaaattagctaaaccgcctagtggagccgatttagagatcaaatatgaagataactacctgtctcgtgggcaaaacggaaggttttcaggacaaacctacaaagaggtgtcgcactctcgcagcggtggcagacagtttacggcgcaaactgacaaagatggactaaaactagggtaaaatagaaaatatagtaaaagaacgattcaagtaaattgtattcgggggattacaatgaaccggccttgtcccttaaataagggttggtcttgccctctacagacccttatccatgtctaactcaggatataaaccaaagtaaacacgaaacatagccttcccgagcaaggaaacccgcgacccgatgaaaacagactcggactcgaccctgacggtcagaccgcccacatacctgaggtcagaccggccctactagccggtcagaccgcccacgtacctgcggtctgaccggtcctgtgaaggaaacctgacactttcaaaactttggcaatttttccctatttcgttcataggtactaaatttgggtgtaaccagtaagaccgataccaaatttagttatcttgtagtattgatgctaactgaattatttttattacgtgtgccatcatatcttcatccaacggcaagggcgaaggaaaaagccagcaaaaacaagcctcgtaggcctcggttgattataaaccgtaacggcgtatcaacgacagacaaaataaattttatgaatagaacttttatatatgtgttaataacttaaaagtccgtgtaaaaaagaagtacattgaaagtaccttgaaatcaacttcaaaataaaattctaaattaaaaatttggcaatggctgtctttttttttgcaaacaacgatggccgtaaaagactgctaatgggtttgttgtatgtttggtttgcttgttaacttgggtccggcttgttgtgcgcgtttcggccttttgggccacctggcatttgtattttggtcttatcttgtggaccacttgtgatgacgtctcaaaggcatttgttttgctaaggcgtgtaagttgggtcggattttgatcattattgtgggccgttttttctcttttgtactaaaatggattgaaatttatggacatcttgtatgggccatctgcactcatgtaatctgcattgtaatgagacaaaacataagggatagccatggacgagatctggggacggcaattttgaccatgagtgtaggtatccgcgggtgcccgacccgatgggcactggtatgggagtaatattttgctcacctgagaatgta

SEQ ID NO: 30841 - DNA, 1674 bp, Oryza sativa
acccctctcctaccccaatccccacaccgacggcggtggtatgggcgggcaatgaagacaggtagggagtggctacacatgatgtcggcgtgggtacgcaagaacggcggtggctcgtgtaggtgacgtagaaagcgacgatgcaggatggcatcgttggccatcagcagttgtggcttagcacgacgtagacgacagcggctcaaggtgacgacggtgatgacagttcagacaggcaacgacaggcaatagtgacggcggccaaggacaataggcggcgacgcagactactctttgagtgacggtgctaggtccttacccggtatccactgggcatgcgtgtgcccgctaggtatgtgcataggcacgaagttttgcctactaacccaattgcatattaccgggccttgggtcgagcatggttttgctctgcccatgcccaacccggcctgtgatcatccctagggagatccaataaaatcacaatgctagcacacgtgtaacttcttgatagtgatagtatagttcaaatgacaaagagatctgtactcaatttatagtactgataataaaaaacagtagtagtcttgaaggttgcacatatttaagttgaagttgcatatatccaattttaactaaatttaaaattgcacttagtagcggcctccctgcacgctacccacagtgaaaaaaaaggaaattggggagaggaagcagcgggttaactgagcgccattagcctgttgcccaaatgtgcacgtcacataggtggtgtttggatcagggacttaactttagtctttatatttatatactaatttaaagtattaaatatagactacttacaaaactaattacataaatgaaagctaattcatgagacaaatttttaaaacctaattaatccataattagaaaatgtttactctagcatcacataggctaatcatagattaattaggctcaatagattcatctcgcgaattagttcaagattatggatgggttttattaatagtctacttttaatatttataattggtgtccaaaactccgatgtgatagggacttaaaagttttagtctcatctaaacagggtcatagcctgataatacgcacgtaacttgcacaagatctactgggaaaaaagaatcgactgatcggaaatgctactgggcgagggcgatcgatccccccctcctccccctccctccctccacctggtttccttttttggcaccgtattactttcctattttagtaaatttatgcacctaaagtttttacacctcaagtttacacatctaaagtttagagaccaaaagtctataagtcaaaagtttatatatccgattcaaatttgaatttgaattcaaatattttttatatatagtatttctgtacatctaaagtttatacacctaaagtttatatactcgattcaaatttgaatttgaattcaaatattttctacatatagtatttctatacatctaaattttatacacctaaagtttatagatccaaagtttataagtcaaaagtttatatacccgattcaaatttaaatttgaatttgaattttttatacataaatttttctaactttttttttaattctttttgtgtactgtaataggaagagaaggggaggaggaatgggagagggggggg

SEQ ID NO: 30842 - DNA, 18554 bp, Oryza sativa
ttttttaaaatttaaattgaggacactggcacaaaaacgtcccacgcaaccaatcaaccaattttccgcgcgctgtcacgctcacacagttgagcgcccgcgccgagttccgacacccaacccagggcctcccgctgtttcccgccaaatttggcacgccgccgctgttgcctctccctctccgtttctcttccatttcctctccatttttagcttcccccgatcgtctcgtctccacccatccttcctcccccgccgcgccttcgccaccaccgcacatcatcgctcgcttcccggcggaacgcgccccgttccgccgccggcgccgcaggagaagacgactacgacgacgacgagcggtgttgtgtgaagagaaggtgatcctgaccgccgccgtacgccgccattgccgccggggccgcggcaccgcccctgatgggcaacgtctgcatcggcccgcgccgcaacttcgccaagaacgggctcctcggcatcctgcggccgcgccacgccgcgccgtcctccccgtcgcagcccaccaccacctcccgctccatccccgtcgtgctcccctcggcccccttcttcaagccgccgccgcccacccagaccgccccgcccgtacccgtcgtcatctccgagccgccgccaccgcagccgcagcccgaaccgcagcccgcggcgccgtcgcagccgccgccaccgcaggagcagccctcgccgccaccgcccgcgtcgtcgaacaccacccagcagcctccgccgccgcagcagcggcagcagtcgcgcgccaagaagccggcgcacatcaagcgcatctccagcgccggcctgcaggtggagtcggtgctccggcgaaagacggagaatctcaaggacaaatacagcctggggcgcaaactcggtcagggccagttcgggacgacgtacctgtgcgtcgacaaggcgaacggcggcgagtacgcgtgcaagtcgatcgccaagcggaagctactcaccgacgaggacgtggaggacgtccgccgcgagatccagatcatgcaccacctcgccggccaccccaacatcatctccatccgcggcgcctacgaggacgccgtggcggtgcacgtcgtcatggagctctgcgccggcggcgagctgttcgaccggatcgtgcgcaaggggcactacacggagcggcaggcggccgggctcgcccgcgtcatcgtcgccgtcgtcgagtcgtgccactcgctcggcgtcatgcaccgcgacctcaagcccgagaacttcctgttcgtcggcaacgaggaggacgcgccgctcaagaccatcgacttcggcctctccatgtttttccgcccaggtaaacaaacaaccggtcacgcaccatggtcgtcgccgccattgtcgccgtcgtgaggagctcgatcgatctgcgtggctttgcactgcaggcgaggtgttcaccgacgtggtggggagcccgtactacgtggcgccggaggtgctgaagaagagctacgggcaggaggccgacgtgtggagcgccggcgtcatcatctacatcctcctctgcggcgtgccgccgttctgggcaggtaggtaggcgacgccgccattgacgaacaaatttcgacctcgaatgctgaacaaatttctcgccgccgccggcgacatcgccgtcgtcgtcttcgcagagacggagcaggggatattcgagcaggtgctgcacgggacgctggacttcgagtcggacccatggccgaacgtgtcggatggcgccaaggacctcctccgcaaggtgctcgtccgggaccccaagaagcggctcaccgcgcacgaagtcctatgtgagctcaccactctcttggcaatccgccatggctgcttcctgcaacactgacactgctgttcttttctcgcaggccatccatggctgcagatgagcgggtcggcgccggacaagccgctggactcggcggtgctgtcgcggctgaggcagttctcggccatgaacaagctcaagaagatggcattgagagtgagcacctgtcttgcattgtggaaattgagatttgttcatggtgatggtgtgtgacattgattgggcgatcgattgcgcaggtgatcgcggagaacttgtcggaggaggagatcgccgggttgaaggagatgttcaagatgatggacacggacaacagcgggcagatcaactacgaggagctcaaggccgggttggagagagtgggtgccaacatgaaggagtctgaaatttatcagctcatgcaggctgtaagtttgtgctctaaacccctctgctaatcatattcacttggagatcttggttggtaaagatgttttctaaaactattatttgcaaattactccctccgtttttaaatatttgacgttgttaacttttttaaatatgtttgatcgtttgtcttatttgaaaactttaagtaattattaattttttttctatcatttgattcattgttaaatatatttttatgtatacatatagttttacatatttcacaaaagtttttgaataagacgaacggtcaaacatgtgctaaaaagtcaacggtgtaaaatatttagaaacggagggagtagtaattagttacatttaacttctagattggaatggcacagaagttacattttagactctagttcttcagatcttcttattatttttcagatcttcagatataatgtgacatgaaggaagcacactgacttgattgttttctgttgatagtcaaaggagttgcatagaacattgtcccagtccatgtagctcggcataacaacgattaagaacaagggaaatcgaattctttaaccaaatagtttagtcacatgttcttttgttcttctttgcctgtttacttattgacaaagtgttaactggtaaagactgaactgaattcatcaatgtgcaactaattgtggcaagtgcataacaaaacgtttatcatgttctttatgtaggctgatatcgacaatagtggcaccatagattatggagaattcatagctgccactctacacctcaacaaagttgaaagggaagatcatctatatgccgccttccaatacttcgacaaagatggcagtggatacatcacatctgatgagctccagcaagcctgcgatgagtttggtatcgaggatgttcgactcgaagacatgataggcgaagtagatcaggacaatgtaagatcatccaagaaccaatcctacaattttgcgctgctattagggttggcaactctaaccatgaaagattatcttccatcagtaaatctgatgtgttttgtgctattctttttcctgcaggatgggcgtatagattacaacgagtttgtcgcgatgatgcagaaaacaacaacagggttcgggaagaaaggcggtcataattttagcggttttagggatgccttgaagtcacatagctgacaatgttgtagtgttatattgtatattggtatacccctttctatgggaaatgttgttgtgcatacgtgttgtaaatgtaaaggaataggagttttgttaactgaagatttcaagcttattttcttgccggttggtgtcttgcaaaaacatccatcaccccacgttcaagcagataaaaatgttgttttctgcctgaacatttgaaatgctaacaattccctttgtccttttgaggcaacacagagatatacagataacataacaaaaacaattgcatagcagagttgaggtgtatgagttaatatgcacaagaaagtagcaatcaaatcatcaagcaaaccacaagccaaagagagcctatcttccatgaaagttgcaacaaagtttcactttttacagattttgtgggggaaattaaccacattggttgttggactaggtccactgttcccttcttcaggcatggatggtgagcagaagctctactatcgacccctaaccacatggaagcctaggcacaaggctggtaaatattgttgaggtagaggtgactctcacctctaatcttattcgtatcatctccgtacgcattaccttaccttttgagattacatatcatatagggataagtttctagatatctatagtactctgacttcacgtgttggcgacttccatactcccaatgccttccatactcagtataactctgtatcatctgtctgagtatgagacagaagtattaattcatcaatggtaagctaacgagagtgtgtctgtgtgtgtgcattgtgtatttgtgtgcaattcttcccgggagaagcagtataggctatatatagtgaggaaggcagctgggtgggtggctgaatgcagatcttaagagaactggctcacaacaagagtccacacttggagaaaaaatatatatacatatacttactgtaaatatgtacccgctattaagaaaacaaggaagatagcccacgcattcgcgcgggcatgaatcgtagactgtgttcgtgtgtgtgagagagaaagaagaatgcgcgcgacagagagagcgagagatagagagagagagagagaggggggagagcgagagactctcggtcttatccgcgcgatagagaccaccggtcagctcggctcgactctttagtgtcggttttttaaaaaccgagtgtcggtttttaattaaccgacactcatagtaaattaaaggtgttagtttttgttaaaaaaaagacacctatattatagaaaaccgacacctacagtctattaaaggtatagtcttttttttattttcatcccgcagaggtcggaaatgatatataggtgccggttttatcacttccagcacctacaacaccgatctctatgtgtctttttatagtgtgatcaaatcatatatgtatgatttagttactatgtaaataatctaacaacataagcatattagaatacttttatgatttaaatgctatagttgcctaaatgtttttgacgtaaattttgctttctattagaagaaggaaaataggagagataaatagataatagaatgaaaagagaattgggaataggagcgtacagagtacgtatgtatatgcatccgcacgaatagagtgagggtccaatttagagttagattaggatgggtggattacttttttttgctacatctattgtaatggtaaaaaaaaagatgggcccactaatttaaatgataatcaagagttagatgtttctttaccacatggcagcttaaaagcgtttgtagagtgccatgtggtgatatatgagcgtttgtagaaagtttaatgaacttttagtatataactaggaaggtggcccacgcgcatgcgtgggcacttatattattaaaagataagattattgtttgttcaaaaattttgtctcatagattaagtgcaaactaaagttcggataatgttattttataataatttaagggttctatttttcttaaggtatcttaaaaaccattcataaacttttgagtaagagaaggattaagtacttacgacttttgaatcattttttttctcgagtaaataagaaactattgctagttaattatcatatagtccatctatatgcataccgcgtagtatagccacaaataaaaattgcgagagcaagatactcaaaattcttgtgattaaatagtctcataaaggcgcatgatatagtaagaaaaagagagaagggtatgcatggaaaaaaagaagaaagggaaaaatgaaaaaagggagaggaagcgtacgtacccacgtacgtaggtgcatacctatgccatgggacgagaggtgggatcttgtagtatttagtttgttctaagatcaatttaatctaacagtttataatattggatgtcccgatttaagtgaaaattaagcagtggatactttgctgttttttttagaatttctaatatttgctctaatttattagagcaccacgtggcagcttgagagcattttaataaattttaaaggacttaacacatgtaattaaaatattaaccgcttaatatatatgtatggggcacatggtaatatttgttccagcttcctgcatgtttatatgcatgtagcttaatatatatgtatggggcacatggtaatatttgttccagcttcctgcatgtttatatgcatgtagagagaaattaattgtgtggctagcaagccattagatgtctaattaatagcaattaattttgatacctatttacagttgtttatagtagctcttacatattcatcttacgactttgattatccgttgattcccaatttacagattaccatcactcgcatgaaaaaaaaatacgtactatttaaggtttaggacagctgaaattgatgaattatctgatttatgttgtagctatttgagggtataaacaaataaattgacttctaaaaagttaaaatgtggtttaaaaaaggcaccatttagaaacttggaaagcgtgcaaacaaaaatccaactatgtaatctagaaaaaaagagggtcttaaactcccttataacacccttgtttttgtaagagttctcttgatattcgttaatatagtgctcagatttataatataatgatttctttcacctatatgaataaatagtacaaaatccaaatacgacataacacgatacattataattattctgtaatcaactctcgatttcagcttaaacagagctaaatgttagaaaaaacacaacccacagtgtttaattcttctctcgctacatcatacctttaattttctttccatgttattaacaaaattaatcatctccatatatgatttgatatgtggcatagcggtagtgctgcggcagtcgtgatcaccttagatgcctcagacacgacgctttacacacgtgcaaaaggcaaaggtgcagacgtgcattgtgcagcgggccaaaaagatgatttcggatactttatttattagcaaataatatatcaaatgatttaaataatgggtctagtggttctagtgtaagtgcatattagtgagtatagattttaaattgttaatttaatgggtacacagtatatagtatataatgttgtagactttattttgaaagaatgcattatttgagaataatagtccaatgtaataaaaatagtttcaatgatttatatagtgggtccatcagtttaagtgtacgtataaatcagttaatatagatcttaaattgtttatttgataggtacgcaatatagatgtgtaaactttattttaaaatagtgcattatttgaaaataatagtataaaataatgagtacatatgtttaagtggaaattatattacattattaatttaatggtaacatataatggtgtaaattttatttcaaaaattgtagagctaatttagttacatgtgagttgtatgatggtaaatttgtttgtttgtaaaattatggtgatttaaaaaatatccattatataaatgggaaaaagaagaaaaaaaggaaaaaaaaagaggaagggaaggaagcgtacgtacatgttacgtacgtatacccacacatgcgcggtaggaggaggagaggtgggaccccacactatttggtttgttttatgatcaatttcatctaatggtgtataatattggacccaccaatttaagtgaaaatcaaggggtggatgttttgcttttttttcttataatttctaggattttctttaatttattagagcgccacgtggcggcttgagagcgtttgtaggaagtttaatggacttttagtatataaatagcccgcgcatatgcgtagacacttatttaatgttgcttaactttttttattataaatgtttacatttagattatattttcaaaatagatcttcactctattttaaacatgttttagttaatatctggttatgacatattacatgaaaccatacaaccctaaatttatgacaatgacatgactttatgagaacaacatgtgtcacgataataaaacaataatggaataatggagtttttttatttctatttgtactatatgtgattttcttacctgaataaagtgttttttaaaatactaccacgataaaatctccaaaggaccatattgttggttatattttgacaaatatatataattttgcatatcttatttttcaacgcctttcataatcacataagatacctttactaattaatttagagaatgaatctattttcccaaacttatttataataactaattgattgaagtataattcatagtcacatcaatagagtgcatgacatacattcatcaaattatgtctgataagttggaattcctcaactataaaaaaaaatatcatgagtagtttattgcgcatgttaattgattgttcatttgttatcaaaactatttgacaaagagaaaaacatacatatatgaccataaatcctatgatggactaaatggttatattatagcaagatcactggcttgaaatatttttcataattattttttacatttatgtaacatttatgttgcccacttatcatatactattgaaatagttctaaaaattaaaaaaaagatgagaatcttaatctcagacatattaaaactaaatcatatctgcttaaaaatacacaactaaattgtgttgttttcaattattttacatatagagctttaagttagcattatatagtcatcaagtgttatttgacacctagaatatgatgtaaaattatttgaaataggaaaagtacaagttaccccctaactattacggtcgaccgaattaccccataaacccgaaaccagacatctttcaccctcaattattaataaaagatgaattaccccccccaaaaaaaaaaactcaacctggagtagttttagtcctacatggtagtccagtctgcatttaaaaaaaataaaataggtggggccatatgtgacactctgtaccctctctacccctctcctctctcacctctctctctctgcttctcttcctgaatcccattccccagcctctctcttctccctcccattgctactggaccggccgggtaggcacactgtcaccccgccgctcttctcctcctccttcgtctattcccctacgcttgcttgcttgattgatccgcctcgttgtctcatcgggagagaggcattggtgatggggatcgattaaaaaccgtggtgggacgacatgctatggtagacatagctgcggccatatttgttggccaagttctagatggcaggggtgtagcagaacctggccattgaggaccagcgcaggttctcgcctccggtacctgcaactctcatcatgcgacaacgatatgcaacggaaatgatggagacgacggcctcgattggaatgcgcatgtggctgccgagtcagctgaggaggagcggcctccgccgcttgccgcccctagccttgccgattgatatgtggagggagaagaaagagagagatgatgaaggggttaggaagagatatgatatatgggtcctaccattttttaagaaaatgctaactaaattgacacgtaggacgaaaaaccactccgcattggggggggacgtaattcatccggtattaatagttgagggtgaaagatgtccggttttggggtttataggggtaattcggtcgaccgtaatagtttaagaggtaattcattatttttctgattattattataacattatttattatatgttgacctcatatataatgatgtatttatgaacatagacatcaatattttatttaattagaggatccgactggatcacaaattagatatatgattttaaaataatttatagataggatgtttaaagagtattcataggatattttatttttatattgtaaacgatctagtttagctatgtatatttgcataactttatagagtaatatattttattttaaaatagtgtaatatcatattttatggagcatcgagtttttcagtggcactacgtacctgctttacgtatgttttttttacttattaatcgcttttatcgtaagtcggtacatgttttcttttcttccattgaagaggagataagattcattgtttcttctccgtatgtacgtacgtacgtacaaagataacttacgttttgtttctttgtccggcccacagtatagatgcgaaagtattctttttttttaaaaaaaaataacacatctaatctaatagtctaaagtattgggtccaccaatttaaatgaaaatcgacggtgagatttaacagtgccatgtggcggtctaggagtatttataggaacgtcacgtggcggtttgagagcgtttctaggaagtttaatggacttttagtatataatataatataatataatataatataatagatagatagaagatagatagatagatgatatatgatgtatgcggtgcatcgttgaatggatagataggttcagatataatctgttgtaacagaatagatattatctatccaacaacctgcactatcttgtaaaccacagtgatggttattatcaccaatatatgaacaaaggtgcggcccaagagggttcaacacttctgcacctctggtgcttcatatggtatcagagccccactaaaatcgcatctgctcgaactcatggggagttcatccaaggcgacggccagcaatccgctcggtggaagcacgatcttggagaaactctccaagaccaatcacgcggtaaggaaagcgtagattctgggattggtgcgaggagcccatcttgaagggcacctcaccggcacgacggcagctccgactgctataatcacgaagcaaggtgacaacgagctaattaaggacagaggtccggggacccaaatccagtctatgaagaatgggtggcaactggtaagcaaatcctggcacaggtagccacatgcagcacctctgcagagcaaggttcactttctcggtttgggacttttgatagggggtcaccgaaatcccgaaatttcggaaattttggtcccaaattttgagcaaaatttagttgaatttgaacaaatattatccaaattcatgaaaaaattgaaaaattgaaaaatttcggacgaactaatatcgtattggagtggactgaaatgatcgaaatttcggaaattttggtccgaaatttccaaccctgctgcagaggcgtgcaggatgcttgaggagatgtactcctcggtgataatagcgtgcttcatcaacactagaatcgctctcttcaacaccaagaagggcgatctagatctatccgtcgctgactatcgcaaagatgagggtgcttagtgatgagatgaccgccgctgtcaagaaggttgtcgacgatgaagatctcatctcctatttcattgctagctcgacgacaactttgagccggtcatctcatccattgtcagtaaaaccgaaccgatgattaatttctgggagaggcatactcctagtggcttggctttgagcagtgcctggcccgtcgacaaaccaccgaagcgacagtcaatatggccaatcgaggacgtggcggctaacagagcaggcacaatggcaaccatgaccacgggaacaatggaggctacaacggtgcaaaccgcgaccgagatcatggaaacggtgccaccggcgggtgccaaggaggagttgatactagacgcaagtgctaactctgctataaaagaggacatatataccaatcttggaatttacttttcactaatacagatatgtggaactagtacttgaagtatatatctacctatttttgtaattgccatgttggctgtctttgttgtttcattgggttggattgagatgttgttagttgactctttttgtcttcgccatggctatgatttttttctgggtccgccagtgctacaggaggtgatgtgtcgattgtgtaaggtgaaagagccacaaaattttatttggtcatttcagatttgctaaagttctactagtagttatttctttccgtttgttttaaactccaactttaaacttcaactttctctttttccattagcacactttccaaacttctagatattgtatttttgataaaaagaatatataaaagtttctttaaaaatcaaatgaacctatttttcaaatttataataattaattattaattaatcatgtgttaattgcttgctctggtttctgtgccaattaaaatctcagttcacgaacgaagccgctagcaggaatcgatattgtgactcttaacaacctcaaaagacatccctttcaaatatactttctccatctaaaaaacttaatctacaagggttaaccctctcttaatacaacgaatttagataaatggttatctagatttgttatgttaggagggatcacatcctcgtctaagttgagtttttttatttgacgaaaggagtattttgtttaatcttcagcaagtcagtccacacacgcaagattaaattttcaatagtacacaacctcactcctctccctttccgggtggggatggatgattctttagtttcctagttgtcattttcataactacaaatcgctgcaatccacgagcttaacttttggtctcatgcatgcatgtgtggtaggccaagaggcgacctatgtcgccaagtttgactccgtatatctgacaatgtttgtctgataccacatgggtgatgggtgtgcattggtacaatggacacgcaaatctaaagtcatgtcattttagtcatatgaatcaattagaaaaaaaagaatcaattgaaaagacgactgatttcgcgccttataattgttcatggtatagctggacatgacccggtcgtagactcggtagtactccccaagtgatattaatttatatggctctcccatgcttgatcccagcataaattgcgcccaaaaatccaagatcgccacttcctttctacacttgcttcaccatagaaggttagttgatcctagttcagctcctgcttaccttttctctctctctctctctctctcgctagtgacgcttactaattttatgcggcaaacattccctacatctgagaaagcttttctcagattttatacgacacacaacttctcttctgcaaattagaaaatgccaagcaatatttaatattttctttaattttcttcactttgtgaatgccacctatttttgttttgtattcatctcggctgttataccatgtgataatttggctcccatgtcgtctatcattaatttgagtttttctgcgtttgttcgtgtgttcttgcatgtcgttcagttaatgatcgagcaaccctctagcctccaggcttgttccttttgtaatgaacataggctgtgtttaattcgtgtgccaaattttttttaagtatacggacacatatttgaagtattaaacgtacattaataacaaaataaattacagattccgcccataaactgcgagataaattttttaagcctaattaatccgttattagcaaatgtttactgttgcatcatattgtcaaatcatggcgtaattaggctcaaaagattcatctcgcgatttacatgcaaactgtgcaattggtttttttcgtccacatttagtgctccatatatatgtccaaacatttgatatgacggaaatgttgaaagtttaaagaaaaaattttgaatctaaacacagccataaacacagccatagaagtgttcctgatttgttattgtacgtgatccaagaaggggaacttatatattcacatgtttctcagtcaaagtagttgggttaggtatcaggaaagtgtggttgtctaatctgatgaagttattgaatcagctcatagctttactgctaagatgtgtgtgttatgcagtattacatgtaccatccttttgaatcatattagagaacttccatatttccataagatgaatatgcagtgggtttcgcgatatacttaaagatggcagaattggattctttatttttatgaaagagtaaaatacacggccggtccttaaagttgagcgcgggtgtcacttaggtccacaatcttgtaaattgcacatctagatcaaccatcttgtttaagtgactcattgaagtccaaaggacctttgaccgggttgactggcttacgtggcgatccagcgtgacaacatatttgcattttgccccccattttgcttcccctcttcctaaatctctctctcacgcgtcggtggcgagcggcgaacggcgacgtggaggggcgggcatcggacggcggcgcacggggacggccccgctgccctcccacgtggcgtcgctgactctgcccttccgctccgaggctacgagactccatcgctgccaccgcgcctagctcgtcgctgtcgtcttcaacctgggggtgcggaggatggcgttgatggcgggcggcaagagaggaggcgtcggtgtcgggtgggagaggaggcgtcggtggcgagcggcgagagaggaggcgtcggtgggggcgggagaggaggcgtcggtggtgagcagtgagagaggaggcgtcggtggcagggagatccggtggccgacgtcggccccagtgacgtgcgctgggtgctgcgcctctccgccacgcccgcctcgccgatgcttccgcttctccgccattgccgcaccgtgtgggccgactgctggcccgcccccgcgcgcggctacatgcctttgcctccgcctccgctgccgactacacaagcgcgccaccggcgcccgagcgagccccgcctctcccactggccgctcgcgctacctccttctctgctccgccgacggccgcccgagcaacctccgcctccgctgccgctactagcgcccgagcgtcgtcctcgtcgtcgtcctccactcctccgtcgccattctcaatgccgtcgtgctggtgagctagtgaggggcggcgtggcagcaggatcccgacgctgccgcgatgttatggatcccggcgttgccgtgatgcctgcccccgtgctctcgcccaccgctgctctaccagccgcagccactcgcgcgtgtgtgtcgtgctagtgtgttgcttgctactggcgctcgcggcaccgtcggtagcggcggtggcgcggcatgactacaacgaaggatttggggatttttgtgctgtccatggcactactgttgcggaggggcttgtttgtaaaattggtgcttgtgtggcgtgccacgtcggcagtcagagccggtaaagtggggtttggacctcaataagtcacttaaacaagatggtggacatatatgtgcaatttacaatattataaacctaagtgacacccgcgctcaactttaagtatcggctatgtattttactctttatgaaacaatagatcaattcctactgagtatatattaatacgtttaaacaaataagaacagagttcagtgaaatcctactagttttatattattaataagttgaaataaaaacagagttcggaggagtcaaggaactgaaaagcagaaaagaaaaaaaaaacaaaaattgatgctacaaggattctagctgttctataatccaagatgaatgtcccaccatggataaccatggcgaattcattcttgcactgatttctgcattatgctccatgaatagtataattatctccatacagaattggacaggaagggagtagtattttactatttctaaatgatgcaatgacaaatatttccaggttgttcaaatatttttgttgcatcagtaatacttatgtaacatcataaatttaaaaattgttaacagagctgttcggaaataagtgctcaaggcagtgatctttttgtcatttgtgaccttagagattgggttgattttgatacatcttcctggtaggccacaattttgtcactacaaattataatcattttttatatttatagtcttataaaagaagcattttgattttgctctcaaatggtagaggcaggtaataaatggcaacgcaaggtaaacagtgcaacactctagaagatttgctattcgatgacataggagacccattgcctattaagctatcagtactgcaaagcatcacaaatgacttctcggaagagcagattattggaagtggtggcttcggaatagtttataaggtatgtctgactaattcttgattttatcagttataggagcatttcaaaacctaccatcttgctaatttcgaacaggaagtccatgttaccttaccaactgaatatataaatgtccaactggaaccgtacaactgaaccagtataccatatttttatactgattggagggtcctccaaagtcacatgataattcatgagaacacgggctgaaaaatttcaggaaaaacagaaattgacttagaaattattacgattgtctatgatggattaacatggctcgtcatagatgagtcatctttggtgggccaaaaagtatctcgtttaagatatggctaccggggaggacccgtcacacatgtcaggtcatctgtgacgggccataattgtaacccgtcacaaaatgatctatgtcatctatgacatcatagataatgttatgaaccatcatagatgagatcactcattttttaaaaaattcacggataaaaaattcactaatgagtaaaagttccaaatttcgaattttctaaaaaacctcggttggagaaatgccctatataaaagttgtagatctcaatataactttataactgacaatattttcattagagatcgtatacatccccaaatatgcattaaagtgatgagatctatttttaaaaatgaaaaattgactttttcaaatgacctcggatgaaaacatggtatggatcaaagtcgtcgtagagctcaaccagatctacaacattataattgacaatagttttatttgggatagtttacatgccctaaggtgagatctattttgaaaaacaaaattttaaattcttcaaatgatctcagacgaagatattccatatataatattaaacacgatgagatctaaaacattttagttgatgatgttttcatttgaaatcatttagagtgttaaatatatgttacatgctttggagaggaataactaaaacaataatattgaaagagaaatcaaatcaacatgtgctctatagttgatgagtttgtaagggtgctctttttagagagggaggtcttgagtactaaacacaacaaatgcaagcatatctacgtttctaaaaaaatgtggaattgtgggtagtgacatgtcatcatgtatagaatggatagctagtgaaattcaaatttttttaattttttttgaatgcgcatttaaagttcaaaatcatgactcgtgatttaacatcaatgatggttcgtaagttactacccatcagagatgagtcatcagtgacgggtgagaagttgtgacacgtcagagatgactcaacactgatgggttgaaagttactactcgtcagagatgactcacctgtgatgggtgttcacccatcaaagatggtattttgtcatcactggtcactttaactctgacgaacaccgaacccgttagagatgacgagttgatgagaccgtcatgtttgacctggtatggtgtagcaattaacatatagagttgaaaattcacagggagtgcttggagatgagcttgttgcggtgaagaagctttactcatttcatgcaattaaagacgaaccatttcaacgcgaggttgattgtctcatgaggattaggcactgcaatatagtatggtttgttgggtactgtgctgaaacatctacaaatgtggtacgaaaaggaagggaaaatatgtttgtggattcgaaagaaaagttgctttgcttcgagtatctacgtaatggaagccttcgcagtcatcttgatactggtataactatatgtgatccatttgctccatttatgatgttcattctgagtaaaaatatttacattgtggaaaaagtaatagaaaaccactagtgtatcggtaaatacaacatagtaataagaggtttgttgacctaaaattgtgcaaatataattaactccaaatttgagttgcgggcaaaattatggtatctacatggccagccaccactatatattgtaatggtcatatattcgaagtgcatggcaatggtgtgccaaaataaaaggcattatgaataattttgcaatttatactacaaggctatgatgtactatttatttgtcgtacagccggatcttgtgtgcttcaatggcagatttgttaccaaataatcaaaggtatttgcctgggtttgcactatctgcatgagaggaagataattcatctagatctcaaaccagataacgtactgctcgatgacagtatggtgcctaaaattgcggattttggtttgtcaaggctcttgagtgaagaaaaaagccgcatggtcactgagagaatttttggaacaaggttagtcaagtatgtgtgtgtgtatatatatatatgtgtgtttatatacatatgtatacatgtgtatgtatacacgtatatatatacatacgtata

SEQ ID NO: 30843 - DNA, 1676 bp, Oryza sativa
caaattcttatatctaggtatatactcccaatttgaaaatttttaaaaatttaagagaatttgtgtgtttcatataccttggagtccgggcactatgtagtcccatatatatatatatatatatatatatatatatatatatatatatagagagagagagagagagagagagagagagagagagtttcatatatctttgcaaatgagttttcccgtggatccgctttccttggacctgagattacaggtgtccattgatgcaggagatacatggcacccgaatacttagttaatggagatatcacagtcaagtcagatatatacagcttgggtttgataatcagagagatggtgatgggtcctaataatgaaggaacaacgacagaaaatgtatattcaagaagaaataattaataatcagtactacattttagattgtttgagttaatactactacgtgtgtaactttttgctaatgaaattgaattgcttgtcaggtactagaaatctggaggcataggttggaacaggattcatcaaagatgaggcagacgccaatcgaaatgcgttaccggcaaataatagaagcgtgcattgagatatcagagacatgcatagcgggtaaaccagataagaggccaaccacaggggatatccttcgtcggcttgagaaagaggaagcagggaattggtctatcgtcccagttactccagttgtagattgggtataaataaatcatctcttactataaaattattttatagatcactaattcctaaaatttaacatgcaaacatatcatatcatcatcaactaataattataataattatagtcgatataccgagttttcattgcaaacccccaagatattattactacatactaaggataacaacatttaaacatcatgcaacatgcatgctatattattataatttattaatctaatagttttagagatttaaaatgtaaacttgtcaaatcatcttacataattcgcataatgtttcagtatttctctccattatttttctataatatcctatatacctatatagttcatccttatttagtttatgatatttttcttttctcattaagtcatagcacatcaattatttttagtccttagatgattaatttatggttcaaattatctcttttcttttcttctctcattgagttatattatctcaatttttttagcacttagatgtatggtctaaattatcttcttttgtttcctcataaagtaacatcatcttacttttatatttggatcatcattctatatactatttaaatttaattcacattaacttacgtaaacttatgtttatttaagattatgttgtttaaactatctcacacttttttttttactcatttttatcatagtaaatttcgcaacagcgtaagggatttcatctagtatgcatatatactatcatgtcgcttgaacagtacatctttcattcaaagattcaccaagtacatccaaaaagctttagatgatgacgagtatactgaaaagtaattaccgtgagcccgaatgtttggctgaatataagtactccctctgtaccaaaataaacgtaaccattagtttccacatataactttaatcgttcgtcttatttattttttttaaaaaaataaaaagcataagtca

SEQ ID NO: 30844 - DNA, 6637 bp, Oryza sativa
  unsure (1)..(6637): unsure at all n locations
gatgataaaagttggacacggaaactcatggctacgcttagggctgtttggatgggggactaatctttagtacctgtcacatcagatgtttggacactgattaaacatagactaatgacaaaactcatttcataactctggaataattcgcgagaggaatttgttgagtctaattaatgtaattcactgggagtaccaagcatagacacaggcaaataagggaaagggatgtcttaactgaaaacagagaaagacaaaaaaactaacaacaggctctttcattgccgatcatttacttcgaatggttctgtgattagattttattttgcttccgtggcagataagctcgctatccaggttgatggagagcataaagcgaatggctgtaacttcacccgaaccgcgaacaattcgaggtgaggagtccaaagcgttgcaattgcaacctgggccttctcagccaggggacaggagaccagctgataaggtaaatgaagaaacaaaagcccaaataaatattaataaattgatttattaacatttatataaatatagacaatactagaaattattatattgtaaaacggagggagtagtactgacagacatttacagaatctactgtggattatacttggtaccgaacaatccaaatttttatattggttgacgaacgcatgtagagtttttggttggatgctacaagcaacgccaagtgctacatgctatcatcgagattattaaaggttacatggggagaaagcccccagcactgaaaatggatcaccctccccgattctaggtaaggtttccatactgagcaaactttcaaatctctacatttcatactataagtctttgactattttcttactgaaagtactttaaatttgccctatgtttatagtaaaatataataatacctttaatataaagcaaacattgtatcaaaatatatttgatgctaaatttaacggaactaatttggtatcataaatgttgctaattttttctataactttggtcaaaattaaagaaactttgagttaaaaaaagttaaatgacttacaatatgaattgaaacggaaggtttattttctccgttggaacaaaggtctattttccaaatccatgaaacaggcacatgtatattaatttgttttgttttctctgctggtaaaatacaaaggcttgttaatttccaaatcctgaaaacatgcacatattaattttttgtgttttatttttcctctgttggtacaaaggtttgccgaatgcgcggagctcctaaacgtgtactggctggcggtgattggggagatcgcaacggaggacctgacgccgggtactcgctacgcggtgtacctggtgtacaagctgacgggcacctccgtcggctgagaggtggccagacgcagaggtcatcgctcaggctctacggcgagatcaccgtctccaccggcaaggtcagcgtcgacgtcgtccctgcagcggcgcgcggaatggccgccggcgtggcctatcctgtggccaggggagacggctggatggagctcaagctggccgagtttgctgccgacgagaagctgctcggtgagaagaaggtgatagtggacttccgcgaggagaacgaccatgtcaagaagagtggtcttgttatagagggcatggagttcaggcccaacaagtgaagctcgcaaaaggctcaacattttgttccacaagaacaatttctagtatcctaactattctcagcacataaaatgacaagttttatctctttaatatactttatctatctatcactgttagtattttaataatgatgagatattttgatcatttttactctcaactaatttcaccgtgagataccactacaacaaaacaacccaatcaatggagacatcttatttgtaggttagagacgaaacgtctcccatagataactgggacgctttataacaaaacaacccaatagagacatcttatttgtaggatagagacgttttatttcgtctcccacagataactgggacgcttttataaagcgtcgtagggacgcttttataaagcgtcgtaggaacgtctccgtttgcactgtcgcgtacctatattatttaagacgttgctagagatgtcgcgtacctatattatttaagacgttgctagagacgtgtaaattgcatctctacaaaatatcgagatgcttttatagaagcattaatataggcacgcacatcttaatatatttgatattaacgctttcatctgtgctcgaacacagcacctgcaggttgcaaagttcatgcactaaccaagtcattaacgtgaacaatcttgaaggtaaatagatagtttttcttatattgcaactctgcaaacatgcatactgtagcagatacattaaaaggagaccggagggagtatactcttcttaaatagatagtttttcttatattgtaactctgcaaacatgcgtcctgtagcagatacatctcagcaaaaacaaataaaaattaataggacccgcttgttagcgttggtttttctctccaccttctctgcttctctatccgtgagaggacagagtgctgccagcgagggccagtccaaacaaggagggaaggaagggggctgcacgagctcagctgtcccacacatggtgagtgggcggccggctgccaatggctgggaggatatggtgggcgtaacggggagggcgcagtgggggttggagatggcagtgcactagcgagggggtcgtcagagatagcggggcagcggtgaggtgggctcgaggcagcggctcatcaatcccacgaataggaggtcgagcttgcttgggagacgtctctgcaagctcatggagggcatccaccatctcctccggattggcaaaaaagccaggaggaggtgggaggtggtggaaaggcttccgggtgaccgacgccgatagcagcacaatggtgaggcttggcgcttgtgaagcgagtgcgggagcaaaggaacccgaggagggtgcccctggggtcggcgacagcggctccgtggtggtagagcttgaagcgctcgctgttgaccacgaagaccaccacctctgtcccgggcgccattgccacctatctnactgncaagcgccgnctgcctcgccgaaaaaactgccgccgcagtagctttnttcagccgtcctcacccgtccctcgcgtataccattgtcggccgcgagatgcgagacgtgcgccacctgctgcctctatcggcgcccgtggctctgcttgcacgggctcaagcccctcctgccattgaccgctgtgcaacgctgatagacaccaccgcgctagctcagttcanagagagagagatggaggtgagggaagggaagggacaaaagagagaggatgggatcggaaatcctgtttggcgatcgatcgccctggggatggatcagcgatcgatcccctcccccctccctccctccacccctccacctggtttccttttttgccaccacattactttcctattttagtaaatttatacacctcaagtttacacatctaaagtttagaaaccaaaagtttatatatccgattcaaatttgaatttgaattcaaatattttttatatatagtatttctatacatctaaagtttatacacctaaagtttatagacctaaagtttatagatctaaagtttataagttaaaagtttatatatctgattcaaatttgaatttgaattatacccgattcaaatttgaatttgaattcaaatatccgattcaaatttgaatttgaattcaaatattttctatatatagtatttctatacatctaaagtttatagacccaaagtttagaagttaaaagtttacatacccgattcaaatttgaatttgaattcaaatttttttatatatagtatttctatacataaatttttctaacttctgttttttttaaaaaaatgtggagatgtgtaaacttgaggtgcacaaactttaggtgcataaattgactaaaataggaaagtaatgcggtgccaaaaaaggaaatcaggtggaggaagggagggggaggggtggggagcgaatctgatcgctaccccatccccacggcgatcgattgccgattaggcgtacccggatgggatgaagggaagagatagatggggagagtatgacatgtagggtccaccgaatttttttaaaaaataattgctgactagatttccatgtaggaccaaaaccaccccggtttgaggcagggggttatttatccggatttaagagtttaaggtgctgaatggccggtattgcagctcagggggcaattcgatcgacctcgatagtttatgggggttaattcatactttttgaaaaaggaagtggaaccaaatgagaacaagccgcttgggctgtgttgcttggtcggtgtttgtcacgcccagaaattcccgaatagaattccaagcatagtgtgcattaaaatccctgtccaggactggccggggtacacaaacgacaaagttgacatacagatccacgtcttacatacattataagagtcttatataagtgcagcggaaaaacaaaagataactggagctaagccttgacttgaacggcagcaggaacaccactccacaggcatcctcgacagcacggacgaagcctactactcggagaaaccaccatctgacgcatactcaaactctggggttggggaaaaatagagcaagactgagtactacccactgtactcagcaagtcataccggaaccggggtatgctgcaggatattgccaaaggatagctagagaggttcttttgcataaagcgagcatttataaacaggtgtttaaagcggtaaaacaattgtactaattaatcaatattaaccatccactgttcaacgctacaccacattgcaacaggcccaaccaataacctgaactaatcagttccatcagactacactagggtgagactaatcacggtgaatctggttgaccgcccataaccgtgggcatggctatttgaatagttttactctgatcagaggtgtacaactgtacccacaagacacagccccacgacatgtttccgtgcaccgacatggcaccacgacataccggatagaggccgtgacaggatccttcgcataaccccctctaaccaagcacaccacacctcaggtttcacccccactcatcgcaaggcagcgggtagtcccctctcgtgcctaggtgaatccggaagccgcatagaccgtcgcaggacccatccaaactccatcacgcccacccttgcctggatgcgtcagctagaggaaagctacactacaagcccagccgttgcccacgctggcttgtggtaagtacgataagttcttccagggcatcccgcgaaccggtccttaattgccatgggcgcgaccatcaaaaccatgcacccatagcccaccatgtgattgattttagttaaccaacaccgaagcggtggcactagtccagcattaacattagaacctacagtctatacattagtttgtattccccattgtgtgctagttgaactaagcatggctaagcaatccctagtccaatctctaatcatgtttatatcccaagttatcaaaggagcatggtaccaaaaatagcatggctgtaacagaaggtaaacatcccatagtattattgcaaaacaatgcagtatttgaaggaaaacaatagaccatttgcaatataggatcaatatgttcaagtgacaagcatgacttgccttgctctgctcctggaggaacctcggcgactatttcaaagtacaccggagcatcgggagagccggaatctaagcgacatacaaggcaaacaatacaaacaggctataagactactgaaacagagaacaaaaccattattaatggattctacacatttttcttgatttactgagacttgaatgggcttaaacggagctcggatggattagatatgaattttagaagattcacagtgattttactataaacagaaaaatccttaattgaattattgcacaataaataaatcccggggagagagagaggtggcgccgacatgcgggccccacatggcgatgacacgggtggcaatccgcggtggaccgagtctacggaccggggaagggacggcgcacgacgtggcgccgacgcggcggccacacggcagccacgtgggcggccgaacggacggccccgatctaccatccggtagatcgaacggcgggtacggctcgtggccggtgcgtgtgggcatgtctcaagccggcccggcggccatggcgcgcggcggcgtggcgtgcctgcagcggcgacgcgaggcggcgaccggccggcggcggagggcgacagcgtcacggcgacgcgggcggcggagcagcggctaagcggctaagcggctaagcggcgggtaccggcgcgggagagagagaggaaggggaggagggaccctactgacgatgaccgacgacggcaagcgatggagggcaacggcgttagcggaacgagctccgggatcaactaagaaatcaaaagggaggggttagagagggggagagagaccacggatggctagggtgccggccgaaggcg

SEQ ID NO: 30845 - DNA, 4134 bp, Oryza sativa
tctacatacgtcagatcttcttggatattgatgtgctctgaatcggcttgttcttcgggtaccctcagacacttctttaactgggacacgtggaacacgtcatggataccgatcatattggatggaagttctagctgataagcaacttctcctcttcgttccaagattctgtatggtcccacgaagcgtggtgccaacttgcctttcgtttgaaaacggtgtactccccggagcggagtaacacgaaggtacacgtaatcccctgcttcaaaagtgagctcccttcgaaggttgtctgcgtagctcttctgtcgagactgggcaattcttagcctctctctgacggttctgactttctcttctgcttccgttaacacttctgttccgaacagttgacgttcgcccgtttgatcccagaagagaggccgtacaatgcttctgttaacacttccaaccgtacaacgctttgaacggcgccatatgtagactggcctgatagctgttgttgtaagagaactccacatatggcaagattttgtcccaggctccaccaaaatcaagtgcacaagcccttaacatgtcctccaatatttgattgacccgctcggtctgaccatcggtctgcggacggtaggctgtgctgaaattcagccgggttcccaattcctcttgcaatttctgccagaactttgaagtgaattggctccctcgatcagatactatctttttgggtactccatgtagacacatgatcctcgagagatggagctatgccaaccttttgcccgtataagtagtatgcactggaatgaaatgagcaactttggtaagtcggtccacgactacccagattgaatcgtgaccagatgatgtcctgggcagacctgttatgaaatccattccaatttcttcccatttccattccgggatttgaagaggttgtagcaatcctgcgggcctctgatgttctgctttaactcgctgacaaacatcgcagagcgcgacgaattcagctatctcccttttcatgctggcccaccaaaatttttctttgagatcttgatacatcttggtactacccggatgaatggaatattgagtctgatgagcctcagtaagtatcagatcgttcagctctttatcatcgggcacgcacaatctttctcccatccagatcatgccatgttcatcctcaaggatgtcccgggcttttctgaccctcatattcttttttagttcagctatctcaggatcattcacttgagctgctctgacttgatccacgagcgtaggccgtgcttctagggcggctacgaacccgtgttctacgattcccatgttgagacgttcaagctcctgctgcaattctttacacatgccctcggtgcatagggcattgcagtagctcttcctgcttaatgcatctgccaccacattggctttacccggatggtagtgaatgctcatgtcataatctttgattagctccaaccatcttcgttgtcggagattcaaatctggttgggtgaagatatatttcagactcttgtgatctgtatatacttcgcagcggttgctgatcagatagtgcctcgagattttcaaagcatgaaccaccgctgccaattccaaatcatgtgttggatagttcccttcgtgtggacgcaactaccgcgaggcaaaagcaaccactctgccctcttgcattagaacacatccaagcccgtggcgggacgcatcgcagtagacttggaagtctttcgtctgatcgggcagaatcagaactggagcagacaccaatttcttcttgagctcctcaaaactcttgtcacactcggccgtccatttaaatttctcatctttcttaagcaactgagtcatgggtcgggcgatcctggagaaaatttcaatgaaccgacggtaataacccgcaagtccaagaaaactccgaatctgtgacacggtcttaggtggggtccatttggtaactgactccacatttgctggatcaactgctatgccctgagctgtaatgacgtgacccagaaatttgtcttccgacaaccaaaagtcacacttgctgaacttggcatataactgttgctccttcaactcttcgagtaccagacggagatgttgctcatgttcttcttcagactttgaataaataagtatgtcatcgatgaataccacaacaaacttatccagaaattccatgaacactttgttcatcaggttcatgaagaacgcaggtgcgttggtaagtccaaaagacataaccgtgcactcatacaacccaaaccgagtagtgaaggctgtcttggagatatcctcttcccgaatcctcaactggtggtagcctgatcgcaggtctattttggaaaacaccttggctcctttcagctgttcgaacagatcatcaatccgcgggtaaaggatatttgttcttgattgtgacctcattgagtgcgcgataatcgacacacattctcttcgtcttgtccttcttctgcacaaaaatgaccggagcaccccaaggtgaagtacttggtcgaatgtaccctttctgcagttgctcatcaacctgcttcttgacctctgctagctcgttggctaccatcctgtacggtctcttgtaaattggagcggtccccggtgccaaatcaatccggaattcaatctctctcttgggtggcatggtagtgaggtcttcggggaacacttccggatactcgcagactatggagatatcttccaatttccgcgaactcttctcctcgatggctacagggttttccacctcaatctgatttaaggagattccttgcttccgtgagactggtgacttgtacaccacggtttctcccttctcattagtcaaggtgactgtgcgattcgcacaatcaataactcccttgaacttggtcatccaatccatcccaaggatgacatctagatctttggattcaagaaggatgaggttggctagaaatcgtgatcggtgtatttctatgagcactgaagggctataactgaccaaggttgaactatttcccggggtatgaaccctcattggtgtactaagctcttcttttcttaacccatgtatccctacaaacttctttgaaatgaaagaatgcgttgcgccagaatcaaaaagtactgtagcagggactgagttaataggaaacgtacccagtacaacctctggtgctggttgcgcctcttcggcggacgcgtggttgacatgagcctggacaaaccttggcccagcacgcctaggcttcgggcatttgtcagcaaagtggccatgctcgccacaattgaagcaggaccctggctttgttccagtctccttcttggcttcggctgatggagctgactgtgctggtgccgttggtgggcgcggagctgcgctgcagttgggctgacctccctggtggttctggctgccactggcgccctggtggaagctgctcgagttgaaagggcggtgctggcggacgatcatggtggtaggtccaccctgctgtccgggagtgaagcgcggtcgctggtggctgtcgcgtcccaaatcgactctaaaatacatcctcgaaattgtgccgagaataattaaaattcatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggttttataaaaagaaagtccctaaaagtcttctttccccccccttttccctcttgggccggctcggcccaattccctccctctctctcctctccccgcggcccatcggcctcctccccgcgcgcgcgccgctgacaggcgggcccgcccgccaccctcgctgacgggtggggcccacctgtcatcgcctacctcgcgccgcgcccgccgcccgcccgtgccctagcgccaccgccgccgccgaatccgccgcatcccgccgtccccgcgcgccataaagagggggaaatcactccccgtgattccctccctctttccccccactttcccctatttctctccctcggattc

SEQ ID NO: 30846 - DNA, 7718 bp, Oryza sativa
gccatttgaactcggaattgggccgttcaaagtctctaatttttccttaaagaagtcaagaacccatttttgtgctttgttttcggctgttatgtggagtttattagagtaaaagccttttcttttccgttggtcgtgtagacgctgcagcttcggaagatccgctcttcgtggaagttgaagccgacgtttgggaaagcgagcaaagcaagtcacatcatctttgagcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacattctactcatggtaccactagtttaattttaggtagatgcttcgcaatttaattaggtaacattaggtggtttttcaactatagactttgggaaatattcatatcacctggatactttagaatggtttggttcttgtggaattggcttcacaccgctccttctattcaaaatccccaaaatggttttaggctgggctcggggtgcatggttttgatagtagcacctcggccatataaggaccggtcttcgggtctctgttgcaaagcactaccgtacttccacatgtctagtgggtaaggcttagtttgtggctcagtctggttataaacaaaagtacacggattggggatggatgaagtcgggggtcgatggacattctccagggcaaatgaaggctacacgagctgcggcccggtagtcgagatgtcgtggcagagggttggtgccctgctgcttggggctcagtcctgcctgcctgtcccggaggttccggccgtaggcgggattgggtcggtactcttgtctatggctaggatgggttggaaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaacgtggaatggttggcctgggttggcttgggacgagctgggacccagggtcgggttgccagatcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaactctaaccctttatattataattcccttgtactcccttgcatttattctgcatttgtgggtgtgtcttgttgagtacggtggttgtactcagtcttgctcaattttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgaattgtatcaagttttggtgtaccttgcctcctgggacaaggattaatgcacgcacgtcagggacgcccgttgggttatttccggtcgtgacaagttggcatcagagctacccttgaccctaggacgagccgtagatcccaagccttagcaatattttcaaaaataaaaatcctttgttatttgtaaaaactgtctagtctctctctgtcttgctgcttcatttatcgccaaaatctgacctttaaaatgttgttttctttttgtttttgtttgtagatggccggcagcgtcacccgtcgtggtttggacatgactggcttcgtcttggagctgcggggcatgtgcgtggccctggggtatccacatggagtggactaccaggccaggccgcttccggatcaggagggtgacgacgcggagccccacgctggttgggaggtcaccgcagtgatcctctctggctctcccgagcggacttcgctggcagttaccgcgggtggagattccttccccgccgcttgccagaacgccgctctcctcgccatcggcactcttcaccagcgctacccggacgagttgcagcactcgccctaccgctaccaccctcgtcgcggaggagcccacgactacgccaccttccgggatgctagctcggaggatgacgctaccatcgtgcacctggcgcgcatggtggaggtgtacgacgcggctcgtatcgacttccatcagatggtgcgtcgcgggatggtcgagaacaatctgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcattggtagcacggagggtgcgctgttgctcaccttccgtcctggcccgtcgcagcagtagacgagcagttagtaggcttgcgcgtgtgtttttttttctcgtttgtctttttgagtcgtgtggggcatggttatgccggtgtgtggcataactgtgtcggagcctgtcttattttatttgcctaagcaacttgaacattaatgaaccaatttaatagcagtaataaattcaagaattatggtagtcgtgggtggttagttttaattgttagctctttctctgtttgctggttctgtgtggggttttcagatggtgacgaccaggagaaatgctgccaccggtgatggcaaccaacccgaaggcagcaaccacaaccatcagggcaacccacctccacctcctcctccgcctccaccaccaccaccagacaccaacgccattctcacccaaatcctcgcccagcaagccaacatgatgactgctttcctccaccacctccaaaatccaccacaacataatgctccaccaccacccccacaacactctaaactcgccgagttcctccgtatccgcccacctaccttctctagctccaacaaccccgtggatgcgttggattggtttcatgccgtggggaaaaagctagacacggtgcagtgcagcgatgaggagaaagttatcttcgccgcccaccaactgcaggggcccgcatctctatggtgggaccatttccaggctacgcagccagaggggcagcctattacttgggcccgcttcaccgccgctttccggagaacccatgtgcccgccggagtcgtggcccttaagaaaagggaattccgagagttgaagcaaggcaaccgctccgtgatggagtatttgcatgagttcaacaacctagcccgttacgccccggaggatgtgcgggaagatgaggagaagcaagaaaagttcttggcaggaatggaccctgaactgtccgtccgtctagtctctggggactatccggattttcaacgattggtggacaagagcatccgcttggaagccaagcacaaggagctggagtcgcacaagcgccgcttggcgaatttccgcaatcaacagggtgctaatcaaaggggccgctacaccaatccctatccagggggatcctcctcgcagcagcaacaacagcagcagcaacctcgccccgcgccccgacctcaattcgtggtgcgcttccaacagccgcagcaacagcagaatcaacaagggactcgtgcgccccgtcctcctacgccaacggtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgttactctgtaccgagggccggaacaaccggttgttttctttgcacccccaacctctatcaagagttcagaattgcatcagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgattacagagctctcaatgaagtcaccatcaaaaacaagtaccctcttccccggatcgatgatctattcgatcagcttaaaggtgccactgtattctccaagattgatcttcgttccggatatcaccaattacgtattcgtgaagaagatattccgaagaccgcattcaccacgcgatacggactgtatgaattcacggtgatgtcattcggtttaaccaatgctcttgcattcttcatgaacttaatgaacaaagtgttcatggaatacttggataagtttgttgtggtgttcattgatgacattctgatatactcacaatccgaggaagaccatcagcaccatctccgtctggtgttgggaaagttgcgggaacatcaattgtatgccaagcttagcaagtgtgagttctggttgtccgaagtcaaattgctgtggaccccgaaacagtgaccgccgtcactgattggaagcaacccaagacagtcactcaagtccgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtagtagcctatgcctcacgtcagctacgacctcatgaaggcaactaccctacacatgacttggagttagccgcggtggttcatgctctaaaaatctggcggcactatctcattgggaatcgctgtgaaatatataccgaccataggagtttgaaatacatcttcacccagtcggatctgaatcttcggcaaaggagatggttagaactcatcaaagactatgatgtgggaattcactatcatcctggtaaggccaacgtggttgccgacgctctaagtcgaaagagccattgcaacactcttaacgtccgtggcattccacccgaacttagtcaacagatggaagccctgaacctaagcatagttagtcgcggattcttggctgcgttagaagccaagcctaccttgctcgatcaaatccgcgaggctcagaagaatgatccggacatgcatggactcctcaagaatatgaaacagggtaaagccgctggttttacagaggatgaacacagaaccctatggaacggaaagcgggtatgcgttccagataacagagaacttaaacagctgatacttcaggaagctcacgagagcccttattccattcacccgggcagtacaaagatgtacctagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagcacggttcattcccgtaaagaccacctatggagggaacaaactagccgagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagaaagatggacagaccgagcgtctaaatcagatcctagaagatatgctccgcgcatgtgtactagatttcgggaagacctgggataagagtctcccctatgccgagttctcctacaataacagctatcaagccagcatacaattggcaccttatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataatcgtcgccgtgacctggaattcgcagtgggtgattttgtgtaccttcgggtcacgccattgcgaggtgtacacaggtttcagacaaaagggaagctcgcacctcggtatgtgggtcctttccgtatcgttgctcgacgcggagaagtcgcttaccagttggagctgcccgcctccttgggcaacgtgcatgatgtgttccatgtgtcgcaactcaataaatgccttcgagtgccatccgagcaggccgactcagagcagattgaagttcgcgaagatttgacctacgtggagaggccagtgaaaatcctggacaccatggagcgcaggaccaggaaccgggtaatccgtttttgcaagctccagtggagcaaccatgccgaagaagaagctacctgggagcgtgaagacgagctgaaggcagcccatcccgatctcctcgccagttcttccgaatctcggggtcgagattccgtttaagggggggtaggtttgtcgcgtcccaaatcgactctaaaatacatcctcgaaattgtgccgagaataattaaaattcatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaa

SEQ ID NO: 30847 - DNA, 4766 bp, Oryza sativa
tataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctagcacaacttctccactctggactgcttggctcgatctcatgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctattcgattcgagggtcgataactttgcctttgaattatgcttcccaagagaaccaacttatcccacttgatatactttgacgtcttcccaaatagttttactgttagacttcttattgtctgatcgttatccggccaaattttgaagcttcgtggttagatgtgattttactctgacgtctgtagactatctgcgaacatatcacttggttcataactgggaatagctcccacgaacaagcaactcagattcactttctttatgttcagtttactttccgctattctcttcatgttgttatcatttagcattcaacgtattcctgtgcaccttcagccttgatgtgttctttcccattggatcatctcccaagacttggcatcacctggcaaccggtgcttgcacttttcactccgtgtagcatctgataccgagttgaagatttcactcctcgtcttcatagaaacacttttacctaggtcatcttgcttacttaatgacaaggtgtctgttgtggggggggcaattactatcaggggtcttccttgagcgatgcagagcatgtttctgtttatcaatcacctttcggcctacttctttgatgctagagaacatctttgccaatctcttttatcaatcatctttcggcttatctctaacaggtggtattctttaatgtggattgcggacgcttctggggacgatgaggtcctttggcttgctgcctttcagtgaaaccttggtggggttcgtcaaaaactatactgactgtctttgcctttgatccgaaaaagacacatctgaaactcttagtccaaacaaatgtctctttggttgatcacttgattttcttttccatcatcaggttgggtattaactcgaggttagaacatagttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaatccttgctaacattggcatcagtggtaccatagttgctatcaccattggagtctttctcagcgtcaaaattgctaaggttgtcattctgggttccaacattgatactatcgttgacatcttggtgaatgctactgacattgcacgctttgttcgagtggtcactaatggggcaagaaccatggttgttggtggtatcatcatcattagtattgctagtgttgttgtctgcattgcgttcatcttcttggggcaggaactcttgatgcacaacagaagatccggtgatctgaagtggctcagtgcgctgtctttggttaccacctggaattactgggatgttgacaatccttctcttgcagttcgtcatccgattatgctcactttcaagttgcatggctttgtccacaagtttctcaaaatcttcataatcctctaggagtagttgcactgcgagctcatcttttaacccctggagaaacttctcttgttggtcttcatcattttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggtttcgttgatgcttctctcattcccattggcttgggttcttgagtcatcggatccatcattcccatagcctttgttaccagtattatccatctgtcacaaggtagaggttgagaggggaagcatacaaggaaagaatagaccagaactagggacaagaccttaaaggaactaactcttcttattgatgtgttgtttgtttcacttattctgcaagttgattaagcaaacaacctagcatggttacatcacaacccactgatgcaaaccacgcgctacacacacaagcaaggaaacacacgacgaacgaaacactagagggtggcttaggttctgcgacgggttctccaagatcttcactcttgcttcacatctggcttcactgcttcctttgcttcgctagcggatcctgcagtcttccggggcttcggcaaacaactgacgatgtcttcttcttcactgacctgaccatctagtactagttgaaatccgaagaaggaagaaggcagtaaaccttttgcaaatagcattaggggaaggagaaaaaggaactttcgcaaatagttttatttataaaatatgtccttaggttttatccatttggcttatcctacagtcgagatggctctgataccatcttgtcgcgaccgggaaaattgccttttcccgaacgctagtgtattaatccccgtcccaggaaaagccggggtacaccacacaaacatgatataaaagacacatctttattataccgataatatttacattattacaaaggcgcttcaggcctgacaatcaaaaataaacagcagcggactagcgggcctacggctccatcttcacaggcgctcaactggggtataagccaagactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattgcacattttagttgtggagcaaattttaagaattagaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaagcccgagcttaattcttatagtggacgggg

SEQ ID NO: 30848 - DNA, 1113 bp, Oryza sativa
gattttttaattaaaatttaaatgaagaaattcgtaaatatccatttaaagagcatataaacttcaaagggccatatcttggccatttgaactcggaattggaccgttcaagtctctaatttttccttaagatgtaaagaacccatttttgtgctttgtttatgctgttatttggagtttattagagtaaaagcccttttcttttccgttggtcgtgtagacgctgcagcttcggaagatccgttcttcgtggaagtcgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgatattaataccttgttcaccctagattaaacaaaaccccatctagtggacactctatttatggttccactagtatgaatttaggtagatgcttcgctgattcattaggcaacattaggtggttttataattttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggactaaagctcgggcctttgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccgcccgtaggtaggattgggtcggtactcttgtctaaggctaggatgggttggaaactatgtcacgtcttccgtccgtataccgtggtggtatgtggcacgtggcaacacgtgaggaagatgtgt

SEQ ID NO: 30849 - DNA, 4394 bp, Oryza sativa
gccgacgctccagaaggctgcaggatccgctagcgaagcaaaggaagcagtgaagccagctgtgaagcaggagcgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattagtaccttaagctcccgagtgaatgaagcaccagacaccagttgtgtgacactggtccaacacctgattaaccagaaccgattgcttatagagatactacagcagcatcagacgccaattctgaacccgagtcaaatacgacctcaagtgcagttggaggcagtccaagcactcacaccacaagtcagcatgccgccagcatcccgaaggacccatggtgacgtgccacatgttgacccaaaagaagcaagtaacatttgctttatgtgtgaggagcaagggcactatgcaagggagcgtcctcagcagaaaagaaaaacaccaatgcgaaccgaagatgaagtccgtaagatgatcattactagcacagaatggcctccaccaggaatgaccagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcatgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgcacctcaacgaattgtcatccatgcatcccgaagcagtcctatagcccgcgttgcaacagctccaattccaatgaatgcactaccacaaggtgtcaatgctcaatttcagccccagccaccagctgacaagacagaggccagtatctgcgttgtacctttggaggttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacctatagcagaaacaatgcaccaatgctcctcctgctgcacctgactcggcaataaatcatagcaaccactctctgcatcgacagcctcagcaaagaattgtcgtagatggaagaagttgtgtctctccccgacctactccaggccgagccaagggcaatcaacctccggaaggcgataccaagcagaagaccgtcatccgcttcaaccagcaatcagaaggaatcttctcctgtgaatgatagcattatgcagtcctatcacatcatcacagaaccaatcaaggatgcagtcactagaacaatgccagctatatctctccggaatcaaaatgagcagccgtgtttgtggttttcagttcgctacctatcattgcgtaatcgaaagtttgcagcaatcatgtaatacataaatatattcatgtctataaacagtgagcttgctatgcttatggatgattcatgttgaggatacaatgtaccgatgttaagcaccgtctctttttgtttaaggcagtgccttgtattcgtgtaataagggagaaatgtgtaatgcagacaagttctaagaggattcttttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggatgaaacccataagggtacccgccatgcctctacattgataagttcggatatacctgcaaacagttaagaagatccaggagacatcaatattcgagaacataatagtcaatggttggtagttagtcgatcaggtatcagaaaagggtcaaaggtgatatggcagaagaacaatatggatgctccccatctcgaggaagcactaaaccctagtggcatagatacagatagcaagcaatgtatttccctgaaggtagtcagtgcagctttttgacaaaccacatcaaggtttcactgaaaggcagcaagccaaaggacctcatcgtccccagaagcgtccgcaacccacattaaagaataccacctgttagagataagccgaaagatgattgataaaagagattggcaaagatgttctccagcataaaagaagtaggccgaaaggtgattgataaacagaaacatgctctgcatcgctcacggaagacccctgattgtaattgccccgcaacagtcaccttgtcattaagtcagcaagatgacctaggtaaaagtgtttctatgaaggcaaagagtgaaatcttccactcggtatcagatgctacacgaagtgaaaagtgcaagcaccggttaccaggtaatgccaagtcttgggagatgatccaatgggaaagaacacatcaaggttaaaggtgtaaaggaatacgttgaatactaactgaggacaacctgaagataataatgggaagtaaactgaatgtaaagaaagtgaatccgagctgcttgttcgtgagagccattcccagttatagaaccagtgatatgttcgaagatagtctatagaggtcagattaaaatcacctcttacaacgaagcctcagatttgacagggtaatgattagacaataacaaatccagcaatacagccattggagaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaataacaagcatgatattcttatgatgacaaacatagtatcctagtaatgacaagctagtgttgacgcatgacgtgaagtggtaacttgtctgaggttgactccgaagataggaatcatgagaagttctggaacggaagcatcactgcactaccgcaacctagtctgagtcagccaaaaggtgcaccctggtccaagtcaggtgaagagaagattccatcctcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttaaaaaggcttataaaaagaaaaaccctaaaagaagtcctcttttcccccccattccttttttgggccggctcggcccagtcccttcctctcttttttcccccgcggaccatcggactcccccgcgcgcgcgcgccgctgacaggcgggccccgccgccgccc

SEQ ID NO: 30850 - DNA, 14018 bp, Oryza sativa
  unsure (1)..(14018): unsure at all n locations
gttatggccggtcaaccagattcgccgggattagtctccccctagtgtagtctgatggaactgattagttcaggttattggttgggcctgttacaatgtggtgtagcgttgaacagtggatggttaatattgattaattagtacaattgttttaccgctttcaactactgtttataaatgctcgctttatgcaaaagaacctctctagctatcctttggcaatatcctgcagcataccccggttccggtatgacttgctgagtacagtgggttgtactcagtcttgctctatttttccccaaccctagagtttgagtatgcgtcagatggtggtttctccgaggagtaggcttcgtccgtgctgttgaggatgcctgtggagtggtgttcccgctgccgttcaagtcaaggcttagctccagttatcttttgtttttccactgcacttatgtaagacttttataatgtttgtaagacgtggatctgtatgtcaactttgtcgtttgtgtaccccagcctgtcctggatggggattttaatgcacactctgcttggaattctattcgggaatttctgggcgtgataagttggtatcagagccgaccttgaccgtaggacaagccaaatgggaaaacctaagagccctctgaatccttttcattgcatatgttctttgcaattggatttgttctgggaaatttgggatctgtttttgtggttcaagggaaaaatcttggtcgctcgttaaagagagatttgtcaaatcaggtcagtctagggttttagtgaaactgtttgagatttattcgacagtcaatcgggatttgatgggaggaatgcattaggtcctaattcaggaatatgggttgcaaggtatttatgctcttattattattattattattattaatatgtacctaattttctcatcattttatcgctatgtaagtccgtcttatttattcgccttcatgcaaaacaaatgatctgtgtataaaattccgcttttattcgcctatttaatttgagtcttttactgcttcattaaaattggatttgagcatgcattgatcctacccctttgtcttctctagatagccgatcacccacccaaccaccgtggagaaggcatggatgactttgtggcagagttggctcgcatgacactggtggtgagctaccccaacgcgccggagtactcgactgttccgccgctcagtggcgagtttcctcaccgtgttcgtctggaggttcatggctatgtgggcacctgcctcgctaacatggtggttgaggcatctggaggcacagcagatcacgcctgtcaggaggcagcatacctgatgatggccagacttcgtgagcgccacaactacatcttctgcaacacggcgtaccggtttcaccctcgtcaagcaagtggcgatgacgtcaacaccttccgtccgatagccggtgagaacgacaccacctttggtcacatgtgtgccgtaatgaggggaatggacaggatgcactcagatatgcgttaggcgtccaaggccttgaatgacgggaagctcgtgaggatcatagctctgaaggataagatagcacgcttgaagaaggagaatgctcagttgaagggtctccccattcccggaggagtccgggtcagcaacacgtcccgcaagtcgacgacgtcacctgtgcgcattcagctcgcgcccaggaacccacatccgcccgcagttcccgcagctcacgcagttcctgcagtgcccgcagctctagctccagccccagctcctgctccagtgtcagctcccgcatccgctctctccttcgctccagcgtcagccgtcagggggccaaccggtggcaacggaggttggttacctgctactcctagtggcagccgcgaccatagcagcagcagttctagtggcacagagccgggcagcggcgagacgtatctgccagactccaggagccgctcagagggacctggtgacgagcaggaggacgccttcgactccaccgactgcaggagccgttccgagcattaggctcgctttcccttagtttaccgactgcttagtaattgtctgttagtttgtgtgtctaggtttgttcgcttgtgggtcagtcgatggtcgatatcatgtgcctatgatatggctgtcttaataaggattttgcttgccgttttaagtgttttaattcagatcagaacaattgcagtttaaattcctatataataaagcttagctcctgagcatctgtttttcttattttctttttcttcccccgcctgctctcccttcagatggtcaacaccaggaatggcagccgtgcagcaggtaagggcagcagcggtgaagaacgcactgacggtggacaccccaacagcgcctctagcaacggtccgccaccgctcccagagaacccgacgctcgcacaagtgatggcccataagacccagatgatggcggccatgatgcaacagatgtagcagcagcaccagcagatgcaccagaggatgcatcagcaagccgagcaacggcagcagcggtttggtcctcctcccccttagtccaaactgccggagtttctacgcgtcaggccacccattttctctagcaccaccaaccccatggaggcgaatgactggctccatgccatagagaagaagctaaaccttatgcagtgcaatgatcaggacaaggtcgcctttgccacacaccagctccagggtcccgcgtcagctttgtgggacaatcacatggctacccacccgccaggcacagaagtcacttgggcggagttctgtcgtagcttcaggaaggcgcaggtgccagacggggttgtggcagaggagaagagggaattccgggcaccccaccagggcaacagaatagtgactgagtatccccatgagttcaatcgtctagcgcgatatgcaccggaggatgtccgtaccgacgccgagaagcaggagaagttcctagcaggcctggatgacgagctgaccaaccagttaatctctggagactacgccgactttgagaagctggttgacaaggcaatctgtcaggaagatcagcgcaacaaaatggacaggaagagaaaggtagcgcagttccggtccaaccaaggaagccactgtcacgaccggaaataacccaacgggcgtccctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataatataaagggttagagttgcagtaaacagcatttaaagacatttagttgctcaaagctattttgtaaacacgatcctagaactatacaatgttattaatcaaggccgtgaccgcacaggaacccggccttaaccaaaggcttatgatgattcagaccgatctggcaacctgaccttgggtcccagctcgtcccaagccaacccaggccaaccattccacgttttagttgttaagcaggttttaagaattaaaacactacttggggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagtttccaacccatcctagccatagacaagagtaccgacctgtcacgtcctgataaattcatcccgaattaaaaatcattctctaaaaggaataatagaattaattaaaattcgaaaagaaattggcaaacactaaaatacgtacaagaaaaattcaaatgtggcccggagaatttttgtcaaattccccttggtcaaaaaggagccctcaaattttagtggaattttcagagcacaaataataattgagaagaaataaacaaagttaaaaaggtttataaaaagaaaatcttaaaagaagttctttttcccccccccccttccctcttgggccggctcggcccacttctccctccctctctctctctcctcccccgcggcccatcggcctcccccgcgcgcgtgcgccgctgacaggcgggcccgcccgccactctcgctgacgggtgggacccacctgtcatcgccttcctcccgccgcgcccgccgccgcgcccgtgccttagcgccgccgccgccgcggattgcgccgcatcccgccgtccccgcgcgcattaaagagaggggaatcactccccgtgattccctctcccgtttcccccgttttcccctctctctctccctcggattcgtccgatttccttcccgcattcatcgccggcgcatctatggcggccgaaatctccgcgaccgattcctccctctccggccgctctttccttcccccggcgctatttaaacgttgcccgagctccgctcttccgtttccgccgctcgccgctcgctctcgccgtcggattcgtgctcgcaccgtgctccgctctctccgccatcgccgccgagctccgttccgccgccgccgccgctccggacttcctccttactcggcgccacctccctcggcatcgccgcatcgccgtcgacctcgtccgcgcctccgtttcgctcgccgaccgtcggagcgccgtcgccatcgtcatcccgagccgcgccgccgtcttcctccgctccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggcccccacccccgtggacccggtccgcgcgccccctccctcggctgacgcaataaatgggatttttaattaaaatttaaatgaagaaattcgcaaatatccatttaaagagcatataaacttcaaagggccatatcttggccatttgaactcggaattggaccgttcaagtctctaatttttccttaagaagtcaagaacccatttttgtgctttgtttctgctgttatgtggagttatttagtgtataagccttttcttttccgttggtcgtgtagacgctgcagtttcggaagatccgctcttcgtggaagttgaagccgtcgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatacaattattgttattgttattattaccttgttcaccctagaataaacaaaaccccaactagtggacactctatttatggttccactagtatgaatttaggtagatgcttcgctgattaataggacaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatacggcagagggttggtgcccaatgctagggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatgggatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttataaaatagctttgggcaactaagtgacttataaatgccgcttttctgcaaaacttaacccctatattattactccttgtacccccttgcattaaccatgcatctgccggtgtgacttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggaaattttcccggtcgcgacagttcagcttataaatataaacatttcatatgaaaaatggaaaagtactcatcggtgacgggctttagttcatgcccgatagagattaagtcatctcaatcggacattagtatatagcccgtcactgatgagtcatctgtgacgggcctaattgttatctcaaacgtgcctcaagttggtgcatgccacagatgatggtcatctgtgacgggtcccaacttgaggcccgtttgagatatggaatgttatctcaaacgggcctaaagttggtgcccgtcacatatgatggtcatctgtgacgggccgtaactttaggcccgtttgagatgtggaatgttatctcaatcgggactaaactacggcccgtcactgataggtgttatccgtgacgggtttaagttttatgcccatctaatatgtctgtgcgatcatatctcaatcggacactttttggtccgattgagatgacttccttgtgatggcccgctatttctaggcttgttagaggccgtcacagatagaaagatctgtgttagtgtgttatattttattttatattgctcatttgaacaccgcttgcctgatgtgcataaaaggaaaggttcacattcagtccaatcaacacgggacttcataatgtaactgaacaataatttcataatattctaaacacacgcacatcaaactctccaatgccggacgattcaacgtggtctataaaagggaaatcagagagattaaagattagataataatggagatggaacaggattaatcgaggagtggttgcaagcatcagagtgccatgttggaatgagatgcagtcaggagtcaggagaaaagcgcgattgctaatcggcgcgcgccgcgcgcgcatttctggcccataaggcccagcgccggcgcgcgcgcctcccactctttttttttttttcattttttacccattttttttcgctttttcctttttttgtgattatttttttaatctttagcatattttgagtttgaaagttttaaattttgagttgaaaatttttaaatttgaacttgaaagtttttaaatcttgacttgaaagttttcaaatctcgatttgaaagttttcaaaattttcaaatctggacttgaaagttttcgaatctcgagttgaaagttttcaaaattttcaaatctggacttgaaagtttacaaatctcgagttgaaagttttcaaaattttcaaatctggacttgaaagttttcgaatctcgagttgaaagttttcaaatctcaaattgaaagttttaaaatttttcaaatctggacttgaaagttttcgaatctcgagttgaaagttttcgaatttgagttgaaagttttcaaatctgagttgagagtttttaaatttgactttagagttcaatcnaaattttcaaatgtacttaaaaatttcacatctattagtagaacatctcctgatctttcataattactatctttagtgttaagtatattaactaatagaggtagttaagtatattaagtaatagtgttaatagaggtagttaatagggaaagagtgctcgctagcagcgagcacgcgctagttaggagtccccggagagaagtgggaggcacttgataggtcaccgatgaaccgatcttccggattcaagacgacccgactcagaatgatcatttgtcaagtaccagacacagaatcaggtggagcagagaaccatttggtggcagtgacctaaatttcccattctgatatttctgaaggtcatgccacaaattttcatcaaaataacaaaagttgtaccggcgtcatcttctgaagaagcaaaaatggtttctcatttgagcacccctttccagcttccctgatatgcataaattgcaaaaattcacatttaatcccattcaacatgggacctaagtgcataacatgattactgaacaataacttctcactgaaaatagaaacccaccaaactttccactgcctgacaatccatccttgtataaaagggaagcaagaaagatcaaacaacaaggatggaatgaagattattcgtgaaattctgaagttgtacatgcattagactgtccacaaattaaaattggggcatatgctagaattaccttgagtaagttagagcgccattagaattagaggtatttgggcaagaatgagaggccatcgggaaatgagtgagaagcattatatgcgtcactaaatcggttagcttgaagctgcaatagtatttcaccggcgacaaacttctgaggtgaattcgatagtattgtgaagcacataatctactatttgctcaaactcagcagcagtggtgctttacctgcacaaattgtagacgacgcatttgatgaaggcgactgatgatttcaggagacacaagatgaccttgcgcgtggtgattggatttttactgtcattttctcgcagaaggcacagattggatcattactctgaacagcatcacaagcttgcaagaaacacaatccttttaaataaacaaattttttatctgtggaatcagattaaccattagatgttttcacagaagtacaagtaaattgttatcaaagaatttttcgaagatgggtttacctacgatgctcagtgctcacacggtcaattcagattatacatgccagtgtatagatgccacaagaaacaagtgctgaccggtggaaagaagcattttggtccttggactctatttagaatccaaatttcatcatcaactctaatatgaactgcttttcccctagaacttagtagtaattccaaaaaagcagagtacaagtatgcttgtaagagatcttttacagtctaaaaatataatataagccatgtgtaccaactagtcggtcgattcggcagtagagattaatattttccattttactgtttactaaggttttgccccaatttttttttgaaaagtaccaaaattttgcatttctcatttaaacattgttttcgtgatgcacataaatggaaaggatcacaaattcacatttagtccattcaacatgggacttctcacgatataactgaacaataacttcattcatagtactgcaaacacagacgcatcaaactctccaattccagacgattcattctactctatagaagggattaatcgataagtagtgcaagcaggagagtgccataaaagctagaggcattcaggtaagaatgatggcattcaggaaagaagtgcgaggcatttgatcattcgctgatcttgacaaccatgtgaatatttggcattttggctcattacgagtatctgtttagagcttgacaacgatgtcaatgagatgcatgctgtataaaagagaagtaaaaaagacgagacaatgagtatgaaacaaagactagtcaaggtgttgtgcaagcatcaaagtgaccacaaattaatgttgtgtgtgtctatagttgatgcagggggcagagttattatatttgtagaagaaatcatagtgctattataatgagaggtaagtgggtgagaatgagaggtatgcaggaaacaagggagaagcactagacgcctcaccgatcgaacaagtttgaaggcgcaagagcatctgaactgaacagtgccaaacaactcagtgtagatcaatagccgttagaacagctggtgctttgacctgcagacattgtagatgatgtataggaaaagcaagacaagcttgcaagttggccagatgtcattgtctttttctagcattgcacaaattggatcaatagtctgaactacgcaagaggcacttcccctttaacaaactttatccgtggaattggattaaccgcttgcatcggagctttcacaagagtacgtctcgggcattttgagaaatgtgttgtgtattcacttgtgatgctaactctgtcaattcagattctgtatacaaatgcagacatgccacgggaaactaattctgaccagtggaattgagcagaaagagcagactcacaattgttagaattaaggtttaacatatgattttttggaacaaactatacactgacacatagatctatcggctaagtcaaaattttactacattttattattttgtcaaaattttaaaagtgcaataatttttaaatacttagtttaaacatataaaatagtatgtgtggattcgtcatcttaaaagtatttttatattcttataaaattattggattatataaatctattatattaaaaagtaaattttgatcatatgccctcttctttgttattgaaattgagactaaccatccaagcaaaatcagagtacaagttcgcttgtaggagatttcatacctactaaaattaaacagtgttcaccaaaactagtaagcgattcctcaacaacgagttagctatatctcccatgttgattttgtgaatattaagtcatagcttatctcgaaacaacaaaatttccatatttctcatttgagcaccgctttcccgatgttcgtaagtgcaaaggttcacattcagttcattgaacacgggacctaacacgccaactgaacaataaatatgccactataaacacatacacccatcaaactcttcacccctagacgattcatccttgtcctataaaagtgaaacaagaaagattggataacgatgggatggaaggattagtagagtaactgtgcaaccatcatagtgtcataagagtaagattgaggtactcagctaagatctgagaatgagaggcatcgagaaaacaagtgagatgaactctaagcaacacggattaaccgaatttctagattgtagatgaacttctgaagggcggaactagaaattggccaaggccttagccccgtccatggaagtttgggtcctacacaatagaagtactaaatggggcttctgccacaggccccgggtcgtcgcgcaggttgcctagggcatgcatgtgtcccccctccccttgcaactcacgatgaacaacatttggtgagaggtataaaattatatgaaggagacggcttgtcttacacttacccacggttgtgacctgcatgcattgtaggtcatgcatttgctggaaaatgggactgatgatgatagaaaacacaagatgagttcgtacagcttcgtcttttctccctttgacacgcaatttgttgctatatatcctaacgtacaaagaagatggatccactaattgtgatgctcacccagttaattcggtctattcatgttcactatagaaataccacagaaaattcaggtggagcgcagagaaaaaaaatactgtttggataaggcttaacctacggttacaagctataaacagtaatataattgattgcatcatatatagtgattacgtttgtatccattatttgatttgattttttcgagaacatgttggatgcatccacacatgaacagttaacatgtaattgtaaccatttccttcatacggattgatttgatcttgtgaacatagtcatagatgaataagtgcatgcacatttccaagtttctaatttttttagataatggaataaaacatcccggcctttgttcatcagagctatagccaattattacaaaagtaacacccaaacactgagtgtagttcaaattaattaaacacacccaacaaaataaaagatcaaactaagataaggagagcacatttattcaagtctatttgtgaatctccatcaatagtttgcaaggagttgcatgaccgttatctcaagcctacgacatgcaaccttcataagatctcgatcatcttcacacatttgcagttgtgcccaaaatcggagccaatatgttgccctgaaaattacctgcatatatgagatagatggtgatttgtcaaaaaccatatcattgctagtcaaccacagagcccaacatatggcagaagctcctacaaatatgagtttactcttcttcttgtctacctccaagagccaaccatcaaacatattagatatggtagtaggaaggtataaaccaagagagaactgtattgctctccaaacaaattttgcataatgacactctataaaaagatgttgaatagtctcatttttcatacaaaaacaacatcttaaactgccattccaatttcatcttgccaaattatccttggttagcacaacccctttaagcaagtaccacataaaaatcttaatcttaagtggcatcttaagcttccaaataatctttttttctctcaatataaccattattaattaaagctagatacatcgacctaacagaaaatattccattctgatgataattccatctaaagctatcagaggattgattcaattgaatatgtacaatagaagcacacaattcgtgccaatatgcaagattctgaccaactaatgatctcctaaaggaaacattgagtggaacagatctcataacattagcaatagtagaacttttccttcggacaatagagtataaagatgtatatttgtctttaaaagccaggtttcctagccatttatcttcccagaaccttatttgtttcccattatttacaatccaaaaacccatatctaagaaggtatctttgaccttcatgagacctgaccaaaaatgagaatcgccctgtttcttattaacttgggttatagactgactgtagagatactttctcttcaatagattttgacatacaccttccttgttaatcaacttaaacaaccacttactcaggagacacttgttttgtatttccaagttatgaacccctaaacctccctgatccttaggttgacaaatgatatcccatctagtaagtctactttttttatggtcatccccttgccaaaagaaccatgatctataata

SEQ ID NO: 30851 - DNA, 16191 bp, Oryza sativa
aagcaaaaatccttcaaattgttttgtggaaacctgcatgtcttattgcatctcaattttttggactgcgaagaggtgaggtggaaggaagaccaacaatcttagtattttcggtgcaaaaacagagcagggatgcccaattttccatccacaactctattaatgtgctctcattcgcgctattcggcaactttggcttgctggttctatcggctgttaagcgcacgagggattccagccgacggattgcttgaacggtgggtaaacactgactgcactctcacgaggcaggagatcctgatccatcacgtccacgcatggttgtctagctcaccgaatcttgctgatcagtcatctagtcatccttaacttgcaagagtaattgcctaattggctacaatgtattttccgcgtttcacttgttccctgaatacctctcattctcatggcactctgatttttttttaaaaaaaaggataattatggcatgtgctccaactgtagatgcacagaacaatacagtgactctaggagggatgcctgcataattccttgatctatcttgttccatcctcattgtctgatctttcttcgtgcccttttatagacggggatgaattatcatgtagtacaaattttgacgggatgtgttttcggtatgaagttattgttcattagttttgtcaggtccattattggttggactgagtgtgtaggagcatttatacatgcacatcagcatctgaataagttgtatccagctggttaaacttgtcttctcatatactttcatgtttggcttttttttaaaagagaaaaagattcttcattgaaccaaaagctggattttatccatcatctacaaaattatgcacatcagcacgagcaaccttatttgttcttccggtcatcacgctcttttgaaaagaaaaaggacttggcataatcttaagaaattaaaaatggaaatttagatcagggccaccaaatggtgtaactcgttttgggagctcaattgtctgggcgtgatcaagcacaagaaattggataattactctcctgtcccagaatacagtaacctataatcggatgggacttatcttattactataaatctggacacgccagatacgtcctatccgatcctaggttatagcttgctatattccgggagagagagtagttgcttgcaagtttgggactgttgtgcccgtgttgaattcatttttttgttaaaaaaaagcagaacttttgaaacacataacaagattattttttagcccactttaaaactaagttttcctaaaattatgtctcgattactaccaaggtaatctaacaaaaatgagtctcatagtgtaattaagtacagatacaactgaactgccaccgtctcaaaatgttttgatagcaaatttggaaccaaattttcagttagccccaaacgtcaaaaaccaaatttccaaaatttgggactcggttactatatagccaggccatcataattaaggtacaaagtgggtttatcatgtgcaagtagggtccacatgccagtgccatacgcctatacttgtagctactgctagaatttgcaacgaattggactcgaatagaggagtctaaatcaataattagccactggtcgccccaagcgatttttttttattttttttcaccggttttcctttttcacatcatactttttttataagtttatgtatcaaaagtttacacacctttagacatctaaagtttataagataaaaatttatatataatgtttctattatacacataaagattacaatatatttatttctatgtgtaaaatctatacacactaatattatgcttcttcctatttctctttttaaacttatttttaattgtttaagaaattctagcagggttcgtgagaaacgggagagggacatgcgatgggcatatcgacgagatcgagctcgacgaccacccgattagaagctcccacgaggagtagttcttgccaaatgttcgagaacattttggtaatcctgaacttgcaagcgtaatcggatagaaaagcatattgggcttctgacttgtttcatgaatacctctcattctcatggcacttttaacattttaatgataattctgttatgggctccaattgtagatgcacacaacaccatgatgcttgcgcaattccatgatttatctagttccatcctcatcgtctaatctttcttcatgtcattttatagaccaagatgaattatcatgtagtgcaaagttttgtgggtgtgtgtttgaatttattgttcagcaattttgttaggtcacatattgattggactgaatgtgaatgagcatttatgtacgcacatcaggaaaaggatgctcagatgagcaaccttatctcttcttccgatcatgacactagtggaaatttcgttcttcgtctgacaaaagaaaaagagaatttggttaatcttaaaaaatcaaaactagaaaattaggtccaaaagttttttgataaacataacaatattatttgttacccgaccattccgtaaggttatttgttatccaaacataacaaataatcttggtagaagagtctaatcgtgtaaactaagtacacatggtactgaactgccaccatttcaatgtttcataacaaccaaattttcaatcagccccaaacgtcaaaaattgaactttccaaaaattcaacacctggccccccctcccacacacacaaaacaagatatgtacaaacacgataaacatgattagctctctatctgtttggttctctaacatgggtcacatagtacatattcactacactgcccatgttggcccaatataatttaaattagcttttgtatttctggaaccaacgtttgcgtcatcagtggcgaatgcacgattaaatttgagagggtgtcaatgggacaaaacatagcatacaaactatctattaaatagaactaattgccttttccagtatacaattacacataaaagggatagtaacttagaagaaagcaaaatacatcaaaagagttatctcgatggtatgtaatatgttcctagaaacccataaaaataatataacaaacttgttaaaattattatcttgtattatttgacaatcagaaataatactaaattcctagggatactactaggtagcccatctataggaggtgttgggcccctttgccccccattgtttgtccaccactgcttctcttcgctgctctgcttactagcttatactctgcttcagttacaccatcttgatcaacagcttccgagttgccttcctggtctttattgtcaaatgttgacacatagtttatatttttttttcagtagttcttctggtgagactttcgctacagtttttaaataaaataatattataaaatttaataagtttatgatgttgtggcagtaattttaaatataaatctacatataccttttatagttgtaaacaaaatattttaattttattgataatcaaagtttcaaaagtttgataaagagagtcaaacatcatttttttatcctttttctttcctcaagctataggtccttgtgtcaatttctattttgatctgcatagccataggttaaccctttaacctatgtatgctgcaatcgtttatattactgtttatattaacttgtaattaaccatggtaaagccttacccaaacaatgttttttttcctctgcaacacctgaatttctgtggcatttctacggtgaacatatatagaccgaattaaccaggtgagcaacacaagtggattcatcttctcgaaacattaggatggataacaacaagaagaggtatcatcttacatttcctatcaccatccatcctgttttcgagcaaaatacatcgttacagtgtgtgtgcggtaaaaaaaaaaaaccgctcctgccaggtgtgttctcaccgattgttcatcaaaagtgagatcgtgtgcaatgcggaaacttagatgatcggtgtcggttcgagctcccctcgcttgttttctcgatgcctatcattctcaaatctcaaatctgaatgatacctctcactcttatggcagtctgatgcttgcacaactactcaattaatcatgtttatattaacttgtaattaaccatggtaaagccttacccaaacagtgtttttttcctctgcactacctgaatttcagtggcatttctatggtgaacatatatagactgaattaaccaggtgagcaagtgagcaacacaagtggattcatcttcttgaatcattaggatggatagcaacaagaggaggtatcatcttacatttcctatcactatccatcctattttccagcaaaatacatcgttacagtgtgtgtgcggtacaaaaaaaaaacccgctgctgccaggtgtgttctcaccaaatgttcatcaagactgagatcatgtacaatgcggaaacttggatgatcggtgtcggttcgagctcccctcgcttgttttctcgatgcctatcattctcaaatctcaaatctgaatgatacctctcacacttacggcagtctgatgcttgcacaactactcaattaatcatgtaccatccccatcgtcttgccgatctttcttgtttcccttttataggacaaccatgaatcatcttgcagtggagattttgataggtgtatgcgtttacaatagtatggagttattgttcagttaacttgtttggtcccatcttcaatgaacaaagtttaaaccttgacatttatgcacgttaggaaagcattgttcaaatgagatatgaaaattttgttattctcagaaagaaaaatatatgacttaatcttcacaaagatcgaaatgaaaaatatagctaactcattgccgtcgaatcaactgactaggtttttggtagacattatttatattattcttttagtccgtaagaaatctcctgtaggcatacttgtactgtggttctgtggaaattactaaattatagggaaaaaatattgatggactaagttagttaattagtcacgtggaacagcagtgctcaatttatatttctgaaaaaaaaagagagaaaattttggaacaacataacaaatatctagcaagagtttaacaaaaattcagttagccccaacgtttaaaagtgagtttcctaaaattgggtatcagttatcaccttggtccgaggccatccaacaaacattggctcatcgtgtgtctgtaaaatccacttgtcagtgcatagatttggaaataagtacttctgcatatgaatattttgatcaaaacaagtatggctttgtcggtgatatgagcccggggtatcatgtttagttggaggaggccgccccccaatgccacgtggccctcccccaaggggagtcaggcccgaggtggggtggcggccactccttcccaaagattagtcggaggaggcagccccccaatgccacgtggccctcccctaagggaagtcaggcccgaggtggggtggcagccactccttcccaaagacaagtcggaggaggccgctccccaataccacgtggccctcccccaaggggagtcaggcccgaggtggggtggcggccactccctggccgagactagagggagaaggctgccccaggcgccacggggccctcccccgaggggggatcggtcctgaggtcaggcggcggcagccccctcccgtgactaggggtcgggcttccccgaccccctctctagatcaccacgtacaggtgcccacctacctgcatttatggcgacccaagcggtcgcgccacgccgcatttaatgcggcgtgcagtgtactcaaccggtctgtgaccggtcgaatgaccgatcggactggctagtgcgcctgtgcgctgctcgtgtgtcaggcggcgtgcagcctgacatgtcccatcaaataatgatggtgagaggttctcatcatcttatcccagccggagtcggtcctcccgctctggtcaaagctaggctcccgtttcccggtataataggagcccagaagtcttcacccattaaatggtgaatgacatgggcgccccccgtgtcaggcggcatggtgtggtaggccccacgaccgaggcgacgtgtatgcggtatccaagttaaggaacaagacatgcatttaatgcaaagatggtaatacttctcgaggaagttaggttgttgggcctatgtggtatccccttgaactataaaaggaggaccttgcccaccgataaaagggacgatactcagtaggcccgaactcaaggagaagaagagcgagagtgctctccggagtttaggaacccttgtaacactcaaccataatcccaaacacaggagtagggtattacgcttcttagcggcccgaatctgtataaacctcttttgtctcatcgtctttgggggattgaacgccctcaagatcacacagcttcgctcaccaagccctcgaatctcacccgctgcccccggccgaactcacaaaggggggcctcacggttctctgatggaggagttcatcctccgacaggctttatcttcaaaacagtaaaaatgaataatcatataaaaccatacttgttttagtgggaaatttgatcatatatcctttgttttgatagaaaattgacgattactatctcatgttaatgatttgtagggtcaattatggtcactggcatgcatctcccacaatggtaaatctaaattttaatctaaaaagtgggaagatgatcacattttattataacagatttataaagtctaataagtttataagactagaagagtatcgtttacgatggcaaaagtgcgcatgtataccattttctatgactaaaccaagtatttaaaatttattgcagtcgtaatcgtttgacaaaagacaggagggagaatttttgttggacttaagcaattgacccacatgttattctcaaattttaatttgttctaaaaatcaatatgttaaaccttaattctaatatatctgagcgtactctttctcctctccattcgactggtcagaattagttttctatagcatctctgcttttgcatatataatctgaattggcagagttagcatcacaagtgaatacatttcctgaaatgcttgggtagcagccgagtttgtactcttgtgaaaactccaagagtgggtaatatttgtcaaaaaggaagtatgtctcctgcgtttttcaaattaatgacctgatttctgctatgcaagaaaagacagtgagatcctagatcaacgtgcatcataattctttttcttcgtttataccactcggatgacttgttcaccaaatacatcatctacaatatttgtaggtcaaagcacctactacagctatgcttgaggcagatcatgtgtttgtcatggcaatgtcttcaatcatcttcgatcagtgtggcgtctagtgcttctgacctgcttcctggatacctctcattctcatgacccatgtttatacctctcattctcatagcactctgatttcttttaactatgccctctgcatcaactatagacgcacacaacaatttagtttgtgggaactctgatccatgcttgcacaacacacctagattggtctttgtttcatactcatcgtgtaatttttacacttcctttttatacaccaggatgaattgtcaggcagtggaaagtttggtggctgtgtttttcagtgtggagttattgttcagtaatcatgttaggcactttggccccttgctgaatggattgagtgtaaacctttgcatttatttacgcacaaatgagaaacctttttcttttgtttttttgatgacaaagcttgcggaaattttgttcatttttaaatagaaaaagtacaaattaccctccgaactatcacggtcgattgaattatcccctggaccacaaaaccagacatccttcaccctcacccccaactacgcaaatcggacaaataacccccttgagcactgttacgaggtttttgacttgagcttacttttgaaaaatgcaacaagattatttgtttgcccaaattttagaactaagtttttctacaattatgtctcgattactacctaggtcatccaacaaagcgagtctcatcatgtaaattaactacatatgctactcagggccggccctgggcctaggcgggttgtgcgaccgcctagggcccaggccagaggggacccatcacttatcccctcccaccccagcccggccaacaggcctagccacagcccagagccccagacgcgcgcctcaggccgccctcaactgctcagcgaatcagcgatcagccagggagcagtgcgcgtgcgcgtgcgcgtcacttcgcctgccgccctgcccaccggccctacaccacgagaactgcagtgcaggcccaggccgagccgcgtcgcttcgtcgccgtctcgccgatgccctagtccgcgagaggccgccgtgagtgccaagaccgcatcggccccactagcctatagcgcctgatcgccgtggcccatcggccaagccaccaaggcggtatcgctgtcgacgcttcttgccggctgcctggatggtggctggtccctgccctacccgcgtgatctgtgattgtcatcggctcatcggccatttcccattcgccccccttcttcaggctgaaggtaggtcacagacctagaagtcaatcgacaagctctatgcagctatgcctttatcaatttactttgcaatttcactgcttcaggtgttacaatgttacctagaaacatttgttgggtgctatacataactcataaggtcgcgaaaaagctcttttttataagggacatgggatatttgtggtctcctattaaggtgttcatactaatttgtttctatggtatttttagttgtcaattatactattgatattatttattaaagattaaattgctctatcgcaacttgcaaactgcttgatttattatttaccgtgttaaaaatgtttatttgtgtcactctatggtatatgtgctttatagagtatactgtatgtattagaagtaaaaaaaattagatataactccttaagggctaactctaagacccatagcgtcaagtctgcctagggcctccaaaatgtcaggaccggccgtaatgctactgaactatgatagcaaccaaagttttctgtcagtcccaaacgtcaaaaactgtttttttttccaaaaaatttgggactcggttaatagccaggctatcatataattaacgtacaaagtgggttcatcatgtgtatgtttgatccacatgtcaataccatactctagaatctgtaacgaattggactcaaatcgatgaatacttgttccatcctcattgtctgacctttcttgcttcgcttttatatactactggatgaatactcgggcagtggaaagtttggcagggggtgtgtttttcgcgcaaatagatttcagatttactagtcgtttgatctacaatatatgataatatgagtagcaccaatctcagttatatttttcttagtttactgtaattgtaaatcggattatctaaaacttgatgggtgtagctatatatatggcgccatatttttcatcaaaaaatagtcggtatttatttacactgtaagtccctaaattacatatgtaattttagtgtatttacaatgtaagtcacaaaattatatatgtaagtactaaaattacatatgtaaattcgaaaattacataccaattatatatgtaagtggggtgtaaatgaggtataactattgtgtaagtggctgaaaaaaaatcgactgtagcatatggcgccatatttctagcaactccgaacttagatatatatagcatggttttctgcaactgcataactattttaggttgggttatatgacacatgttaacacccctgtagatatatgtatcccatatggccttacaattattataacttagtgctcagcagtctgtacatgacaatgcatggaaatttggctaattagtcgcgtgaaatggctgtgcatgatttattttattgaaataaactagtttttgaaaaatatttaacaaaaatattcagttacacttaatttaataaactaaatttctctgaaattgggtattgttatgactcggcgcatctaacaaagcaggctcatcacgtgtaagataaatttccacatcactgaatacagatttattttttttcaaagtactctgatagattaaaaaattgagtatatacatatttttactgttgagttaaaaaagatttgttcaaatgaaagtttcaaataaaaatctacatatgaaaacatgatttaatttaaatatgtatgttctctcctcagaaaaaaataatttatatggtgcaatcatttgtattactgtttataacttgtaaccatggattaagccttctccagacagtattttcttatctgttccagctgaattttgtgtggcatttatatggtgaacatatgtaggccgaattaaccaggtgagcatcacaaatagatccatcttctcaaaacgttaagataattaaacaagttgcacatcaaaaggagagaaaagaagctgtaccatttttgggtaaatgcaagagctaccgtgcgtgcaggtcggagcaaccactgctgctaagtgtgaggcaggattcaatcacattaattgttgtctagctctcaccaaatgtccatcatcagatagagcatctttaatctagacattttctcgatctctttggcttggagttcctctcacttattttctcgatgcctctcattctcagatcttaactgaatacccccaatctcactcttatggtactatgatgcttgcacaattactcgattaatcatgtttcacccccatagttgtccaatctttcatgatttcctttcataggaccaaggtcaatagtgtggtaggggagagtttgatggttgtatgtttactgtagtatggagctgttgctcagttatcgtgttaggtcccatgttgaatgaactgaatgtggaccttggtatttatgcacgtcaggaaaacggtgttcgcatgaaaagtatgaaaaatttgttgttttgggataaattacggcttaatcttcacaaacatcaaaatgggaaaaatagataactcgctgttgtcgaatcaactgactaaaacagtgtttacattatgttttagtcagtaagaaatctcccacatgcgtacgtgcttctgtggaaataactaaattctagggaaattcatgttagtgttgaaggaccagattggttaattagtcatgtggaatgtctgtgctcaatttcagtttttgaatataaaaaaagagggtaaattttggaagaacagaacaaattaatatccattaaaactgagtttttcggtttcgaagttatgagtattaacaaaaatttcagttatgagtattaacaaaattttcagttagccaaagcctttaaaactgaatttttcggttttgaaggtaaaatcattgtttgttgggaaatttgatcaagtaccattaatttgaccaaaaattaaggattttcaatatctatttcaaaagcatgtgggggtaatttgaagtcacttacatgtctgaggatggtaatatcaatttatctacttctataaaagtgcagttgttttcctcacacctcaccacccgaaaaagaccggaccaatttgattgcacactttttgggaaaaaaattatagaaaaccaaatagttctatcgtactatgttggaaaaagaatggcccatataaaacgaatagtttatacaagagtaaagaccatcacctgtccctaaacttgtaccgctgtgtcatagcggtccctaaactcgcaaatcgaccgttcaggtcctcaaacttgttcaactatgtcatcccggtccctaaaattgcagatcactcatttagattctccaacttgttcagttgtgtcacctcggtccctaaacttagatttgaatatcatctgggtcaaataggacggtctaaagactttatattaaaaaataattcacccctttttcatgtgaactctaataaagacaaactttatatcaaacttgtagccctcgacacgatctacaactttatagttgattttttttatttcaagtcattttttgtcccaaaatgtaattttaaaattaaaatttcaaaatctataaacatgcaacaatattttgggaccctaaacagttttaattcaaaaacttatcaactacaaagttgtaggtcacgtcaagggctataattttgatataaagtttgtcttcattagggttcacatgaaaaagttatgaattattttttatataaagtttttagatcgtcctgtttagagaccggggtgacacaactaaacaagttggaggacctaaacgagtgatctgcaagtttaggaaccgggatgacacagtcaaagaaatttgaggacctgaacggtcgatttatgagtttagggaccgggatgacatagcggtataagtttagggaccggtgatatactttactctttttgttttttagtcggtaagaaatctctcacaagcgtacttgtactctgcttatgtggaaattactaaattacacggaagttcatattagtgttgaaggaccaaattaattggttaattagtcacgtgtaacggctgtgctcaatttaaattttttgaaaaagaattgttaattttggaacaacataacaaatattcagcaagagttttttttaaaaaaaaacttcagttagctccagcctttaaaactgaagtttcggtcttgaagataaaatcatttttttgggggaaatttgattatgtcccttcattttgatctaaaactataaggattatcattatatgccaataacatgtggcaggtggggtcataaaggtcactaacattttcaaggatggtaaatctcaatcaatcaatcaatatatctaatatctaatgctggcttttctgccagtttctgattggtccgaattcggacctacgattttgcgacacgtcgcactaggaaagaggagtatgagctttggaacaagtaggaatactttatcagggcaaaggccctctgcccaagccggtgggccgagcctgccctactggtctggcctggtatcagcagcaatgctcaagttaatcggtttatttaggaaatttcaatcgcatcaattaatggattacataaatttcatggggaataaatcatttttatcaattaatgcaagaaatcatccaaatatagatcagattattactgcatcaatgtcaagtggcatagtgatatcaattttaagatttaaaactccaagtcaaccaccttcaaacaagcacagaaaaaactttgtcctgcatgccttaattttatctacaattttataatgaattttacaataattaacttaaaaaaatgtaagacttatattttttttgaacgagtttatgttatatacggctatacaccgtctcgcgtgcctattgggcacacctattttctagtttcaatataaaaagagggaatatgatcacattttactatttaaatggaatagatttagattatgaaaggactttataagactacaaatccgcacataccatttcacatgatcaaaccaagtattaaaattttattccagttttaaaggtttgagaaaagagtaaaatgtcataaaattatggctggagggattattttgttggacttaagtaatggacccgcatgtgagtgcctaatttgatctaaaaaaaaccaaatgttaaacatcaattctaacaaatgtgagcctgctctttcttctccattccacttggtctgaattagttatctatggcatctctggttttgcatatagaatctgaattgacagagcaacacaagtgaatacatttctcaaaatgcttgggtgaatcgcattgcacagataagtttgttaaaatggaagtgtctctcgcgtttttcaaaccaacatgacccggtttgtgctatgcacgaaaagccaatgagatatgcgagataatcagcatgcaacattattttcttttttggctataccatcatcagtcgccttgttcaccaaacacaccaaccatgaatgtgtgctgttcaaagcacccaccgctgctaagtgtgagacagacagtatggtgttaattaatggctatcaagcttctcccgtttgttcggcaccggtgagatactcttgcacattcaagaatcgttgatcaatgaggcatcttatgtttctcacttaattcctgcattcctctcattctcatagcactctgaatctgttatatacataattctgcccttgcacacaacaatataacttgtggacactctaatgcttacacaactcctcagttaatctttttgcatccttatcatctgatctttcttgctcacgtgtagcatatccttatgtagcattaataatttcatattaaaagcgtactcacgtgtgcctaatatttatatgcacttggattaaaacctatttggtgagttatttttaaataggaatgaatgtttaactttaacaaatcatcaaacataaattaggtgatatataattgaatagaaaaccaaaaaaaatgtaaaaaaagaattaatcactgacaaacttatcaagtatataatgtctaataagaatcctaattaaaaagcatgtcatgtgtagagaattagtgcaaatttagaagaggaatgaatcaaccaggatggttgtacgctatagatataccaaggcattaattatgttgaacatcatgtaagaagttataatataccaacctgttcactcaaactcctaactcaaacagttagctgtgactgagatcttacgaactaatggaaatcatcaaagttcgttcttttttttaagattaattagtggtaatctaaaacgagattagttaatgcaacacaaatcaagcatatagcccaaactatatagatgcacttaactagacaaccggaggcccttagacacctggggcccagggcggcctcactgctcgccctgccccagggttggccctggcagcaaaggctgaagcatttgcacctaagttagggccggcgctgggctaatgtggatggtgcgaccgtactaggacttaaaaaattaggagcctccaaaatatgtattctatggtaccacgctgctggatgagattgatattgacactatcatcattgattttgcatctagaattgttagaagaaattattttaaatgatctagagacatttatttttttattttaaacttattagtgtgaaattcgttaatgacaatgagtttttaaatattatcttgtatttttatagtgaatgggggccttcattttttattccacaccgggccaccaaaaagtcagggccggccctatcctgagtcctcggcgatggcgagcaccatggcttgaggcgctgaggggttcaaatacggtgacaatgacagtaagagcatgatggcccagatactctttagttctttaaaaactttttggcaatgtgcaactacttccgaacatccactacaccatgtaccaaaattggtgacaaacatcgtcaaaaaaattcatttttcgttcattagaaacttggaacaacaaggggaggtaaacaaaggaaaggcaaaggttgaggtcaaaggatcaggcaaaccttattgttatagatgttatactaaagggcatacaatgcaggaatgttcttctaggttttactatgagatttgtgaaagtgaggatcatgttgcttctcgttgcccaatttttaggtcatctgttaaacctgttgctcagttatgtggttatgctgaagatggtttgggattcttccatatacctctttagctggaatgagggttaagcatgagcctaaagcggctatggttaaggtcactaaaggacagatgtctgtaagttctattatttctgagttggagaggttcatacctggtagatgaaagtgggtggtgcatgataatggtgatgggacttttcgttcttctgcagctgaattaagtcgtatggtcgaatggggcaaggtacacactaaagttggtgaggctgaaatgaagattgtggaaaggggagttgggaat

SEQ ID NO: 30852 - DNA, 5382 bp, Oryza sativa
tgcttgtctatcccaggagaagaaaaaagaatcgaaccacgtttcatcctgtacatcagaacatcccatgcacaacatgagtatctatctatctatctatatctatatctctatatcttctatactaattgggcactttctatgaactctcatattaatcaggcagatctaaccgttaattaagtagatcagataatcttaaccatagattattaatatctacttaacgtcacggcctcatgggccacgcaaagcccatccaatttttcactaatgtatgtacacaacatatctgccatacgtacttaatataatttttttaaaaaaattgttgccacaataaatgtatgtatttgtacgaattaactactttgccggattcgatagattaattcgaagaaaattttaagaactatatattatatctttactttcttgttcactcacgcttcaattagtttgaatcccataaggtttaatttttttacttatccatgagaattgaaacatctttctaagtgaagaaagtacgtatgcacatattatacttagtacaaacagatagcctacacataagtgaaaacacattcatatctagcagaaacccataaagttaatataacaaacttgtcaaaaatattatcttatattatttgacaatcagaaatatatctatctatctatacctatactaattgggcactctaaagaagctcccacgttaattagaaacatcccactgttgatttgatagatcgaattatcctaactatagattataataaattttaataagcattaattaacgttatgggccttctttaaagcccatcaaacaaccaatactttaatgacctttccaatatctgtctttatctcaacgcctcttcgtttttttgttttgtccacactgcaacgtcgtacaacatgggagaacacaagaatatcgatggagaacatggcatcgatcaaatacgagagatttctcagcacttgcgcacattgatcaggcacgcaacaagtcatcccggctccatgcatggtggcagcgcaatactatcaaacctagctaggtaatatgcagcttatacgtatacagcagattgcacgcaggaggcagtggtctgcgcttgcgatatgcttaacacatttattgtatcagctagcaatcagtcaatcatatgcatgtgtaagttttagacgcttccacagcaacagcaacagttctctttgtacctatcaaatacaagtctctcatatggttaattggataatttccctttatatatatgtatataccatatttttcattcttgttttgatgaattgttatttgttgtccaaccggtttgatttttctcctcaagcttttaaaagtacatggttcgagtatcctattatattgatgctgttgctgtcatgtcatgttttttcaccaatatcaagaaagccctaacttccacttcccgtatatttcattttatgtgagtatgtgatgggaaaaaaatcaacaaacaagtagactttaacttccccgcatgcatacaaaacgagtgttaactatacaaaattcctgcatgcatttatatgcagactcaatttgcattcataaaataatgctacatgtcagacgaggcttacatgatgatcaatttgaaaattcagatttttagttatatggtaaccaatatggagcggtgggagtaatttgtaactagattttggaagtattacttagctaccctcgataatttccatgtatatatgaatataccgtatttttcattttcttttgatagtttgtgtgtatttaacttggtccaagtagtttgatttcgtcctcaaaatttatattttaaaatcgtattctttaaaaaaaatcaatttgattgtttctttatacatgtttctcatctgaaacaagattgaccaggatttaaacacaccgtcaactgactcgataaaaacaacttcattgcaatttaaaaatggtgtacttcactattcatgaacttaaatatcatggtcctaatacaattttaagatctgcattatgaacttaaatattgtggtaaataatttattatttaatatcttaattgaattaattagttttttcattaattacacaatcagttgaaagacccagtgttctagttgcagtcatgataaataatttgtgttcaaaaacatgtataattgaattcaattaatatatatatatgtagttatatattttaatttaattttgacttccagaaacatatataataaaatatacaacgacttatacatgtaacttactttcaaacataatgtagtaaccaaaatattcaactaataacacaaatttagtatggtaaattaacaaaactagcccgtgcaacgcatgggatggcgactaataatactaaattactagggatactactaggtagctcatccgtagaaagtgcttgggcggttgggccccttagcccccattctttgtccaccactgcttctcctcgctgctctgcttttactctgagtcagttacaccatcttgatcaacagcttccacgttgcctttcccatcttcatcttcaaatgttaacacatggtttttatttttcagttgttcttatgctgagactttcgctataatttttaaataagatagtattataaaatttaataagtttatgatgtcgtgacagtagtttcaaatataaatctaaatataccatttataattttaaaacatatatttttaatttattgatagtttttttacaactaaacttattgatagtaaaagtttcaaaagtttgataaagagagtcaaacatctttttttttaccctttttctttcctcgagcaatagtcccacatgtcaattcctattttgttctaaatagccataggttaaacctttaacctatatatgttgcaatcgtttatagtactgtttatatcaacttgtaattagccatggtaaagccttacccaaacagttttctttttctcaacaccacctgaatttctgtggtatttctatggtgaacatatatagactgaattaactgggtgagcaacagaagtgaatccatcttctcaaaacgtaaggatggatagcaacaagctagatgggcattgaaaggagagaaaagaagctgtgctaactcatcttgcatttcctatcaccatccttcccattttccagcaaatacatcatttacagtgtgtgtgcaggacaatgaaacccgctactgctaggggggactcaggctgctgtctccttcacacggctagctgtatggttctcaccaaatgttcgacaagagttcacgactggagaaactatcattcgtgggtcggctaaaaatcacaatagtcttggttactcaaaaaaccgagactaaaaatcatttttagtttcgtttaaaagtgcaacggaaatatatgatctttagtcccggttggtgttaccagccaggacccgtttatttttttgtcagggtgtgtcaggtcccccaatatctttaactaaatatattcactttagtcccggtttgtttaaacaactgggatagaaaaaagagccaagctacagagtcatccttctctcccccttcccttatcctaattttcttctcccctcctccttcccctcccctctccttatactctcctccccttcacagggcgctgcagctgctctggcggccccttgcggtcgtggtggaggggcgtggcagcgggggagcggcatggtggggcggcagaggagctgcacgcacgcacggctgctctggcggccccttgtagcagcggcggaggggcgtggcggcagcgtgggagaggcatggcggtgcggtggaggggcgtggcggcgcggcggcggaggggatcgtccagggcgcggtcgtcgccgtattttggggattttttttttgagattttgtgatgtaaatttttggagattttgtcatgtaaatttttggagattttgtgatgttaatctgtcatgttgttgcattccatccgtttgcattcgatttgtgattgatggaaaaaagcaatgaaaaaaaacacatgcaagcaactaaaaacaatcgaaaagaaaaaaaaactttagtcccggttggttattttaacctttagtcccggttatttcaaccgcaatccagtagtaaagagggttgcaaaccgggacagaagaacgtttctccaatagtggttggatcatgcactgtctagaaacttagatgtttggtgtcgctccgagctcgcctcacttgttttttcaatgcctatcattctcaaatctcaactctgaatgatacctctcactcttacggtgctccgatgcttgcacaattactcgattaatcctgttccatccccatcgttttccgatgtttcttgtttcccttttataagacaaccataaatcatctggtagtgaagagtttgatggatgtgtgcctttccagttgtatggagttattgttcagttatcttgttaggtcccatgttcaatgagagtgtaaaccttggcatttatgcacatcagggaagtgttgttcaaatgagaaatatgaaaaaaaaatgttattttcagaaagaaaaaaaatggcttaatcttcacaaacatcgaaatgcaaaatatagctaactcactgctgtcgaattgactgactagtttttggtaaacattgttaatattattttttagactgtaagaaatctcctataggcgtacttgtactctgcttctgtgaaaattactaaattgggaaattcttattactattattgaaggaccaatttagttaattactcatgtggaacggttgtggctcacagtgtgtcagtaaaatccacatgtcagtgccatagttttggaaataagtacttctacatctgaatgtttgattattctttttaccgttttgaagataaaatcatatttgctttagtgggaaatttcatcatatatcctttgttttgatcgaaaattgcgtgattaccatctcatggcaatgacatgtgggaccatgtaaggtcactagcatgcatctcccacgatggtaaatctaaatttcaatatataaagagagaagatgatcacattttactttttttaatataactagaaaggtggcccgcacgatgcgcgggcatttatattgttgaaagataagattatagtttatttagaaattgtctcataggtaataaacttgggatcgatcaatatccttttaaaatgattcaggggttctattttcttaatgtaactcaaaaaacattcagactcttgaatacaagatggattaagttagtacatctttactaccgctagcttaattatctaccatatcacttgtatacat

SEQ ID NO: 30853 - DNA, 707 bp, Oryza sativa
tgaagttgaaaaattctagtttttctatgtttgccgttagcaaccaaatgaaaatactttgtatttgaatcacccttcaaaatatccttagttttagccctttgataccacttaatttcttcttctctcataagagtagataatctattcctacaaaaccatctaaaatcaatttcctcgtgaattagaagaacagattcagcctttttatccaacaaatccaacctatccaaaatctccttttttttcttttttatacataccacttgtatgtttagcccatcctctcaaatgctgtcttaatcggcgaatcttcgcctgccatcgctccataggagtattaccctcatgtacactagaccagacctcctttaccatatctacaaagccatcacgtaataaccaaccaagttcgaatttaaaactatgttgtgcattacctgaagaggtggagtttgtatttaaaaaaagtggagtatgatctgaaatatctctattaagagcaaccaccgaggataaaggaaatttatgttcccactcagtggacatcaaaatcctatcatgtttctcataagttggatttgctaagttatttgcccaagtataaatcgtacctgacatttgcaactccctaagacacagtccatcaataatagcattaaaaagaaagggccatctatcatcgtaactgtcattatttttttcat

SEQ ID NO: 30854 - DNA, 423 bp, Oryza sativa
ccccctctctagatctccacgtacaggtgcccacctacatgcatttatgcgacccaagaggtcgcgccgcaccgcatttaatccggcgtgcagtgtacacaaccggtctgtgaccggtcgaatgcccgatcggacaggctagtgcgcctgtgcgctgctcgtgtgtcagcggcgtgcagcctaacatgtcccatcaaataatgatggtaataggttctcatcatcttatcccagccggagtcggtcctaccgctctggtcaaagctaggctcccgtttcccggtataataggagcccagaagtcttcacccattaaatggtgaatgacatgggcgccccccgtgtcagccggcatggtgtggtaggccccacgaccgagccgacgtgtatgcggtatccaagttaaggtccaagacatgcatt

SEQ ID NO: 30855 - DNA, 7470 bp, Oryza sativa
aaaatttatgaaaccatccatgactacttaaaattttggtttgtctgatttgtttatttcaaatttagataatcacatattctccttctaatcggtgtgtttgtcattattcataataaaaaaaaacactccttgtacagctgacacatcatattgtcactcaatcacatacaaacgtaaaatatttgtcattattctcggaccgctcattcctcattggtatcttccactcatccatcatcttataatagaagtatacaccatattttgtctaactatttagtttacataagggacaacaccacgctcctcctccctcatgcatgggacacagtgtccaattttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacgttttcattttagcgaagcaatagcgctataacatcatgatcaccttagctaccttaggtatacgatgcttcgtcatgcgtgtaaaaggtaaagacgtcaatgtgttgtatagagagacaaagaggacttccgaggctagatctcatggtctaaataatatgtccaccggtttaactaaaaatcgataaacaaatatttttattaggaaatagtctaaaataattggtacataatatcatataatggtgttaactctatttttaaatattgtagatctaatttatttacatctaattgtaaagagttatatgttgacattcaatgttagtaaagcaactattatgtaaagtttattatcatgaataataataattatagtggctcaactaaatacatggaaaaatggaaagggaaaaagaggaaggtcctcctgagtggaaggaaaggagggtacgtagggagagaagaggtggaatcgtagtttaatctaacggcttataatattggacccaccaatttatgtggaaattaagggatatatgttttgttttttttctcaaattttgtagcatttggtaacttgagagcgttttgaggaactttaatggacatacgttgtatcgtttggttgagacacttatataaggacaatattaaccggagaacatccagcacgttttgtccctaaattgttttcgtcagttttgctttttataattttgtaacataatagttatctttatactatattggatttatgtaatacatagaagcaattatttataatgttattcatcaactgtaaagaatggtaggcttattttctttaaaaaagcatgcatactaaattaagtgttaaatgaaaattaagactttttaattggatataggttattgttttctattaatggatgaattgggtggacatgaaagtccactaaatgcattggttatatagtctaatatgatttggtgtagttcgagatgcggcccaagaatccaagaattgagaatttttttacagtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacatacctcataactgttgatcttcgttctttctgccccataatgttttcttgtctgtaaactcaaagtagtagtccgagaaacattcatttttgctttgacctattttattattgtatcgtgataaaaaaagattttgagatatctttcggtaccagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataataatcttgcctgcttgatcgatttaaaatttgctaatctactgaccggtgtatatatgtatatgtagagataatgtgatattaagttgaccggtgtatatatgtatatgtagagataatgtgatattaagttgacgtaggatagctaatcttgccagcttcattgattcaaagtaggaaactaatcttgagataaatacgctccatgttatgatcatggcaaaagcgcacgtgtgggtcctcaacttctaggcgcgggttcacgttgtgcccatgtggcatattgagagcgttttgaggaagccacatggcagttcgagaacgtttgtagaaagtttaatggatttttaatatataatagataggttataaagtctaataagtttataagacaataacaatacttttcactattgcaaaaatacgcacatataccattttatatgattaaaccaagtatttaaaatttatcgtagttgtaatcgtttcagaaaacagcaaaatgtcataaaatttgaccggagggagactttttttttttggacttaagcaaaggacccatgtgtcagtgtctaattttaatttgttctaacaaatgtgagcctactctttcttctccattccactggtcagaatttgttttctacagcatgtctgcatttgtatatagaatctgaatttacagagttagcatcacaagtgaatacatttcttgaaatgttcgggtagcagcggagtctagaccttgtttagatggtactaaaacttttaagtccctatcatatcggatatttggacactaattataaatattaaacgtagactattaataaaacccatccataatcttggactaattcgtgagacgaatctattgagcctaattaatctatgattagcctatgtgatgctacagcaaacattctctaattatggattaattaggcttaaaatatttgtctcgcgaattagttttcatttatgtaattagttttgtaagtagtctatatctaatactctaaattagtgtctaaatatagggactaaagttaagtccctggatccaagcaccaccttataccctttgaaaactccaagcgtttttcaaactaatgactcaatccgaaatcaaagtgcaacataactttttttcttcgcttataccactcggccgccttgttcaccaaatacatcatctagaatatttgcaggtcaaagcacctactgcagctatgcttgtggcagaccgtgtgattcttatgccggtgtcttcatccatcttcgatcagtgtggcgtctactgcttctgacttgcttcctggatacctctcattcccttgacccacatttatacctctcattctcatttttgtacacagccacacctctcattctcatagcactctgatttctttaaactatgccctctgcatcaactatagacgcacacaacaatttaatttgtgggaactctgatccatgcttgcacaacacacctagattgatctttgtttcatactcatcgtgtagtcttttcacttcctttttatacactcgggatgaaggctgtgtttagtttctaaaattgggttcaagtttgagaaaagttggtagtttgaaaaaaaagttgggagtttatgtgtgtaggaaagttttggatgtgatgtgatgtgatgaaaagttgaaaattggggggaagtttggtgtgaactaaacatggcccaattgtcaggctgtgtttttagtgtggagttattgttcagtaatcatgttaggcacattggccccttgatgaatggatcgagtgtaaacctttgcatttatttatgaacaaatgagcaacctttttttttttgttttttcagatgacaacgcttgcaaaaattttgttcatttttaaattgtcgcgtgacctctagaaacatcaaaacgggaaactgaagaccaacattccattggccaatgccaacagcaagagcacgtcgtcatgtgctctgcaggtgtcttcctcttccacctctctgatggtttttcttgtacaaaatttagttggacttgtttcataaatcattgtttgtgtccatgaacagacaaggaaacgataaataatccaaatgtgttcttttatgtttatttattattgagccctttcatgttgctccacttacttccatatggggtaagagctcaaagaaatcccaaccgttgattattgataattgttttgttaaataaaaacatatgagatcatttcattaatgatgtaattccggaaagggaagtaacggtagatatattatacttccaaatttaattatacatgttaattctaccatatatgcaacatcatctgttaaaaaaaataggacccttcttgtcaaaaaaaagtgagagagttttgactaaattcaaagtaatttcaaaatagtttttgaacatgaaaataattattgtatttggagtctctaaatgtcatatgtgaaaaaaaaaatataacttaaaatttcaaaattatttttctaaattcaaatacaaaccgcagcaagaaatagaaatagcatttgactatcacagttttcattcaaaatttgaacttttaagcagttttaattatggtattactgatgaatcttctaaatacaaggaaacattgccctcttctttaaatgctaattagtaacaacttaccacctaagaggtaagaagaatattaacccttggatcctaacataatgcattgatggtccagaaagttttggagtacggtaaaaaaatcctaatttatttattttgttcatgtacaacaaaaaaaaagagaggatacaaacttcattgttgttcaccaaaaatttgaaaatgtgcatgtatttctccatcttatatctttgcaagttcatttctcttcaagttccatccaaatagtcgaaaagtgcttaaccttccatatcaggcaaccaaatgaatcaactaacgtgaattcaggataggtctaatgttaggatccttgtggaactcgtccatttggattcaagtcttaaaatctagaatgggtgcatgtattttcgttgaatttaatccaagtaggtaatacatacatgcatgcacatgtgggtatgtctatgtggtaaagttattatccaaagctatgttaggctatgccttcaatctttgttgagatatgtggtaccatgcactgacggaatgtgtgcgagtctgaattatagtaaaaaaaaaaagaaatcaagtagatggatataatgtactcgcttggcactgcaatcatttgtattgttgcttaagttaaccgagtgagaaatcacaagtgcatccatcttctcaaaactttaggatagcaaaaagctgtgcattgaaaagaaagaataagctgtaaaaactcattttgtgtttcccatcaccgtcaatcccagtttccagtaaatacacgatccacaagggttgcaggtcaaagcaaccacttctgctgtgtgaggtactgaggcaggcagtctccttcactatctgtctagctatcgccaaatgttcgtcgtgagtcgcagggacaaccccaggtcctgggcagcatcggccacggcctgatcatggggcgaaaggccaatttaactttttatccaacgtttaaccattcatcttatttaaaaaaatttatgtaattactatttattttattatgacttgattcgtaatcaaatattctttaatcataacataaatattttcatatttgcatgaaaattttgaataaaatgaatggtcaaacgttggtcgaaaagtcaacgacgtcatacatttaaatatggagggagtactatttttcaccatgtaaatccgtgttgctccaaaacttccatgggcggccccggctatatatggtccaattcctggtccgcccctcactggtctggtgggttagatcatctataattttgaaacttgttgatttttgagtttctctcacttgtttttccgacgcctcacatcctcagatcttaacggaataccctctcgctgtcatggcattctgatgcttgcactactccttgatcaatcatgtctcattcccatcatcgtccagtctttcttgtttcccttttatagatcaggatgaatcgtctggcagtggagacttcgatgggtttgtgtttacagtactatggagttattgtccagttatcgtgttaggtctcctgttcaattaattcaatgtgaatcttggcatttatgcacatcaggaaaccagtgttcaaacgataaatatgaattttttgttattttgaaatgaattatggtgttctttctgcccaacaacagaacagagtcttacaaagtaaccaaaaaggaaaggaacaccaacatattttcatacagctgctgggtatgccagctttcaaaaatgcataacacctctaagtttctgaactagtttgttcatagaacccctcctgacaaaaacttcagatgtccatcggcaaaacatcagacgaaatatgggttaatcttcacagacatcaaaatgggaaatgtagctaactcgctgccatcaaatcgactgactagctagcttgtaaacattgtttatatttggtttttgagtaaagtccatcaccggtccctaaacttgtaccgctgtgtca

SEQ ID NO: 30856 - DNA, 3086 bp, Oryza sativa
gttgtttgaagttgtcatattttcaaattcaaattcaaatggttcaaaaaatattatatagaaaaatgaccaaaataaaagttatagatcttgatgagttatacaactttgttgctgatgactttgttgctgatgactttttcagttgaagtcgttcattgatctaaaattctatttgaatttttcaaactttgaattttaaatttcaaattatttaaatagagtcagatggagaaatgaccaaaataaaaattttgcacctcaatgagttctacaactttggttttggtgacttttcgatttgaaatcatttaataaccccaatttttgttcgaagttgtcaaattttgaaaattcaaaatttgaatctttcaaatgaatttatttgtacagaaccgatacaatagttttagatctcgatgagttatacaattttgttgtttatgatttttgcatttgacacacaacaatcggcctaaaattaaatttaatgttctcatctgtgacgggctttatttttgacagatctcaatgagttctacaactttatttttgacagctttttcatttgagtttttttagtattataaaattcaattcaaaattcattttttctagaagtctgatttgcttcctcttcataataatacttgctaaatataatatttgatccaattaactcggttttgctaatataatatgtgaaatatgtgaatggatatgaaatatatgatcaaaatggatgttatgtgaatgtggttgtgttaaatatattgatggttgtgtatatgaatgaatgtatatgaatgggggatgttggggtgtgacatcctagcctagggcttaataggattaatagaatactcataccaagaatttacaactattttttcggaagccgatctccaaagaactttgatgttaagcgtgttagccctggagcaatttcgggatgggtgaccaaccgaaaagttcatcccgggtgcacatgagtggggataaaaaagtcacccaccggaaagttcttctcgggtgcacatgagtgaggataaaaaagattggcatgggagaggcgggatggcatggcatggctagccaaaaaatgaaatttattttttttttattatactcatctgtgacgggcattaacttatgcctgattgagatgagagtcatctgtgacgagctatagttaatacccgtcacagataagggtcatctgtgacgaacgctagttgtggcccgattgagataggtcatctgtgacgggctatagtttgattagtcgtctgggtcaaagctatcggtgacgggctttaattagggcacgattaagatagattcatccgtgacggccgtttgcccgattgagataactcttcacagctgtgacttctaacctgtgacggacgccatgcccgattgagatggggcttacggtccgattgagatgatggtatccgttctagtgacactttgttgccatatcgagtgactactagtgcttctgattctcatccgagaacctctgtatttgggatgcacctagtgcttctcacttactacctccatcctaaaatgtttgacgccgttggcttttttaaaaatgtttgaccgttcgtcttattcaaaaaatttaagtaattgttaattctttttctatcatttgatttattgttaaatatacttttatgtatacatatagttttgcacatattacaaaaggtttttaataaaatgaacggtcaaacatgtttaaaaaagtcaacggtgtcaaacatttagggaatgagggagtatttcctaaaggcctctcaatctcacccgaatacctctcattttagtggcactctaacttactcaagataattctggcatctgctgcaactacatgtgctacactcagaaatttaatctaagagcagtcttatgcatgtaaaacctctcgagtaatcttcgttccatccgcgtcgtttgatctttcttgcttccgcgtagtgaaaagtttggtgcgtgtgtattgttaatgcgatgttattgttctgtaatatatcttattaagtacttaaatcctatgttgaattgattgaatgtcaattttctgcaattatgcacatctgttctgaaattagaaaccctcgctctttttgcttctttggatgatgactcttgtgaaatttctgttattttgaaaaaaaaattgtggaatgaccttcagaaaaatcaaaaatgggaaatttaggtcattgccaccaaatggttttaccatttgactagtttgggagctcaattgtctctgttacgatagtcaggagattggttaattggtcgcttggaattctacattgtcatattctcaacatttttgagaatattctacattggtcgcttgaactcgcatcacaagtggatccatatcctcgaaattcttgaataacaacagagttgcaaaaaaactgagttgtactgttcagaaaacatcatacagctaatcaaaatccacgcaaatttgttgcaaaagcaatgagtttcttgcggacttgtgattgatgttgttcagacttatgaacccaaattgcacgacaaaacaattgaaaactgcagaggggagtcgtagaaactacactcagaagtttcctatccccatcggtagcattttttacagaacagaatggatccaccatgtaggcggttgaaagcacctactgctggtaagcatgaggctgtgtacttctcaccatatgttggcaatcaatcaggtcatgttgaccttccgatcctacttgatccacaatgaatcttgttcttgtcacctgtttcctgaatacatctcattcccaccctcgtgtacctctctttttttttcaaggcattctgattttctttagataattctggcgtctccaccaactatatatagatgcagataacaatttgatatttgtatatgtggatgcttgcacaacttctcgattaattaatctttgctacctcctcagccatgttttttgcttccttttttagaccctgacgaatagttagacagtggaaagtttggtgggtccattgtgaagttgagggtctat

SEQ ID NO: 30857 - DNA, 6389 bp, Oryza sativa
cgtaaaaagaagaaggtgaatcattagcgcatgattatttgagtattatttattttaaattttaaaaatggattaatatgcttttttttaaagcaacttacctatagaatttttttttttaaaaaaaacacaccgtttattagttcgggaagcgtgcacgcggagaacaagagaaatcttctctctttcacctgctgctgaacgcagattagtcgatatagctggtatcttactatgcatcagatctgatacccatcgatatcggctgatacccatcagtatccgatcttgtacctatcggacatcggtaccagacccgataccctcgttaccagctcaacgatgtcacctcctccagtaccagctccttgttgtcgcccgcacgtgtagcattgcgtgccttaggctacaaaattccaatcaataccgccggcgaagaggaccatcaggactgcctcgaacaaggccttgatcatctgcccctccaactgcctcctccgatggaggtgctaattccaactgcaaaatcgtgaaacatagatgtgtaggcgtgtagctgccatcttgttcaactccgatggacactgtgctgtccttcagcgtgcagctgctccattacggagcttgagataccgcggagttttagttggttatttcctatttcaatctttacataattttttgaatttttttctaacaaaatctaacatttaaaatcttttagtttctactgaaagttttcatagaatatttttagaaaaattcccatgcaaaaatctaacttcctattaaaggtttattcccttttttaacagagcatctatgttttatcttaaagttacataaaaccctactccatgtaccaaaaaaataaatatatgatatgatgtaactcattctactactacgaatctggacaactctctgtccagatactactagaataagtagtactaaaatatgtcacattttgctttaggtgtgttttttgtgcgacaaaggaagaaggtattataaccggtgatacataacctcggatattatggttttaaagtttcataaaaccccacatctatgtatgttgagcaggaatttacttaagattctaaatcttagagtgtatatgaaatttttaattattaagttcttgataaggttgatagtttaactcttcactactttgaaaaaaaaatgtttcaaacatgttgcaattaatcaatatttgaatacgtgtggttttataaaatagttagaccataaaacctatggttaaataccataagccataataactatagttttctgtaactttaatcataaaactagaaaaaagacctggccgtgtgttgcaatgggaaaataaacattacaatattaagcgatgcttgctttactggcttcgcctcctaccagctgctttacccaaaggctacctttcggtgcaaggtacgccatgatgtaatccatatgacaactttctgctcttctctcacccgcacacttaaataagaattggcattgatgaccaccataataccagtttaataaaaaactaatagtaatatcataagtgtcgatttaattctgaaagctagtttgattagcttaatttcgtgaaggggatggacacacatatatacatgtctacgtgtacatgcaagtgttcctagcaatatatctgtgtagtcccaggcttgattaattcaatattattttattttggtggtgataatgctggtttagttagctacagagtgacacattcatagcactcgcagactcagtcttatttctttctcaactcccatatctctttcttccctgtcccatagccacacatagccttctctcgatctctcccgtgtaggatctaacaacaagaattaagccaaccagaaggggtgaatggttgtagaacccaaaaaccataacttttatcggaattaaaagttactctcgaatttgatatagatcgatctgaccggagtatatgcgtcggtttgaccgctcgaagaccttcgatctgaccggtataattgctccggcctaaccacccgatgcgtcgaagtcgctagtcgtcgccgccggtctgaccgccgtagtgttgtaggtctgactgcgccgatgtcgtcgttctgaccgccagtgtcccatcggttggaccaccactcccatgcaagatctctcaaagtagattgaaacttcattacttctattcgtgtttataaagtacaacaacaacattcctgacaaaaatctcgactaaactcgaaaccctaacttttctcacaactcaactatctaaaaatcgatatcagaaggcgtcaccctccctctctatttatacccaaggtaagcacaaaaggcacaaaccaaccttatacaagaagttctaatcccctagaaaaacattcccaaataagaaacaaacttaacaaattccaattgtaccaaatttggactccctccaaatttaaactcctcatcccatatgcacacaatatctctgtcgtttgccatatgaaatattcatcaatcacgtgcattgatctctagcctaagtatcccacaagatatcccgatcgtccggacgtcatcatatcccaagttgactcccgatccatctccagcaatgctcttccaaggcatcaagactcacctacacatgaatcaaacacaaaaccatatccgagcacaagttctctgcaatttagtcacaaaacatgaatgtttagagctccatcataataatggtactagggatttgaactctaaaagctatagttttgtgataactttgatattaaagttgtagttctatgataacttcaatattaaatatgcagttttatgatacttaactttaaatctatagttttgtgataaatatggtgctaaatttgtagttttatgatacaacaccttaaatcaaaatacatgtagttttgtgaaatttactcaactatatgtaatacacattctttatcagttttactctctaactaggaaggtggcccgcgcgtatgcgcgggcacatatattattgaaaggttagatttttattgtttgttaaaaaaattatcacatagattaagggcaaactaaagttcggatactgttattttgtaataatttaagggttctattttttttgttaaggtatcttaaaagtccattcgcaagcttttgagtgggagatggattaagtacttacgacttttgaatcatatttttttcttaagtaaatagattaaatcgtctcgtgaaggtgcatgatatagtaagaaagggagggaagcatattcatggagaaaaagaagaaagggaaaaataaaaaaaaagggtggggaagcgtaggtacccacgtacataggtgcgtaccaaaggtggagaggtgggacctcgtagtatttagtttgttctaagatcaatttaatctaatggtttataatattggacccatcgattcaagtgaaaatcaagtagtagatactttgctttttttcttagaatttctaatattttctctaatttattagagcaccacgtgacatcttgagggcattttaagaaattttagtggacttaccacatgtaattagaatattaagatgtaatatatatatgtatgggatgtatgttcatattcgttttagcttcgtccatgtttatatacatgtagagaaaaattaaatatgttgctagcaagccattagttgtttaattaatagcaattaattttgacacctatttacaattggtcatagttgttctaacagatttatcttacgactttgattatgcgttgatcaccaatttacttatcaccatgactcgcatgaaaaaaatatgtactttaggggataggacaactgaaattgatgaattatctgatttatgtgatagctatttgagattataaacgaatgaattgacttctgaaaagttaaaaagttgtttaagaaaagcaccatttagtaacttggaaagcgtggagcgtgcaaacgaaaattcaaaagatggaatcagggaaaaaatagggccttaaactcccttgtaacactcttatcctagtaagagttctgttgatattcgttaatattgtgctcacaattataacataatgatttctttcaactgtacgaacaaataatacaaaatgcaaatacaacataacacaatacattataattattatttaatcaactctcgatttcagcttaaacagagttaagtgttccacggtacttaattcttctctcgctacatcacatctttaattttattttcatgctattaacaacaacggtagcgctgcagcggtcgtgatcacccaagatgcctcaaacacgacactctgtcacatgtgcgaaaggcaaaggtgcagatgtgcattgtggagtgggccaaaaagagaactttagacattattaacaatagatccgatgatttaaataatgggtccaccggttttagtgtaaatgtaacttagttaatatatatgtatatatatatatatatatattaaattgttaatttaatgggtacacaacattatggtgatggtgtagattttattttaaaacactgaattatttgagaataataatccaaagtaataaaaaatagatccgatgatttaaataatgggtctatctgtttaagtacatgtatatattagttaatatagatcttaaattgtttatttgataggtacacaatataatattgtgtaagctttattttaaaatagtgcattatatgaaaataatagtatttagtaaattatcttacattattgattttagagctaattaacatataatatggtgtaaattttattttcaaagtctgcatagctaatttagttacctgtgtttataaagagttatatgatggtattttctttttttctaaattattattatttaaacaaatatatatcagattgtataaatggaaaaaagaagaaaaaaaggaaaaaaatggagggaggcgtacgaacaacaggtccacatgcatgtacgtacgtgacctatacctatgcacgcgggagaaaaaggagaggtgggacccatattatttggtttgttttaagatcaattttatctaacggtgtataatattggacccactaatttaagtgaaaatcaagggtagatgttttgcttttttcttagaatttctaggattttctctaatttattagagcgccacgtggcaacttgagagcgtttgtaggaagtttaatggacttttagtatataaagatagatagatagataaatagatgatagatagatagatagatagatagatagatagatagattgtcatccatgcatgcatgcaagcaatatcataggctcaaattatccttgatgcatgtgcatgacacaagaaacggtgttgcatgttaatcgatattaattcaaatcgcttgtgagggtgtattggtatcgatacacaaatcatatactccctccttatcaaaatctaagacctatttatttttcaatcaataccaaaaagcaattaacttaattaccaataccatgtggcaaaatcaatgaatatacaaccaataagtattagaataactttttatttccgatcaacaatttaatttagcacacaataactataaataggatttagaattttaaaaaaaccaaagaatgaaatgggtgtcagattttataaggagggagtactgtatatgctgataatgcatgtgtatggaggggagtatggtggttcctagctgctgccttgatcgccgacttccacctcgcgtccaaccacctcgatcggtcggcgcctccgcatcagcggttggtcggccaggtggagaagctgcggcttgtgtaacctctctctcacctcctcctcagccaagattaatctctttttatctcccccttctctgcacggttagagcaagcttaatattataaccaactgctagctctaaattatctttggtcaatctaatagctcattcatataatagttatttttaagcattaatatatagtcccacatctcatacacacaacgtattagaatccgtgttacagttggctataaatctagcctgatttccttcgctccagccagcgtttctgctacagtacgtctctagctatgtcgtcgtctacaacctggccggtacttgtgacggcacctgcacctattttcattgatgcagtggatcatacggtagtattgattactatacccaaatacagtactattttaaggggtaataaaagtataaaacacatgattgtaggttttagtgaccgtcaaattacaggtggaaagatttttaccagtgaaaagaaataggtaatctccaaagcaggccctataatacaaactgtgcg

SEQ ID NO: 30858 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnnnnnnnngaaaccatactttttacaggatttttgcatggcacaatagcggtagcgtcgatgaggcgacggtgtggtcgacctcatgcgcgacactagaacactgtcacaccctgaagttctctccccaagcctaaattgaatttataaatcaccttgagaaaatatcggtgtcaaagcaagagaaaccctaataaattaatgcaaataataatcggaattggtgtgtgggatttttcttgagttctacatgtcgaaatatgctaacaagatttttagtggaattttcagagctctagaaataattttaaccaattaaaattgagcacaagcaatatttaattccctggaaattcttttcctcctttttctttctttttccctcctttttcttttcaggatgggccgccggcccattctctcttcccccccattccatccgctgggccggccgacaggtcgcagcccagctgagccggcacccctcctctcactcccggggtcgccgacaggtggggcccacctgtcgggtccgtccccaacctccagtcacccgcaccgcgcccgcaaccggcaccgtgtccacaccccgactccaccgggccacgttggccacgcctgcgcatgcgcccg

SEQ ID NO: 30859 - DNA, 209 bp, Oryza sativa
ggggatgaggaggacgacgacgaggatggcgactgaggagtggcagagcgtggggaggatgcggcagcggtgggcagcgccgaggtggggggatgaggaggacgacggaggaagcgagcgcggtgaggcggttggcggggggacgatggcagaggaggcgagcgcggttgacggcagaggcggttggcggcgaggcgagcgtggcggca

SEQ ID NO: 30860 - DNA, 12545 bp, Oryza sativa
  unsure (1)..(12545): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcataaaccggctgtatgagaacctttttaagtgaactaccaatatctcaggcaacctccataagtcaagctttttgctggcttgcttgtgctccgtgcatctcggacagtacctgctcagataagcaagaaaagtgatgcaagctcagacattgaccaaggtgctttctttatggaaaaaacagagcaatttgcaagtatcagtcaataagacagaaataatactaaccacatgtcatcagggcccagaggttcatccttcagaaaagcatctaagcatgaaaataaattgactgcttcttgccgatttttctttgacataaatccaggcttgaagaccacagaaagttcatccatgtacttaatgtcatatacttcatgttctctatcagaccagtccattaataacctcatggtcgacccaggaacaccgttagaatctgcatcaatatgctctctcttattagctttatcatcagtcaaccaaagctgaaatggcaaaacctcttcatcagctgcttcctcatccacatttgatgtagatacatcttcctcacaggtgacaccattgtctgtcacacaataccatccaggctaggtccattgctatttaacttggttgcagattcatccagagtatgtacttttgcccgcacaaatggagccagaagtgaagagacagttgcataaatatcagcttttcttgtagagtcacttggaatacaagtcacaagagggcttccaattagcttccgactaagattaaacatggactctgaagtatatctgcataaattaacaaaacaaatcaatgtgtaagcacaaaaatggaaaccagttccaaggaatagaatagtagaaaaaagaaaatcactaccatcaaatacatggcatgtatctgaggtaagaaatctcaatgtctgtagcattttttttgtcagctacactaaactattctcacgaatcataagcacaaaattctcactagaaccaaaattcaaataagggcagggttcacctattctaaggagcaacaatagatgaacggacatcatggaaacacatatgtggtccttgctaacataattacagactcacctatcaaccacccgatgcaggatctctaccctcaagagattttcagagccaaccggtagcctgtaagcaacaagtttgtcttcatcttttacatgacaaagtggttctgatgggttccaatagcggtaaatccgatgatcatatacctaaagaatatgatgtttattagctatttactgaaaaagagttatgcttcaaataacaccattgctacataagaacaaactggattttttacctctgcaagtaacagtgtttcgcaactttgtaagcaacacataacactcagagattttataagatctccacaaactccattcttttgtaccttcacagtgtaaggcatgggaagggcatctccagtaccactaaatacagttacattaatcatgcgagtaactgttgagggcaatggcagtgacaagtacatgaatgggtcaaatgtaactgaattttcttacaatctgggcaaaccaaagtggacttgtactgaccctgaaacatcaaccaaatgaattgatgttactgcagagatgtgacaattaacaattatcgtacaccacaaaatacgccaaaggggaaaatgctactgaaatttgaacatgtatatactccctccttataaaaatataaggtgtattcactgttattaacgtcaagactttgaccaacaatttctttattactaacatacatatcatttatgtgactcaaaagcatatcataagaaagttcctttgaatgtgaatctattaacattgattttgcatcacaaaaattatattctaacataataattgttggttaaagcctaatccaaaaataacatatgccttctatttttgtatggaggaaatattacagaatgaaagcaaaataactatactatctctcccacttcctaaaatagcttcaagaaacatcaatcatgtttcaccatcagagagcaatcattaatcaacgctataacattgttctttagtattttcttctattgaaaatacccatcactgcttcataaatcgaccaagtaataaccaacaattggttcaagccagattcaactcaagacatagcttgatacaacggtgccaaccacataagtgggttcacaggtcgacccacttgtcccaacatatatactaaccgatcagaaatatccaacaaattctacagtgctaactaataataccaagcaccagaactagctagtatcttgcactcagcagcaagtaaaaggctgagcagtttgtgaggtaaatcttggtacgctacatctgcttgcagacagacctggcctaatctttcaagcctagtctcaagaagataatcattgcaaaagcagcaagcaatggaaaaggtatactgatgcagtggtgaatagttgtgagcatacataaacctaataccaaaatgagccatgccacattcaagatttttgtattttcatttccagtttgattttaattctctttgttcggtaaatggctttagatcattatgccatgttaaagtacaaaatatgccaaccagcaaccaatcatcatgccaacggctcaagcacatctcacgcccctaccaaaccacaaccctacattcccgactagattttctattacatctctttcctccctcggttccacagtttcaccaaatcaattcaacgacagagcagcgcaaggcatggcaggcagtcacagagcggcagtggcacagcaggccagcaaaggagcaacgtcaagcggcacaggtcagcattggcatgttccgaggagaaacagatactgttttctaactgaaccaaactgaattattcggttcaggagctcttttttgtgcagcaatcattctggttaccactatttcaaaaccggttgtcaaaaaatagaaaacatccaacaaaattaaccaaaaactgaatatccccactacttatgagggctctacagaaaatagtacccgttctcatcccaaaaacggttaaatttttgtgatataaccactgttgaaatttcacctgatccctgcctcaaaaaataacctgtttctttaaaaaagaaaataaaaacctgttgtctgattacaaatagtttcagcattaccaagttcatttccataatacgaaaatccttaaagaccacccagagatagggaacctttattcaaaaaaatgcagaaatatctttaaaataattccagatccaaacaatatttgctccacatggtaaacatatacacgtagcaaagatttcattacctggaatttatcaccaatatatagaatcatttcgagctttatggtaattccagcattcctcagcaagttcttcatcaggacggccatcggcatcctttgcttcaatatatggtttctttttcacacggttgagatcttcatgcagaccatccaatagaaatgcaagtaactcctgcataaaagaggggcaataagtaacagatcaatcttctttaacaaaatgtgaacaatctaaattgccaaattttgtcaaataaatatagcttatccaaacaagaactaaacgacaagatgagggaggcactaatatatcaaaaagcataataaacaatcccttattccgaaagacacatttattaaaggttgcaacaggtaatattacacaatgaaaaaaaaatgtatggagaaatacatcaagttctgaaaacaagcaaagcagggatgcataagtagtgataaataggatgcatcagttcacaaaatgacaacaaactgtgtacaagacgatgacggttataaaagagaagattacagcaaggaagataacagggacgcaattaaaacagattctaaagatggaaaacatattcaggaaaagagctgaaaacttgtgtcaatgtgtggccaaaaaggatgcaccatttatcagaacagcgaacaagccaaaaagcagagacaatttatctctttgacaggacatgttgatttatgctacaagtcgttgactttttttctagtcaaacttctttaagtttgaccaagtttatataaaaatttagtaacatctacaacaccaaattagtttcattaaaactaacatttaatatattttgataatatgtttgttttatgttgaaaatgtgtctacatttttctataaacttggtctaacttaaaaaagtttgactaggaaaaaagtcaaaacgacttataacaaaagtttgagaaacatagatataatcatagtttgacacaatttaaataaacaaccaacactatggttaaaaaacaaatttcacaaaacctcaggtttggaacgattgtaacgcaaaatcccagcttttatatttgtttcgaagaaccccaaatttttggcccacactcttataccactatttatgcataacacttgtacaataaaatagtatgcggtattgtttttagtacatgtaagaattagacctgggagttttattacccaaaacctagggttttgtaataaaatctcacaagaaattaatgcatatgtacttcggaactgaaatgtgccttaacactaacagtgcaccggtgtgttgaaatgaaaattaacttcatagttctgggacacaacagcatgttatcttaaagtaagaaatacgtttataatgtacgactaattaatggaagttacaaaacagaacaaaggtgcaaaactcagtgtcagcaccatttaacagacatttataagaagtgtttaggagaaacattcggagcaacctgagaatcatgttgattgtatccactgaactgtggagcaaaacgagaaagttttgtcttgaatggacgtggagctatagaagttcgaccagctgaccaaagttttctcagtaattctccaaatgctgttgcaagttcaccctgctcaatggagatgttctcagaaatcaccaataagatcataagttcgcaatctacataataggacaacatgcattacctgtagcccaagtggattttctgtatttatctcccgactgtaatcctgtaaaaagtactccaccaatggaggtgtatgcaccaaggattgtatagcactgttcatgaaacatgtatttcccaagttatgtaaaccactcagtccatggatatcatcctttgtgccattggagaaactataaccatcttctgcgtcccttaataaaggactaaagctattatcttgggaaaaactggaaccaaatccagatgaaaaaccatttgaaaatgcaggacctccagcaattgaaaacgatgatgttgagggttccaacggaattaatgctagttcattatttgatcttgtaccaagatccgaacaccaagcatcatctgcctttgcctctatgataatctgcaagcataaagaaagaagttgcatcttcagttaatgtacagacagaaaatagaaaattgttggcttgccaacaaaataggggtaaatcgttaagaataataagattcaggacacccacaatacagatagtgaacatcttagaagcaatagtacatattcataccagtacatattcatacccgaacattgcaatggtgcaaatgtaaaccatattcatatgataaaacacactgatcagaagcatattcatatgataaagacaaatgagccaactttattaactcaaaaacaattctcatgtcaaccataatagaacttgaaaagtgcaaatgtaaattaagataataaattaagcaatatttaggagttagacaatttatgacaaagtcattatccatgtgcaaggtgacatcctaaggcagacagcagaccatagatgaaaagggcgcatagcaacaataacaacaaaaagccagcgaccatctcgctgccagaataaaggaaacaatcataggtttcagcagataaaacaatagatatgtgaatgggaattgcatagtgcataatacctcctggtccatcatcagttgagcttcctcaaccgtctcattaagatttatcagtttttttccctttgtcttttggtaaaaatcccagatgtcgatctgaagcattaaagtagatggagcaaagaatcatatacataaccataactgacactacagatagagatattagatgaataaatgatgatgcttgtaccttagactgttcgacggacaaaagtgagcaaaccaagctatagagctcactaactttggcctgaaagcaccaaatacaaacgtcaaaaaataagtcaagtcaattgcacaagaaactagagtatccaagaaagaagataatagaaagttaacaaatttactgttcaacaaaagagtatctaagaaagaagatagtagaaagttcatctttctacttttttagtaaaagtgctattagttcaagcagttagtaaaaccagcattcaaagtatttgccattgcgcatcaaatttgtaacatttttttccttctggtaatagtcaaccaaaaatatcagatcaaattctgaaattcaagggctcagcataccaaagtagaagatcgcaacaagcaggtgatgaacagatgcgatttctttgacacttcatcacaaagagggaatcctcattgctttatttcatataatgcaaatgtgtaagcactggtttttatttgacaaatgtgactctccaacaatgtgatcaaggtataaagaatgcctaaactgatcatctaacctatcaaatataagaaatgctccgatttgtcccacacaataagcacagatcaaggaggcatgatggctaagataagctaatgtgaaatacaaccaaatgttaaccacacaacctctttgaagcaataaattagggctggatagtggaatcatcattgtaataactacactattgatttcatcatcaatggataactatggagggactacatcccaaaagaaatgccaaacattatgaaaccagggaagtttcaaggagcatcagtcgcattattgacggttaattacatatgaagcacaatgtcacaatataaatcaaatataccatacctttctactaattctgataattctctccaagctgtctcttccatcaaataatttcagacggaggggatagacatccacaatgtaacttctggaagttggactactacaaattactcttcttgagagttctggtccacctttgtacctgaaaagtattcatgtgtccatgagttgatgatcccaattgaagaagaatgtattcaagtacattaggccatggacattagggataagttatggttacactagtattctggcataatccattgaagagcaacctgacctcatgagtgaaaacgcgtacagtatgcatttaccagttagcacatcattgttttaaacaaatatcaacaggaaacagaaaaattgaatagggcaacaactaattgccaacagactgagcaaacaggactacaaaccaggcttttttggtttgcacctaagtggagcacatgcaatctacaatgtggcatatcaaagccctggcagcccaagcttggccaaatgaacaagagcgcctaaagaaaataagaactaaaaaaatgtcgcaaaatggaactgtagttatatgatcaaattttaatcaggcaaccattttctctcatgacaaaaagtaaagagacaaacccgtggttttatgggtacaacaaactttctgacatgaaggcagttaaacagacatataacattgcataccattcatgtagcttcctccatacttcctggggcaccaaagcgtagtcatctccttccctcagggttctttgaagctctggctcatcaccaatactgctgctttcctctgaaactagctttgagttatctatctctcctggtctacttggagcttgaggaagcatgtcagcatcattctcatcaggtttgattaagcccacatagctttgccagttaagccaccagctgcaacatttgcaaagtccacacgatgtaatttatcagtcacaaaattcagataacatgtgcacagcaaccaattgaaatgaaatgcgaacggattaaacggatcaacatcaaacaggaaaccaagtcccacaagcaatgctggatgacatttacttgcagccaacgagaagatcctgcgcattgaactacttggacagctcagatatatatatatcatgccttactctataaactagtttgtaatatttaatacaggagtttgcaaaaaaaaacatttttattaaagatatactacaaaacaactcagcatggtgcctgacgattatatcattttactgtagcgccccaaccaacacatccccggagcacaacaagattggatcgcgactccgcatcacgcgccaaacggcacgcgtcggatccccagccccaattcgaacccctggattttcccgcagcatagataagatccccacggccgccacaccgcgggaagacgggtacctagatgctcgccggaaaaaaaaataaaacaaaatagaacgacactaaatcaggagaggccgcggcggcggaggcgacctgtgggagacgaggtagcggagatcgccgtccttgacattctcctcggcctccctggtgagcgcgacgacgaggtcccgctcctcctccgccgtgcacgggaggcagctcgcggcgtggaggaacccctcggcgctcggtatcgtcatcccctccccgccgccgccgccgcccgcgcgatcccgccgatccagccccctccccaccgccaccgaatcgagccctagggtttggtagctcgcgagacctcctcgcctttatttttattttctttttttctcgcgaaacaagaggaggaagacgatgaggcgaagagagagggaaggacagagaaaaagaagggaaaaaaaaaagaaacactctccaatttggaattacggcctgtctgtaataataataataataataagtaagcggacgaggcgggtcgtagaatcaccccacgtgaatgacaggtggggccggggaagggtgggcccacgtgtcggtgtcgttgggggcggtggtgtggcgggcgagtgttctggagaggaggcgtgcggcgatctggatccgtaccgtgaggggattccgcgttcttggtgtcgatgacaggtggggcccgctggaggtgggtttcggtttggcgtgtattggcggctacgaataccgcgtgttggagactgactgctacggtggtggtggtgggcccacgggtcagcgtgagtttgtgtttttgaggcccactgaaactgggccgaccatgggctggcccatcctgctccaacatcaagcattcaaaacccagcctttcttgcaggttgggccttcttgtcaggacttaaaagcattcatcaccttaggacatgttgaaagcatgttcacaggtggaatctggtagaggctttcagagactatcttacaacattcattcaagacgataaaagactaacaatcaatatactgaaatattttattattatttttccttccttttctccatcctcacgtagtaaagtttccttttataaacagacattatgggtcatgcatatctttatctattttatttgtgttagaaaacttatcttcttaacaactctaagagcccactattaattaccgttatacatgcccttagggcatgatcaatgatagagacgggtatggtctcttaaacaatacaagattatttagagaccatgtctttacgataattgagacgacaaaggctctaatcattaactcaaaaaatattccttttgttaatattcttttcatatttttatcctcatgcaaccatatttccatattatagtgactaagagtcgttgttaagccgttgtcatacataacaacgatgttttgtctctcctctttctctttcctccatgtcaacaagtatttctaattagcaatgctaagagaccactattgacaatcattgtacatgcccttaggccctacaagaatacttaccatatcgaaatttttgtttggttgtgataatttttgtttggttgtgatacacgtttaccgatctcacgatgacaattccctagcccactattacatatgtgtaatatttgtggacaacttggatagagttacacacccacaactccaccaccacactggtgctttcttgtacaatttgacatacaactaaacacataatatatatacagcatctaactacagtacatcttaagttgaaagataggtttagccctaattgtttgtaacactttggcaaaaaagtgactcagagtaaaatttgctctattaaaaataacccaaaaaaatccaatatgggaaaattggaaccataccattataattttgcaaaatttgagatatgccatcctgacccacatgtcattaactcatgtgggtcctacatgtcattgagatacatatggcatatctcaaactttgcaaaattataatggcatggttccaaattacccataaaaataatgcaatgttgtcttagaggaaatcattatacaaaaatgacaagaaaaatgttttatctgtaccagtaccactatgcattacttagaaaatggcagaccagatcagggttttgtcattatttttataaaggggcatttgcaaatttgccactggttttttcaatattgcaaggataccactcgaatgacagttctagtggcatttttataattttttagtggcagttttgcaataacgattcaaagtagtggtaaatttgcaattgccccttttatgaaaggtaatggaataacatcatctttttgcttcaaagaagctatagccacttattacatagtccgctcaacaaagagcaaataaaatttaggaattgaaagtgcaaagactaataactccaacacttgaggagacatacatttattcaattatatttgtaaatctccatccatagtatatctacatgaccgttgactccaagtttcaatatgtagtatgtattagttccttgttttcatcatacctttgtagttatgcccagaatcgaaaccaataccttgccaaggaaaatacttgcacataagattgatagagatttgtcaaaaaccataacattcctaataagccatagatcgcaacatatagcaaatgctcttactaaaataagttttttttttgtttttgagtcaatacccccttagccaattctcagatatatgtgagatactatttggaggtattaggccaaaagaaatatgaactgatatccagagaaatttagcaaaatggtgtaccatatatagtgtgacacgctcagttcaatttcacaactgaccatggtactcgtcctagctagctagctagcctcctgggttggatgctcttcaagatgcccaatgtataaaacccacttatcttatactttctccgtttctaaatatttgatgccgttgattttttttaaatatgttcgaccgttcgtcttattaaaaaaatttaagtaattattaattcttttcctattatttgattcattattaaatatacttatatgtatacatgtagttttacatattccacaaaagtttctgaataagacaaacggttaaatatgtgctaaaaagttaacggtgtcaaatatttagaaacggagggagcagcaacaaggtaaaaagctcaacaatgtatgaaacccaccgttggactcgatggacctacttacattaaatagcaaatctgagatgacaagctgcaattcacatactgtgtatgacgagtgggtttaagatattctctctcctttaaaactcgttactatgcctgatgccgactccttccagcaaaaatcttacatgtatgggaccggttttattgtcttttcactcctctttacaccttctaaaatcatacattgcacatgctcttaatgttcttgcaattgcaaatataacatgggacatacggcagactcatatatatcctaccttcggtttttaatataggaaaaagtacgaattacccccccgaacaatcgccgtcgtccgaattatccccctgaaccataaaaccggacattcttcacccccaactatgcaaaccggataaattacccccctggacccaatccgcagtggttttggtctacgtggcgtacacgtggcaatccagtcagcactctagtcattaaaaaaatgtgggacccacctatcatactcctcatcctctcatcccctctcttttctctctcactctacccctctctctctctcaaacgggtcaacagcggcggcaggggaggacgcggcggcggcgtgcgggttgtggcggagcgcggggaggacgcggcggtggcggg

SEQ ID NO: 30861 - DNA, 15955 bp, Oryza sativa
cattttttaataactagaatgctaactggattgccacgtgtacgccacgtagaccaaaaccactgcggattgggtcgagggggataatttgtccggtttatatagttggaggtgaagaatgcctggttttgtggttcagggaggtaattcagacgaccgcgatagttcaggggtaattcgtactttttcctttaatatataacaccgttaactttttttatatgtttatcattcgttttattaaaaaatttggtgtaaacgtataaaaatataaggaaatatttagtgacaaattaagtcataaaaataaaatgataattacatatttgttttgaaaaagagtaaattgcattactggtaaataaccttgtcaggtgcgtgcaatttagtgtatgaacttataaaatgcttattttggtgtatgaacttgtctattacgtgcaaactaaggctaaaatggctcgataaagaccaatttttctacgttgaacattataaattacaaattagtagatgacttgcatgtacatagtagaaatgttatatttgtaaacttagattccactttatctttctttgtttctgtcccttgcatcagtactcatatttttattttttttatgcaattattatgccttattatatgtttatccttcttatactaatgtttacatagagtttaaatcaacaacagaatcagcaagattaaccttgcagtgcgattttaaccttgttcgcacgcacctaacaagttcgtgcaccaaaacgagcgctttacaagttcatgtactagattgcacccacttgacaaatttgtgtaccgccgatgcaatttactctttaaaaaatggagagagtatgaagctcgtgtgagcaccttttgcaaagctgacctgcacattcggcaaaaggtcacagattgttttgtgtatttttttttacagaaaatctcattttgaagttcttataaaaatcacggtcttccccaatatccgaccttcgctcgtcgttaggatagagatcatgatggctcgatgcctatggtttgatccatataggtctagtgttcaccgattggatctatcgatctggtcttagttgattctattcaacaattaggtttgtgttcgtcgagggatgaaaccttacttgaatgtgttaccatgatgaatggaacttgagatttatggaagaaatctgttaatctaatcttccttgatccaatctggcatcgacgatgaagcgtacccttgttggggccatcttttagatactaatagataaactagcagttgcatctaagctgcacaaagccatgacactcttggtggatgcattggcatgaagacgtactaaaacttcacaccttctttctgtatattatagtcgagttcatatgtgtcctcgtagtagttccagttgcgagttttatgcttttatcattagcccagcattgatctgtttgttcatctttgtttggatttttatcattagtgatgttgtcaataccttctcttttttaaaatatgtagcttaagttcatgtcggcataatttacttactttttttaacaagtaaaacatccctaccattcatcaatctatccaaacaaatcaaccccctgcgctgcttctgtcttctgatccgatgctgtctgtccacgaccagatcaactcttttttttaccggtttccatcagagaactgtacttaaatactccagcacgagacctattactgccaaaatgtaacctatcacttggatccaaccaattttttttcttcagcttcccaaactttgcagttctgcagttgcagttccggattcagagaaagacaataaatagtactctctccattctaaaatactactataagagaaagacaataaatagtttacgccaaaattggaagcatgattgaaattggaacgatgtgacgtgaaagttaaaagtttatttacgtagaaaagttttgatgtgatggaaaagttgaagtttgaagaaaaagttggaaactaaaccaggcctatttaggttgtgttcgggaggaggggcacgcaaaacgatgttcgcattaacgcgtgattaattaagtatattaatattttttaaaaaaatagatcaatatgattttttaagcaacttttgtatagaaactttttgaaaaaaaaaacgcagcgtttagtagtttgaaaaacgtgcacagggaaaacgagggtggggagctaggaactccaaacaaagaacgcagccttatagaggtttttataggaattatttaacattcgagattaaatagcagaatattataattgattaagaatataaagtaattaaaatataaatggagatgtctatgattgatgggatgaagagataggtgaaaaaatagttatattttaaaataaacttaaactttaaaaataactacttcctacaatgtaactcattttattattttccacatttatattaatattaatgaatctagatatctatatatatatatatagatagatgtatatgagaaatgttagaatgaaacggagggagtacattataagatgatgtaagtgcacatgtactcctataataaaaaataactcaacctaaaagaagatgtgacatcttctagtgtaaagaatctgaacgaatagttgtccagattcatcatcctagaagtctgaggttttttttcttctgatggaaggagtagatttgtgccagtgtaggtgcaggtagtacagttctacatgtacacccattctgccactcagtcccacaaggagttaaaaaaggtgtccaacagacagcacacgtgagaggacatctcatcccaaaaagaaaagattcattcattcagtagtactactgcctttgcaaaacaggtgctcttttgtcagtaatttacacatgattaaattaggctatgatgcaccaagatgaccgtttgtttggacctaaacaagagggtttcccagttattataatcaacacagccattgcatgactgcatctgcaaagctaaaagctagtggtacaaagtgaagctcactagctagctcacaagtcagagaaatgtgttacttttggttgtagtaactgataagatgaaaagcaacagtatctgatcctccagttcagtgcaggtgcagcctacttctaaggccccgtttagttcacaaaataaaaatttttgggtgtcacatcggacgtttgaccggatgtcggaagggattttcggacacgaatgaaaaaactaatttcataactcgcatggaaaccgcgagacaaatcttttgagcctaattattccatcattagcatatgtgggttactgtagcacttatggctaatcatggactaattaggctcaaaagattcgtcacgcaatttccctcctaattgtgcaattagtttttgtttttatctatatttaatgctccatgcatgtgttcaaagattcgatgtgatgtttttggaaaaactttctggaaactaaatagggcctaagctttgcagggagttgcccaaacttcaatcaaaaggtcatgtcttgttcagattcatagtattaggttatgtcaaatttggtaatatgttgtaatattttggaaaatatagagtagtgactttgtatcgtatctaagccattatctgttaatcactagtgttatctccccaaaatgaacaatttaatatcaaaattcaagagaggaagagcttcaaaacagagaaaaaaaagtctagtttaatgacactgaccaacccattagattaccccctcaattacaaggccatatcaattacaacaacatggcaaggacagagattaaattaagggacattcaccaccatcaatgcctttgtccactgcagcaccagcaagaagcaatgcatcccaatgtgcgcctcctctgactccattagaaaccagaggcttccttcctactaccatcacttgatctgctcacaatcacaatgccatcatcctcatcaggacagccacacatgctgctacagctgcttgtgtccaccatgtccaccaaccctagcaagcacaagcacaagcaaaacaaaagggaacacctcagcaagtgaccaaaagggagcaaagctccagtgaggaaacaacaacagacagatcatatgccactgaaaattcttcttcccttgcatgattgcaggttatgcatagatagatcgtaataggggacgacaatcgtgcccgattgcccgtttaccgcctagtaacaatcttattactctattagggtcgggcatgttcctattcttttttataattgctacttcattgcctgattggtttatgcttatgctagcaagaatagggagaatcatgttgatggtgatgcaacatgtcacatctaatctatttcagcttgagcccaaactttatacattgatcattgtgtatgtactaatgttgattagccattcttgctttgaatgctttaattgcataaaaatttgtgattgtgacatcaagttgttgttggatcagacagtagtcttaacctgcatcatgctcctttatgccttgacattccttgtgtttgcaaaagcaccaagcatgataaatacaacacttttcagattatcctaaacatttttttcagcatttgattacactgaacaagctagtcgttatcatctaatccaagaattaactttgctaattaatctacttctaatgaaaagaagaatcaaagcacataaaaattatgcagcataattaacaggagagcaggggagagcttactgccggctttgctgaggccgagatgctgtagtagccgccatcctcgccatggccattgtactcgccgccgccgccaatggtgccgctgccgccgccgatgccgccgccgccgccgccggagttggtgttgtccttgggcaggcggtaggagagctcgtagaccggcgtgccgtcgggcttgaagaggccgtagtttcgctccgacgtcgggccgggtttcatgttctcgttgaagagcgcgaacatgtaggcgcgcagcgccaccgacggccggagcggcgtgcccttcccgtcggcgacgaggcgcatcacgttgccgttgtacctcgcggcgttctgcggcgtcgcgccggtctcgttggcgtcgccggcggacggccacccggtctccgacacccgcacctccaccgcccgcgccgccgcggtgttggccgccgcgatggcgtggtacacggcgtccacctgcgccacgagcaggttggggtagtgcaggccggaggaggggtcggcgacgccggcgtaggtcggctcgagcagcgcgtactcgagctcgacgccggtggggtcctcggcgtaggcgaagtaggggtaggcgttgacgaggaacggcgagccggtgcgggcgtggaagtcgaggatggggcagagcagcgggaggaggtccttgcggaagtacgccgacgacggcgggtacgacgtggcgagcacgccgaggttgtgcgccgtggtgacggccacctgcttgtcgagtccgagctgcgcgagcgcgtcgtggaggcactgcatcgccgggagcagcgaccgcgacagcgacgagctgttggcgccggtgagcacctcgttgccgacggtgagcaccgcgatcttggtcgccgggagcgccggctggacgacggagcggacccacgacgcggcgccggagggggttgacacggcagccaggcactcgtccgggacgccgacgacgagctccaccccggtgttggcgaacgcgcggagggtggccgggtcggcgtcgtagagccggactcggccgaccccgagcgacgacagcatcggcggcacggcgttcgccgggggcaggttgttgccgacgcggccgtagttgatgcccagcagcaccgacgacgtcgcgtcggccgccgccgggagcagcagcgccgccattaccaggatgaggggcggcattgcggcggcggcgagacggcgacgaggagctgagtagctggagctcgggtgagcttggagtggacagtggagtgtgggagtgaggggaatttgggctggagcgttgtgggggcgtggggggtggggggttggtggtggtggatgctgcacttcaccagttttcacagttgcaagttgcaaaccgtaccgttagtggagtgtgagtggccgtcggatatactccttccgtcaaaaaaaaaaaacctggaaaaaattaaaaaagacaaatcacgcataaagtattaataatgttttatcatctaacaataataaaaatactaattataacaaaatttcatataagacggaccgtcagacattgaacacggaaacccagggttcgtcttttttttggacggagcaggaaagttgagaaaaaaatgaggatgttgagggaatcaatcaatctattgataaaaaatgggtaaaatataccccctccatctatttttataatcatattttatcttggcacacagattctacttatcatccaattaaacatgctactagtcattcctcgtaaacaagcaattcattaatatttacatttctcgatacctatgtagccaatcttgtgtggaagaatggagagtcacgcattaaatccaagaaagtcattaagaggatatgttgttggattgaaatatgcctatcaaaaataaatttttcaaatttggaaatatgactatcaaaaatagatggaggaagtatttggttgggtctgattagtgtatatattactctctccattccaaattgatctacaaatttcataggcacaccaataccaagaaaagctaatactataactctctaatactatatttactctagcaacaaactcgatacatgcaccatccccactatttcctagccaatagcaaatcaagatattgcacgttggttataaatacttgtgtgcatggatgcatgcatcaatgtccatttactccaatgcacaaataacgaatagacttaatgaatgaacacaaatatgatgatcatttataaataacctaaaaaaaactatatgtagatcaatttggaatggagggagtagtaagcactatattttttttatttttaattactatatgcaggtttatgtgtcgtagtgtttctttgagatggactcaagaatagggtctgtcacgaccgaaaataacccaacaggttttccattcgtgcatgtattattcctcttctcacgaggcgaggtacacaacagttgatacaatatcagagtttaacaagcggaagcgtaaataatacttttattacatgggcgaccaaaggccaaacacacatagataaacgaaaaagcacaaatgactaggacaaagaccatagacacttgacggcaggcacgagctagacactgaagccatcctcttccaagaactccttttctaggttgggggaaaaattgagcaagattgagtataatcaccgtgctcaacaagtcacaccgataaatgcacaataaatgcaagggatacaaagctataataataaagggttagattttgcagtaaaacaacattttaaaccacttagttgctcaaagccatttggtaaattcgaacacaggtctacaaagtattataattattcacggtcgtgaacccacacgaacctgccttaacccaaggcctacgaagagtcggaccaaactggtagccttaaagccgagctccagctcataccaagccaacccaggccaaccattccaggttttagttgattaatatgttttaagagtgaaatcactaacttgggtatattactaggcttgctcataatcgagggcacggctacgtactcgaataggttatactcttatcagaggtgtacatatttacccacaagacacagcttcctcacgagtcatcacgcgccacataccaccacaatatatggatggagggcgtgacatagttcttcactcaccctagccctgaacaaaagtaccgactcaacgcccacctacggccggggttcccgggacaggtaggttatggtcgagccctacggcatcaggatacccttggggagtggccacccggatgcccgtcctgtgccacaacatctcgactaccgaacactcgcccatgtagccttcatttgcctcagagatatccatcacccgacttcatccatctttatcagtgtccttttgttcacgaccagactaggctacaaactaagccttacccattagacatgtggacttatgatagtgctttgtaacagaggtccgaagactggtccttatagtggccgaggtgctactgtcaaaaccatgcactccgagcccagcctaaaaccattttgggggttttgaatagagagaaaggtgtatgtccaattccagcatatgccaaccaatcacgaacataaatatttttttcatcatatcataatcatgtaagatcttgttgtacagttttaattgcaatgaacacaacagtgtaatcggatcgtagatcagataagtaatttaagagaaaattttatttgaaatttagatgggtaatgaggatgcaagtggcaggtgctactactttcagtaagaagggtaatgagttgatacaaactgtgactatttttggtaaaaaggatggtcgctggttagcactaatgagtgcatgcgctccctgtagtcgcgtcctaatatttagaggccaaaaatctagattttacccaaaagttgtgatgggcaaatatatttttattgcattatttaaatgaggtttaatccttagcctagataatttggaggcgttgatatatcttaaaagttttttttaaaaaaatattctaagtagacataatgatactttgttgctccatttctttacatgaccatttattttacatgagtggattttatgccatgaaatgcttgatgaaatgttctaaatattagtttgaatattccaatgaaacactcttttggtcattgtagtggtgaccattatttcatgacactcatcaacatggttaaagcatttaatatttgatttgtaatttgtattaaagaattaataataagtaaatttcacttcgggccaccttttgttacctatgtttcattttggaccaccctttaagcaatattttcactttggactgggtaaacttacctttgtttcactttggaccatccaactctcttctcaagcatatgaacgatcttgattacgccgtctcctactcgtcgatgaactgccacagttatatgtaagactatttcttcgacatattacaagtttgatgtagatggataaaagagtaagggtggtccaatgtgaaacaaaggtaaaaatacccggtccaaagtgaaaacattggtcctaaggtggtccaaagcgaaacatcggtaataaaaggtggcccaaagtaaaattaactaatataataattaacttgtactttatttggctttgctttttgtgcataaatatttacagggttaataataaataatgtattctcgtatattatatttattactcaagcgtaggtctctactttactttgtgatcatttatggtttggcaagcaatagcaatcataacaactagcatgatgcaaaagttttaaaatgttcgaaattttagtgatttttattattaggaattttcaggatgttacgcattcttttagaggtgaatctcctatgtgtccactacctcatcaattattatcctaacatctgtctgggctatggtgaattaattttaattgattaaagagatataagcatgtcatcataccaccgcattccttgtgaaaatataaatacgatacccttgggaatactcatgggtgaaatgctacagcggtatccgtgcgcttgcggatttatatgtgatagtaagaaataccaatagcagcattgttggaggcagggaagtgtagctggaggacagggaagtgtagctagaggacgtaacatagcttttctcccttgggagagattaggaggcctgctggtgtacccggttgttgttcttccgtccattcagtgatgaagtcagagagcacttgagacttgatggctacccgaagttggaaggagatgtcaaacgccatcagctgtgcccacttggcgatgcgtccggtggcctctttgttaaacatgacatagcggagggggtgagaggtgacgactgacaccggatgagcttgaaaacagtggctgagtttgcggaccgtgatgaatattgcgtggcgtagtttctgaatctgcgtgtatcgcgtcttcgactcactaaggacttcactaatgaagtagactgatcgttgtatcttcttgatcgatccatcttcttctcttcgacacctaggactgtgctgacaacgcttgaggtggcggtaatctataacagaatcggctcttttgggagtgttgtgaggatgggtggacttgttaggtaccgcttaaagtcgttgaaggctgcttgggcttctggagtccaggtgaagtcatcagactttttgaggagcatgaagaatggcatgccacgttcgcctagttgggacgtgaagcggttaagtgacaccatgcacccagtcagcttgtgcagcttcttcaagtcggcaagcggctccattgagtggatgacggctattttgccaggatttgcctcaaagccgtggttggacaccatgaagccaatgttggaattttctacgcacatagataaatccgcaagcgcacggataccgttatagcacttccccttagagtgacccaagggtatcgaacataaggacatgtgtgtactatatacgaacgggattctatccaagggcaacaataaatgctaggcttaagctagagaggattcctatggacttaattaactaacttaagttaaaggtaaaactctatcgaatgcttcgggcaccgggcctcccctggtctgccaagctgagtccgaccttgagctctatgatgtacccgaacatggaggaatacaagggacggacaagctatcaccacttgccgtctacctcactttccctggagcacacaacaaacgaagctaatgttgatgtgaaaacacggtggcctgggagatctgcttaactccagtgcaggtccaatgctagcctcgagtgtgtcaagcgcgtgccaactgatttgatactgcaatcatcaagtgttggcggctgttaaatgccaattctatgctgccaatgcctgcataaaacatcatgaataacacattcaacatagtggtagggtttaattctaacatattccatgagtgttggtgtatatttggatgcaggtaataaaccgtcaaagttgggatgaaaaccagacttcaatgaaggatttcttttatccatctaagagtgggccttaaactttgtagaattattagaaaataggcccatcgctcctcgaattggataagacagagcaaggggaaggcccaggctgaggcaacaggccatctagcccagcctaggtggtgacaaccgtttgattcatgttttggtatgtacgttcctgatttgctcctgatggcggttggagggcagattagacatttcgcatcatcatacctaccctataaatagaattcacttcactcatttcaacacgcacttggaagcttgagctgaattataagaggctctattgtactatattgtatactaaaatgaaggagagagtagagtacaggaagtcggaggaattccggagttatcggtaatcctcttcttgtttcttttactctgataagtattctgctttaattaaatatcattacgagtatttaaaatttattctatgagagttacctcttagttagttcctaatgaacgtacgggatcactgatcactataatccagtaatttatagtggttgctttagtgtttagctaacattaaagtagttattaaactgcgtagacgtagtgtctgggtagttaatttccggtgtttgctttgtatctcacagtaggtttgagggggtgtagaggtggtgacagccctcgaaacactaaagtcatccctgtccggtacgttgtagagtcatatctgggagccagactttacaggcaacggttcgatgtcggggccaatagaccacgagcatccccatggaaggcgtaaagttccaactggcggctttttagtggcaaagggtattttggagtaaaaggagatatttgaaaagcaaataacatttaaataaattaagaaaattcaaataaaatagcaaattgggtatcaaaatgtagattttgaatttatatgaatttaggtccaagtttcactagaatcggatctacggtttaggagatatgtgcttctaaagaattggatttgaattaaatagggaaaataggaagagttactgtgctggggtccacctgtcagggaatattcttaatttcttctccttcccgtctccgtcttttttttctcctccttccagccgggtaacagaggagagagagggagtagggcgtcggtgctccggtgagtgaacggcctcgacggcggcggccaagcgtgttcctgcttgctgcgtatccggggaggtcggtggaaggaagagggagagaggaggatggctggaacggcagtggcaagagtttggttgcggttaccacaaggaggggcgatggtggccaagctaggggtggagggagaggggaaggtgggaaaatggactctcctcagtgaggcaaggtcggtggtgaaaggtagtaggaaggggatcaatggaggaggagatcgtccagtggtgggtggcggccgaacatggcaggagagagaaaggaagagctcgaggctctgttgatgtgtggagaaaaggggagggctcgccttctatttataggcggcgagaggcggtggctaatggcggttcggaggagaaggacgacgaggatacggctgcagcgacgtggagaaaagaacggcggcgccggctctgtcctctgattggctgacgatggcggttcgtccctgctgctgacgtcggcgtgatgaagtgtagctgacgtcgggcggcgattccttcgcgtcgacggcaagatagcagcggcggcgggaaagccgcgggcgacggcgcaagactacaaagcggcggcgccatggctgtgggcggcggcagcggcggcgtgcgcgcccacagagagaggaagagcggctcagctgggttgggccggcttgggctgaagaggaagatgagccgaaaaggagggagaaaggaatttcggcccaaaatatatttcgtggattctagagaattacttgtggctaaaagaaaattaatttggaagaggaggattaaataaaaatatcattctaatatttataatattgctattcttgtgccgagaagacttagttgaggaaattggaatgggaggctagatcaaaataggagcatgaccaaagagttaatgataccccaactaaaagaacaattgagagaaatggtggaacttttgtatgaaggtaaactggacatgaggagattaaactatggagtcataactttgatccccaaggttaaagatgctaatactatcaaatcgtttagaccaatatgcctcctcaatgtgtgtttcaaatttctcaccaagatcctaacaaggaggttgtctgaaattgctcagaaggtaataggggagagtcaaactgcctttattccaggaaggcagaatctggatggggtggttatcctacatgaagttttacatgaactaaaaaaagagaagaaatcaggtatcatcttcaagctcgattttgaaaaggcatacgacaaggtgcaatggagttttttgtttgatgttctgcataagaaaggtttcagtgatagatggattcagtgggttaaaatggcaaccataggagggaagatggcagtcaatattaatggggaggtgaaagacttctttaagacttataggggagtaagacagggggatccactttcccctcttttattcaacttggttgctgatgctttatccgaaatgttgaataatgctaaacaagcagtaccacatttagttcctggtggcttgacacacttacaatatgctgatgataccatacttttcatgaccaacacagaggagaacattgttactgtgaaatttctgctatactgctatgaggctatgtctggtcttaagattaactaccaaaagagtgagatcatggtcataggtggagatgagatggaaactcaaagagtggctgatctgtttaactgtcaagctggaaagatgccttttacttacctagggatcccaatcagtatgaataaactgaccaacgctgatttagatattcctcccaacaagattgagaaaaggcttgctacttggaaatgtggttacttatcttatgggggaaaagcaatcttaataaactcatgtcttagcagcattcctttatatatgatgggagtttacctattacctgagggagtgcacaataagatggattctattagagcgagatttttttgggagggattggaaaagaagagaaagtaccatatgattaaatgggaggccttatgcagacctaaagagtttggaggacttggcttcattgacacaaggaaaatgaacattgctttgttatgtaaatggatctatagacttgaatctgggaaagaagatccctgttgtgtgttgttgaggaataaatacatgaaggatgggggaggttttttccagtctaaagctgaggagagctcacagttttggaaaggcttacatgaggtgaagaaatggatggatttggggagttcttacaaagtgggaaatggtaaagcaaccaacttttggagtgatgtttggattggggagactcctttaaaaactcagtatcccaacatttacagaatgtgtgcggataaagagaagactgtctctcaaatgtgtttagagggggactggtacatagaactgagaagatctctgggggagagggatttgaatgagtggaatgaccttcataacacaccaagggagatccatttaaaggaggaaagagactgtataatctggaaactaaccaaaaatggcttttacaaagcgaaaaccttgtatcaagctctaagttttggaggagtcaaggacaaagtgatgcaggacctgtggaggtcctccatccccttgaaagtcaaaattttattctggttaatgttaaaggggagaatacaagctgctgggcagctgaagaaaatgaaatggtctggaagtccaaattgtaaactgtgtgggcagactgaagatgtagatcatttgatgtttagatgccatatctctcaatttatgtggtgctgctatagagacgcctttggttgggataatattcctagttctagggaagatcttttagagaagttaaacattcaaaaagatggacaaaaatctgttttgcttgcatgcttagctgcaggcacatgggcgatttggctgatgcgaaacgattgggttttcaatggaaaactaacctctgatccctctcatttgcctccaaagctgtttcttttcttctacagtggagacaactggcgccgcagatccagcggagcgatttggacgcctcaagggccttactgcttgccagtactcgaagggcaacaggctcaaacccctgatgaagacctgaatgattttcagcttatactccagggatgtctttttggttgttcactctgagtagttatttctggcttgtcttttgggctgtgccagcagccattgcgctctatcacttactgggtagtctccagccccttttatcttcatgtcttgttttactttctgtatgaaccttgttggctttttaatgaaagctgggcaatgccttttctccaaaaagagttaatgatactgtagaagattttggatggagaagaactaaggaattttagaggcaa

SEQ ID NO: 30862 - DNA, 6142 bp, Oryza sativa
aagggtcttgtcacactcgcatggtgacgtgtcaggtatagcacggtgaaaaatggtggattgtgtcttgtctcttatgggtacagttgtgcacctttggtaagagtaaaactattcgaatagtcatgctcgcgattataggcgatcgactagatgcaccgtgattagtttcacaccattaattaatttgacttaatgaactagtgtagttcatgtggtatggttagatctgttcaacatggtgtagcgttgttcagtggaggtttaatcttgccttaattaatcaacaattttattgttttcaactataaatgtttacacccgcctttatgcaaatagccacaaacttcacttgtttccccttgcacgattgtgtcattggtgtggcttgcgtcatacggtggttatacttagccttgctataattaccatttttcagaagtgtagtgctactgagttgaaaacgaagttaaagtaccaaggcttatactccagttgtgtttactaggatcacctcttttccgttgctgccttcttttggtgtgatgactaaatgcctattctgtaagtatttacactttatttacatttggatctatatattaatttgttattttgtgtaccctagcttgattcttggacaaggatttatacacagaatagtttgaaaatttggctaaatttctggtcgtgacagcagagttcttcacaaatgcactataggtagagatccaaaaaccgcgcactatacacattttgtgaaccttaagccttactcgttctcttggttgtggactctatgccagcgatttaggaaaatggcggcatggctaggatgtgccgatgatgccgtcgaaccagctcgacgagacaatgagggggtgggggtggggggggagaggggtggaggaaggaaagtcggaaggagggagagggagagggagaggaaaaggacgaggagcaagtggaagtcggaccctcccctcctccccacaattatcaagggggtccatctcgatcacagtataagagggctcagttcagggatcggaagaataccctggaccatcctagtgctcctatgggtaggaagaggtaagttagttggcatatctatgttcgaacttgtgcgaacctttattttggcttcttgtatgctgtaaagggtatggatggatgtggcaagggatgtggatgtagtgctgtgtatggattttggatggatggatgtgaattgatttcggatggatggatgtgtgctaagggtgtatttgcaggtggtgatgactggatatagagctggttgttagttcctgcttggggccatacttcatagctaatgaagatggcgctgaaatgtccaaacttagctccatatagcttatcgctaaggtatggcctctaagcagccaactgcaagcctagctcagagcaggtgcatcggcactgagcttgaaaaccttggcgccacgtgcattggcgctgagtttgaacacctcagcgctctacaggctcgcatgactatgttccaaaccgcaaaggtagatggtgctgaggccttttagtccgacgccgaggttggcggcttagcgcctcatggctgcacaacacaggagctgtgttggacgagatgacctcgcgcggcaatgtcccgaaggaggtctttccttctggccccatctacattggtgcttaagtctttcctttcagcggcaatatggttggtgaagagcccctgccatgtaagtgaggtgattggctcgggttccatgtgaacacgggagtcagcgccaacggacccggtgttgacgcgtacaacctccacaacaaggtggtggggctgaggtcgtggatcatttttggttgatttttttttgcatggtgtaatttcaaaataagtttttagaaaggatcaatttgtcaaaaaaaagatatattcattctccgattttgctaaacatcacacgggtgatttttcgttgatatttgacagatttttgcccctacaattatgcgccgagatcagtacacgattctgcgtcaatgttgtcgtgaggtggagaggagacctcgtgggtcccacgtttgccgctgatcacgattcacaagaaatttacatcctagctacgtgtaaatatcctatataactaaaataaaatataaaattacagtcctatttaactaaaattacatatgtaaattcagttgatattaattataatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgatgacatgtaagtgcactgtaattttgatgaaaatattgtgtaagtaaatttgcattagttattttatttcaaatataaaattacagtcctatataactaaaattacattgtaaatttagttgatatgacatgtaagtgcactgtaattttgataaaaatgttgtgtaagtaaatttgtattagttattttattttgtagtccgttggatgcaaatccaagggaggaaaaaatctgggtgattaatcacccgagtgatgcataagctgtcccttcattctctcaatccaaatttcatcggagttatagttgataatagctcgctgcggttaacggctttgggtggggaacaggggaaggcaaaacctctgcttgcaaactccaaaaccttctggaacgtttcgtcgttcgaatcgcccgcaccaaaatcccacccctcctcttcctccttcctctgcaagcaaagcaacccggtggaacaccacgcgccgcacccctcctccacctcgctcctccgctcccgctccccgccgccggccatggtgctcgagctccaggtccaccccaccccctcctctcccccatttcctccctcctctcgcttcccccattcggcgctcgctccgcggctacccgcgagttcgctacggtgattaatttctgaaggtttttattgttggctggaacccaatgcattcgcagaggagcatgcaggcaactatgatatgcgtcgacgactcggtgtggatgctgaaggaggactacccgccgacgcggctccaggcgcaggccgacgccgccaacctcgtgttcgccacgaaaatggcggttcgactgcaacctcgtgttcacacaatttttggggtttttttttttgactccgggagtttttgggggcgtcgtgttcgttgcagtcgaatcaggcgaacacggccgggtgccggccatggctggggacagagtgcgcgtgctcctcgcgctcaccagcgaccccgtcaagttcctcgcctgcatgcgcggtgcgtgactggcccccaatctccatatagggtgtgtttggttcccggtcaaggttggatgggatatggcggtccatattttcctggatatggcgatccagttttttgtttggtggagtgaatatggtgatccagttttttgtttggttgtagggatgaaagtggatatggtgatccatttttttgtttggttggaggagtgggatggatgagtgggtacaatcactcttccattagaagtggtgagtttacccctatttcaacctactaaaaaaataaatagaaataaaaaacagaacgaaataaaaggggaaggagaaaaaaagaaaaaagaaaaaaaaatcttcctctctcgaaatcgccggccgcccctcgcctcctctctcgtcctcgtcggccgcccttcgctcatctctcgccctcgccggccgccgccgcgcctcctccggccgccgccgctccagatccggccgcgtcagcgcctcctctctcaccggccaccgctgcgcctcctctctcaccggccaccgctgcgcctcttctctcacccaccgccaccccgtctcctctctccccgaccgccgccgtgcgtcctctctcgccggcgcggcacgccgcccccagatccagttgccgtcggcgcatcctcttcccgtctcctctctcaccggccgccgagctcgcgtcccactgccgccgcgctcgtcgcccacgccggccgccgagctcgctgcccaccgtcgtcgcctcctctctcgtcgcctggcctggctgccgccgagctcacgtcgtcactcaccctagccgccgccaagctcgcactgtggtgagaggggtgacgcgacccactatcgctcgcccccgctcgcccgggcgctcgggcggctgcatccggccgaatcggccggatccccccatccagcatctggggggaatattcccctccgggccgccctatcccacctccgaccaggaaccaaacacccacaaaaaatgggccgccatgtcctatccacccatatccctccatccaaacacatccataattgtgtgatttcgcctgttcctcccactattccagaatgtgggatagttccttgatcaatccatgatcactttggtttggtttggtaactttgataaatgatggttggttggttagcgtgcagtcgtgcatatggtttattgatcaatccatgatgttgtttgcaaaaaaatgtagtgttaaatgaacgctaagttgccaaggaaccatcaactttgcttatcctcctggaattcaattctgaatatatggttctgtcttgtccaggattatcagttcagttagaaatgatgttagttactgcacaatagtagttcactgatcaatccatcacgttatttgccaaatggtgacaagcacactgatctctttattttgtagggtagtgctaagcgcaaggaaccattaaattagcttatactactggaatgcaattctaaacatatatgggtctgatcacttagtcaaatatgatcaaggattaagtaggaagatttgtggtttctgtgttgcttatggaatatgtaaccacattctgttgttgtacgacttagcaaaatccatacgaagaaatgatgctgatatatgtctcccatgtatggttcacttgtttttaaaggcagtgtggtagtaattgtacattcgtactgtcataaactcgtcatctatatttgctttcattttttttgtaccattctaaaatattactacctccgtttcaggttataagactttctaggcacacatatatgtatagactcattaacatatatatataaatatgggcaataataaaaagtcttataatatgaaacggaggaaatatctatattacaaggaagagaggatatgtatggaatgagaaccgcaaaatgttaagtcttcttgtgatcgatcagatacttgatagttgataatactgctgctttaaagaaatcatgtgccacatatattcctataactgaaatacttatctttgcagggctgaaagttagtggtgaagcaaatttgactgctgctttagaggttgccgaactggcactgagaaatcatgccgacaaaacactgagccagaggatagttgtttttgttggcaggtatctatctatctatctatctattatctatcttctattatatactgtccataagacttcctacaaacgctctcaagccgccaagtggcgctctaataaaatagagaaaatcctagaaattctaagaaaaaagcaaaaaatctaccccttgattttcacttaaattggtggatccaatattatacaccattagataaaattgatcttaaaacaaactaaatactatgggtcccacctatcctcctcctgcgcgttggcaggtggcaggttcgtacgtacatgtacgtatgcttccttcctttcttttccttttttttcttttttccatatatatatatatatatatatatatatatatatatatatatatatatatatacacacatactatactaaacccagggtgcgtaataactaaaatgctcctcctcacatcctacccc

SEQ ID NO: 30863 - DNA, 3628 bp, Oryza sativa
tcctcacatcctaccccccaccccacgcacccccccccctcccgccggtgcaccccagctctcccctcccatatttacggagtaaattgtttactatcaaatctatctgctgcctatattactcactccctgtcttgtagtagaaaccgtccacccactttctcctttctctccactttttacggatctggtgctcctcccctgccccaccgccgcctacggccaaggagtggcggtgtgcaggcgacgggcggccgacctaatcaccgcccactcccaccgggggtcgtcgtcgggtcgtggccgtatcggcgtgcggctccggcagcggcagttcagggatgaggaggagcggcggcgaggcgcatccagccacggctcggagacgaggaggttcgggcggtgaatccggtgatggcgaggcgtgtgggcggcgtgcggctattggctcgggcttcctccggtagccagcgatggcgacgctttgcggaagcggcgggcgcggccggcgacgacgacggcctgcgacggcgacggcttgcggcagcggcaggcgaccgtcctccacccggatccggcggtggcggcccggtggcggcgggaggagagcccagcggcgtagtcggcaatggcgtggccggcgacggcgacggcttgcgacggtggaggatgggggaggcgagggggaagaggcttcgtgctcctccaatcgggcgcattcgccgccattccgcccgcgctcgccgaggccatcggcgccgctgggtagggcgcgagcgtcttggaggtgatgggcggggcgcgcagactgctcgtgccggacccgaccgggacctgctcccaactcccgtggcatgcgagttgagtggtgccagatccgttggctacgactgggcaacggctgatccggggtaggcttcgtgctcactggtgctgccttctcccatgactccgacctccctctctagccgtcgccggcgtcccctgctggatgcagtcaatgtaggctcgggactcgcctgatctggggtggatcgacgaccattgggctgtcgaagcatagcagagacccaggcagagatgtactccctccgtaccaaaaaaagacaaaccctggtttccgtgcccaatgttttaccgtccgtcttatttgaaaaaattatgaaaaaaattaaaaagacaagtcacgcacaaagtattaatcatgttttatcatctaacaacaataaaaatacgaattataaaaaaattttatataagacggacagtcaaagttggatacgcaaacccaggatttgcctttttttgggacggagggagtaggttgctgcttgcaggtccgccactgcccgtggacagacagtgctcgtcgatcgcatttgctgtaggcgccagcgactagtcctgccaggcctgactggagaacggtgggatttggtgctgctgcaccctcagcggcgctggttagttcctttttttttttattggatcgatggaagttctgagctgagcttgttactattgtgcttttggctttttgtggtctcgatctagttgaacagagctgttctaagagcatcttaatattattcccttgcttagcagtaaccaagtattacaaatcaatagcgataagtgtatgaaataaaaaatttgcccctttatatctttgtagtttgtaataagcctgctaaattctcaatgttcatgtgttctgttcaaaatttatatgattcagaaattatccaaaccacttgtgctagcgttattcataaattaagatgtcatggctgatatgatctgtgtatgtttgaatttcgacagtaatctcaaatttatacaactcaaaacttgtataaaccaccggtgctatctgttagagcttgcattttcagaaatagctgtaattggacatattttcataaatgatcatgtattcttagtgaatttggttctatgtattgttgtgatgattgctgcttttgctggatcaagcatcatgagtgaatagccctgataccagaggttttttttttttgcaacgcatgaagaaccatgctctcatcttaattttcatttgttcagtcatgaattgtttgtgcaatatattcagaaaagtgttcccatgtgaatttcatttgtttagtgatatatttgtgcgtgcaatatttggataactgccaatagcatcatcatcaggttctctgatatgtttgataaatgaaaactctagaagctcaattaggtagcagttctatgaagttttgtggttcaacagagcatatcaattgattttctctgaactactctctgaaattttgtggttcaacagagcaaaggtgtttgaataaaataatctacaacctattaacgtgatgatggtaacgttttttatcagtgaaggattaaaactccttgattcccatttatttatgcgaaggaaaaaatgagccattttttatcccagttttgcatcgcggaggaaaaaaaaatctatttttcaaatgttatttactgatgtgtcatgattcatgatctgagaatttatcattgttttagacggatctatttggttttacttaaatgctcaccctctagttttaacccttctagaactgtgccatctgcccatctgtaatatagtgtagtggaatgattcattcggctcagttgaactagaaaatctagaaaatgaaccttgcagctgaatgatttattccgatcatcttgaccaaatagatttatttctggatttggtatttgctttctcattctgctgagttgcacaatgttcaattgtaggctgggagtaaggcgagcccaagaacattatagtccggatttaatttttgctttctcattttcaggtatagcagagtacattatgctcatgtgaatacaaccaagtacattttcagatccggttgctagctagtgccatggaggagcagcaacggccacctccatgacgcgactccgtcaatgtccagccagcgccagccatctccgccaccaaccaccggccggtgtctagatctatgttatattgtcatggagtaaaatgtttactcacaccatatgattgtttcatgccgtgtaggcttattgtaaaaaagttactattctcatatttctcattgtattcatatcgtgtaggtttattgtaaaacatttaccatgtgctaataagtgtccgtgaaaaatacttgagtctatttaactatatttaactagatagtaaaattattactcaacaataacgaattaatctaacattatgttcacgagtaattgatttacttagtgaggctctagtgtgaaaaaaaccaataacttattgacgaaaacaatattgggcgcggacgtaatctcctagtaattcttttacttatggttccacgttagaaggaaaacaacataaattaattgggtgtgcgggagtgttagtaactcgtttactcataggttgataggctcttttactactataagtaatttacttactaaaagatggtcgcgaaaaaaaaagaacgtggcatcaaaaaggtgcgggtgtggggcggttgggggtgggggaggagagagaaaggtggtttttctgggtgggagtgggggtggggtgggggtg

SEQ ID NO: 30864 - DNA, 9226 bp, Oryza sativa
tgggtaggggggcatgtgaggggagcattttagttattacgcaccctggatatttttttaaacaatcataattttacaaaacaaagaatctaccgtcatataacaaagaaacttcctttcaaatattgcactattttaaaataaattttacacatttatattctgtacctattaaacgcactcaagccgccaagtgatgctctaataaaatagagaaaatcctagaaattctaagaaaaaaacaaaacatctaccccttgattttcacttaaattggtgagtccaatattatacaccattagatatatcgatcttaaaacaaactaaatatcatgggtcccacctatcctcctcccgcgcgttggtaggtggcaggtggagtatatacgtacgtacatgtatgtatgcttcctttcttttcctttttttcctttttacatttatatatatataatggatatattttttaaataatcataattttacaaaacaaagaatctaccatcatataacaaagaatcttcctttcaaataatgcactattttaaaataaattttacacaattatattgatatgtacctattaaataaacaatatctatattaattaatttatacatgcacataaactgatggccccattacataaatcatcagatctacttttcattaccttggtctattattcactgtttcaaaataaggtctacaccattatattgtgtacccattaaattaacaatttaaaatctatattaactaatttaacttacactagaactggtggacttattattataatcatcggatctattgtttgctaataaataaagtgtccgaaattctctttttgcccgctgcacaatacacgtctgcacctttgcctttcccatgtgtgacaaagtgtagtgtctgagacatataaggtgatcacaaccgctgtaaagcttccaccttgccacaaatcaaatcatatatggagatgattaattttgttataacatgaaaagaaaattaaatgtgtgatgcagtgagagaataattaagtaccatggattgtgtttttctcaacactaattagctctatttaaattgaaaccgagagttgattacataataattataatgtatctgtgttatgtcgtatttggattttgtactatttgttcgtataggtgaaaggaatcattatgttataaatatgagcgcaatattgacgaatattaatagaactcttactacgacaagggtgataaagggagtttaaggccctctctttttttcccgattccatattttggaattttgtttgcatgctttctaagtttctaaatagtgccttctttaaattaacaacattctaactttttagaagtcaattcattcatttataccctcaaaaaaaatatcacataaattatataattcatcaatttcaaaaaaactatcacataaattatataattcatcaatttcagctatcctaaaccttaagtactacatattttttttcatgcgagtcatggtgataaattattaaagtcgtaagatgaatatgtaagagttactctgaacaattgtaaataggtgtcaaaattaattgctattaattagacatctaatggcttgcaagccacaaaattaatttcactctacatgtatataatcatggacgaagctggaacaaatattaccatatgtcccatacatatatattgcacagttaatattctaattacatgtgttaagtcatttaaaatttcttaaaatgctctcaagctgcgacgtggtgctctaataaattagggaaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacgcacctacgtgcatgggtacgtacgcttcccctccctttttcattttttctccttcttcctttttttcccatgcatatgcttccctctctttattactatatcatgcgccttcatgagacgatttaatcaaaagaattttgagtatcttgcactcgtatttttcatttgcggtcgtactacacggtatgcgtatagatggattatatgataattaactagcaatagttttttatttactcgagaaaaaagaaacatgattcaaaaatcgtaagtacttaatccatctcctacttaagtttgtgaatggttttttaagatacgttaagaaaaatagaacccttaaattattataaaataacattatccaaactttagtttgcccttaatctatgagacaaaatttctgaacaaacaataatcttaccttttaataatataagtgcccgcgcatacgcgcgagccaccttcctagttgcaaaaaaagttgcatgatagattctgttccaaacttctcctgtcacaattctatgctgatgtgaattggatgctgtggatttgtgactggaaggagcaataacaatttgaaatttttatctgagctgaaattatgctacattgtcccttgcagccctgtaaaagatgaaaggttaggggacatcggaacagttctgaagaagaataatgtttctcttgatgttgttgaatttggtgaatctgaaaactagaagctcttgttgctgcagttggtggcaacagccacatagttcacatcccacctggggaagatctttgtgtcgtcctttcgaagtgaacatctattatgttatctgctggttcttacccaaattcctagtgctagaatatgctatcactaatcagtaataaccctattcctttcaaaggtcaccaataattactggagatgaaggagggggtgctgcgttactatccttattgagatcacctctgctgtcaaaaaaggattatgaggtagattacaagaaggaggcggaatctacctcagatacacctactgacaatgagaaggcaaaggtatgctactgcgttactatccttattgagatcactggctttctttgtgcacaagtttaactactatcagatcatgaactctgtgactgcagaattccatcagggatatatttgtatttgtggtattgtctatctgtttattgcttcggagcacccatccctcaaaatatcccaaatcactgttcacccttgtaagttagtgcctatagctacacactatgaacttcactaacttaactgcccttgggagtggtagtcctgtcctgtctagtattctccaggacaaaaaaaaaaaaaaacaacaacaacaactccagcaacaatctatttccatgtcaatttttagtaaatagtaactgaattatatgaatatgaataaacaggaactgcatttagacttgtaatcttggatctgtttagaattttatattaacattttcttatctgggaacttaattttcttttgaggctggccttgaatgtgttgctaggaacctgagccacttcctcatttgttttcttcaccttctaacgatgcaagttgtcttgaaaaaagatcggaatgatcatgatactaaccatcattatttgattgcttttgtgctattttagtggcactgtggcaggacaacgttaacagtgtaattggtgagataactataaatattattatcaatgatttttaagctttgaaatctataacatatggttatcaccatctttgtaatatgcaaaatgtagtaacactaagtcaggattacttttatggcttccttgccttttattttttagataatggaagctttattaagactcagttaaatacatcaagatgatacattccaactgagtccacccggggcctctgcatagaatgcacacagccaaaacactggatctaagaagacttccccatcacaaaacacaaaaactagtggctatcaatccatagactagatcgccacccatgctcctgggtaaaaaattcttgtaccacctagtccaactgttgcaataccaccgcaatagtatcccgaagtcccggtttgtggaggatggcccaggtgcgtagccaccgggtgactaaagtagtaacctgcaaaggagaagacaacactttgttataaaaaattaccccgtttctgcttagccatatggaccaacaaagagacgttgcacacatcaaaagcagatttctcatgtctttaggaacacaagtaacccaatgcccaaacaagtgagtaatattttgaggaggttgtatgttcgaagccatatgaacaacataccataccaagcgagaaacactacattgaaagaacaaatgttgaatggtctcttccttgtgacaaaagcaacattttttactacctttccagtttcgcttggctaggttatccttggttagtattactccccgacgtaagtaccataggaaaatcttaactttgagcggtatttttaccttctaaatacgtctattgatatttgggatcttttgtgtgttgtgaggttggtggtgtaattttgttttatcttctattggtcgttacaatgttatcaaacaagctagttatttatgtcatgcatgaagaagggctccatacgatacaagaagctctttcaaggtttgaaaatgcagaacatgcaggaatatccgacgattcctcatccgggcaggagttggaattaggttagttattggcttatactacgtattttctgattttacaatatcgttttcctcttcagccttgctctcttggtgctatatacgttggaatacgcgtaggctacgatagcataatcaaaatttttctactgcgtaaacctggtgtttacacccaaatttggcacctatgaacgaaataggggaaaattggcaaagtttggaaagtgacgggtttacttactcgagaaggcaggtttcgtgtttcctttggtttctatcccgagttggatgtggagaagggcctgtagagggcaagaccaacccctatttaagggacaaggccggttcattgtaaaaccctccgaatacaatatacttgaatcgttcttttactatgttttctattttaccctagtttagtccatctttgtcggtttgcgccgtaaaccgtccaccgccgctgcgagagtgcgacacccctttgtaggtttgtcctgaaaaccttctgttttgcccacgagacgggtagttatcctcatatcgacttaaatcggcctagaggctgattttgatctctaaatcggctccgctagctggtttatcttttctttttgtaaagcccatcttgatttggccctttggctagatcgaggtggttagcgactccatatcaccgcaaggcgtttaggtgttgcgatcgtgcttgtcgacttgtcaaaaaagttgccaacaccaggaaccatacaagtattagaccatagatcgttatcactcgacgtgcgaccctataggttcatgtacactcggctgtaacctgaaaactccttttcggtccacgtgtcaacaacggcccctagcagaacgtattgaccaccgggcatacataaagattatatcgcctaaacctctagtgcatacttgtatgaactcctttgcctcacgatatcgattaagctcaaggctagatatgtgccatcctctattagctcaatcattcactcgaacctatgatagattatataacttgtgatagactcatcaatcacctttggcatggccatgcacttccataatctatgacatcgaggggcccagagatatctctccataggaggggcaaatcccatcttgattattcatatcccattacatgtttcatagcataccccaaaactacttttatagctacccaattaccgagtagcgtttaacagtccctaagtaagctactacaaatgttgggaaccatgataatctcgggtctaagaattcaacaccaacacttaatgagatcactgatgacacaacacatatggctcttgcacgggctcatgttgggtctattcaacaacatgttccccaacaagggtccccattatcaatttggtatctctattccataatgcatgaaacatgatcatcaattaatacatgtgctgatcatttaaacattttttgttccacatattatatttgatcagggatcctttagaaatagtaacatacaacataaagagtctcatgaaagaatcacatattcattaaccaataatgagttatctatttcaaggaacaatgttggataaatatgaaaacatagtatgtgataacaatcatctctatgattgcttctagggcatatcaccaacaatatattgagcaagaagtgaggagatttactaccatcttctttctctcctctctcttctcttcttgcactcagctctcgtcctctcctgtgctatatatctgcctcctttcgttccgattctacttcagcaagatttcagtcttgagtgcttcagtagattattctgttcacattgcctgagtgacgtatgtgggctctgctgcccagagcacgtgcccacccaccatgccgacgggaatgccgtcgttattgaggtgagtggatcaagagcgcttcttgtcttcaatttactctttcttgcttctgaattgaccttttttgctttcttagaaggtacatatggtggaaggttcctctgctctaagccaccacacggtcaggagtaatggacttggctataactggataaaaatacggagagtagactatcaagataatacgtgggtcatgatcggacaaggccgaccaagaagcactcgctctagcatgagagggtaatgcaagggatgtcatggtcttatttctctgaggaatgaatattgtagccctgcatgcaaggtaataccaacacagatgatttctatcgcagtattcttgttattgagttgaacactaacgaattgcagttcagtttttgccggaaaaaataatttgcattgtctatcgcattattcttgtgattgagtcccaaatttcagtttcattggttgaagttattgttgagtctacagaggagtcataaattaaatttccattgtatgacactgacagattgatgtttgctttaagtaatggttgtataaacctgccgtagcaggaacataatgcaaagccttgtgagcattgacttccatggttcacataccagagatagattctgtcccatttgtttaagagcattttcatgtgaaaggtgtgtagaccactcaatgcatcatcctgttcctgagcaaccgaacgtttatgtccttcacgttattggacgtgatggatggcttgtgataccatatcaacaactaccttcagacatgataattgggattagggtaagtacccttctaatgctatttgtgcttgaaattgagataacttctactattgtatgtatgactaaaattgatatttgctaattatagaaggtacaactcgaggatggaagttttggtgtaccactaaggccacgtctacccccaattcaagatggagaatacatatgtagcagattggattgtgaagagggggtccaatttgctgctgacatatgtagcattttgtgcaagcatcatgtcccagattaggacgtcaaatcactgatgatgaaggacaacattaacattctcgggacttatcacaagctgtttatctgattacaacaagatatataatttctctctttactctttaccgtcaggaattagcattgtgtgcaaatacatactcaacttttgaaattctgaatccaaatacatacatttcaatactattaaacatttcaatactattaaaagcacatccttgaacagatccagtgcaatctcaggccaactctcgtgagggtatgtttgagaaaacttattgtaatagatgcaagaatgttggtcacctaaatagagattgtgttgcttttgtgttttgattaactgccaacacataatactgaggactgcatctttgataaacaacctagacccataggaaaacttgtgggatatggagctcctgggttatattgcatcatgattcagaataccaaacctatctctttaatggaacactctcaatcatttctgatggagagatgtccgatcctatggcttatatcaatcatttctggtggggagctagacatggaagatttcccaataggttgagatttgaggagctctctaattttgatcatttcactgtaaaatggactaatgtgtatgagagaatggatttcccaataggttgagatttgagtagctctctaattatcatttcactgtgaaagggagaatggacacaacaatgctgtgcatttagtttgggttaatgtgggtggaatccctaacgagatgaaaaattaccaagctctttttaaaatagattcaaatttggggctggtaatggaagtaggtttaaatttggggccagtaatgaaagtagatatgaagctagcaataccattagagtcaaagtaggaatgatggagttgggtgtgctagctttgaagttggtgcttacaaccctaaaaggttttttttgtattaatctgtttttactctgaatgaagtgttagaaaaaggatggttcaaggatgaatgttttgaggagggacatacataaaggaacttcaaacataagacagaattagagagaaggtaagcagccagtcaatgaggagaataagagagaagacaagcagccagtcaataaggattgtgacatggatgcaagaagtctcagagtatatatatgtcagggagggaggttacttgcgagtctgttccagaactgatgaacaaataaacagtgaaagtgtgtgagatcttcagacaagagtggctatagattgtaaaagcataacataaggagcagtcagaaagtttgaatagacagaagatgactgaaagatcccatatgcaagataaaatggaaacacatggtagatgcatgatgggtaaggaattcagtcacaggacatggtgagaaaaaggttctgacatgcaggagacacacaaggatataaatattgaggttagtgtgcaaatgaggaagacagagaaaaggtagattttggggagagtgaggtgtttcttgatttacaagattctgaatataaaactaactctgaacatttctggcagtagtagaaagaaaaacaaaagagaaaaccttgaaattat

SEQ ID NO: 30865 - DNA, 1991 bp, Oryza sativa
caggcatgcaagcttgaaaaaaaatatataacaaaagcgaaagaagctaaaactgaaactgtatataaaaataactcccatggaactggcaatttggatgaggccggttgtcacaatccgtggcgacgcaagcgcttgcgtgaggcgccgggtgaatggatcaatcgaatggaacggcactaacattaacataacggggaagtatgcgtatgatgcaaatatggagcatatctactatcggttgggcgccttcctcggctggggactgctttctccccacgcgatgctcccagccatgcgtacattccacggcgacgacgacgttacttcccctcgctttccccgtcttcttttttctccgaagatgatgttcagctagcgggtctcactgaactgtggcccatgaaacatgctaaattgccaattgccgacatcctcccttggtctttgaggttaggcgggtctgctgtgctatagacatattaattacgctccccttctcgaaatataaggaattttagatgaatgggacattatctgtctagattcgtattattaggaaatgtaatcaccgacggatctgatggatggtctggtggtccccggaccacctaaaaaattgccgacccaaggcccatgtaggtaggtacggcaaaaaaaaaatcccataaaatatattgccgtatcatgtgggttgctaactggcgcgcgcacgtcagcaacggaggtctcgcgcgccctagctggtaccttctgtttcttttttttttcccttttgtgattttcacttttttggtgtttttttttattttttttaatcttcagcacatgtatttttagatctttgggttgaaagtttttagatttgaagttgaaagttttcagatctggtttcgaaagttttcaaatctcgagctgaaaattttcaaatccgagttgaaagttttcaaaatttgtgttacaaatttaaatttcgagtttgtcgagggaagacccccgatcgcggggagtcgcgtgacccccctttcgtgagttcggccgaggtcagagactcatctctccgaagtcgcgtgttcgtccctccgattcccggttagaaagcacacaagtcgattacccaggttcaggccgctctggagtgtaacaccctactcctgcgtttgggattatcaatgaacttttttacaaggttccccttgcctccttctcttcctctctctctagcccccctcttttggtgggcaaggtcctccttttatagcttaaggggataccacatgcgccgtttctacccttcccctccatcggagggaggggagggggcccttctccctactgccaccgggtttcaacccgtgccttttgctggaagctaagcatcggtcggtccttgagtggggcccagcgccgtctcccgcctgacacggggggcagccctgtcattccctcataaatgaatgaggacttgcggtagccctgcatcgaccgacgcccggatgtgacggggcgtacctaccgccactccgcggagacagaggcgacgtgggggcacgaccacccgttcaatcgaccatgaccggcaatagactggtcacagaccggtcgcatccgactgacaggagtcggtcgggcacgccgcacgtctgccctcgccgcattgaatgcagcaagggacggttggggcgctgcacatttatggccgcctagcctggactcccctctcacacttccccccgagagagggcctcgggctaaaacgacgagagagcccgagggggtgacgtcacccccgaggggatgtcgtcgacccccgaggctctccccatcgccttagtgactcacgaggtatacaggtgggaccagctcgcagagccacgtggctggaaagggaagcagctctcctttactccgcatactcctttactccgcatacccccgggcccatatctccgacagagttgaaaatttttaaagtttgagttgaaagtttt

SEQ ID NO: 30866 - DNA, 5489 bp, Oryza sativa
gcgtgcgtgctaattagcttttccgcgtatcatctgctcgcctcgcgtatcggcctacttgttactgtaagggctcctggtggcctggttggcatgcctgatccttctcggtgaccagcgtccacgtgcggtgatcggggccgacgatcgagtggcgacggcaaggccgcagcaaggggtggccacgcgacgtgcatatgtagaggacaacggcggcggcggcaagccggcaccggcacgggcgcacgtacggtggttggccggcggaaagtggcaccgagccaaggaagcaaggcagggcagatgattaggccttattcgtttcgaaggattcctaaaggaaatctcaattcctatgcaataagcactatccatgcattcggtttgtaggattcaaagaaaaattttccatagaaacgctatgccaatcctccaaaaatcctccaaaatatactaattccacagaaatgacaacatccactccatccttttttgtttagctaagtataggaaaaatttctgtgttccaatcctttgttttgcacgtgcattcctaaattatttttacgtttttcatattcctatgattttaaaatcctgtgaaccgaatagacccttattgattagccgattagattttctcttctattcaattcatctcagctgggatgcgtcacgaacgaacgcagacggcgagcggaggcggggggcagtcagtggcgtcggaaaggtaggacggcgagtgaaggcagtggcgcgtcgcagatggaggcggtctccgctttctcttccttaccgcacacattcaacttcttcctcgagcacttcatccatttctgccatttgccgctcccgactttggcatcattggatccaacctaatatgatcgatcacttgatcagaaataggtatgggtttatcgaaaaccacagagaagttggtcacggacgttagtttctttccattcacaaatcactgatcgaagtagctccagtccatccctgtctctccaacaaaaaaaaaaaagtctaattcgatccaaaaacagtgatggttccattataccctacttggtcctcagaccaaatacatgtttaaagcccacaaattttcaatgtttcaatgtatcgtgcaaacaaacgacggtgtttgagaaagattaagggaaagataaactaaaaaattattaaggcatgattaattggattttaactaatataaatttaaaaatatatttatttaatattttaagacaagttttatatagttttcttttaaaaaaaccacatcatttatttgaaaagtataataacacaaaccgaggttatatcctagtctgaaaaaacttgcaacatcatcttttcgcttttgcttatactaatcagccaaaatttaaattttcacccttaaatttaaagttaattttgggatttttcaatcatagtttattttcggtctttgctttaagatcactaaaaacacgtatataaaagttttattcataaattatttttttatttacaaatataccgtttcgcattttcctccagtatgtcaaacgatggggctgttagggtatcccaatagaagccacacctatcagtggcctcacatgggtcatacaagctgagaccacacatgagaaacatatctcccaatagaagacactccaaatgcccctacaaaaaatctgaggcaagtgtccgaagacacactagcccacaatgtcccacaacgtgtgttctctagcccatggagcccatgtgcattttactatcctacccctacgttttattttagcccggcctctttttctccgtcacccgtcgcctatctctctatctctttcgccaccgcttgcctctctctccagccgctcaccgctgtctctctccctcctcacaacgagaggggcgagcggtgcacgaggtggctggcagcgcggggtggctgacagtgctggttgctggttcccttcttcctccgccagtcaccgcctctctctctctctccacggttggtcgggaggctggatctagtgggttgctgcgttgtcgctaggttgtcgctgttgcaccgcctccagctcgtccactacctcaccacctccggccaagggtagaagggaaagatacatatgcggagcagagaccatgaaagacttagccacgacatcgtccaacatggagcctagctccgtggcttgatgaaaaggggccgagtagcacagtgaggtgtgtgtctcatagagaagtcgtgcccctcttacgagagatggatccggtcctaaaagaaacgttcgcatggacaaccttatagccacagtacaaagggtaacagtacaggtggaaagatttttcccccgaggcagagctcgtcaacgcgaggtgggagtggacgagcagttgacccaacgaaatgtacagtacagtacgtggaggagcagcaaatgcagaccggccgtggcgtggcaggcagccatcacattcaccgaggttccgctccgctccgctcgtctgcggatcgccgctctctgtctcaaccacccgcacagacgagctccgggcgccgagcgggtgggccccaccggacgcgacgcggaaaaaactccaatccgattaattcccccaacacgccacatccgcccctcctccgctataattaaaacgcgactagccgacggcgcactccgccatttcctcctccaccgcctaccgcatctcctcgcgttcacaccacgcacccgaatcttccgcgcctaccggacgccggtgggccacgccgcgcttcggtcggcgcgtcgccggagaaggaggaggagccgtctcgttgccatgaagtgggggatcgccgccgccgtcgcgtccgccgccgccgtggccgccgcgtcaggggccgagctgctcgcctgcgactgcgccgatcagccgccgcagcagcaggaggccgccgccgccgccgtcgggaggtgcgacgccttcctcgtccgccacaaccaggtttgcctccccgatccccttcttcttctccccctctcttcttcctcgatctcctctgatccccttttctccttttggctcgtcagggttcgtcgttgtcaagggacgcggaacgcgcggcggcggcggcggcgggggagcagcgtgtggaggggaagaagttcgcgccgcggttcgacggcctccgattcatcgagacgctcgtcacggcgcaccgctgaactggggctgagattccttccttccttcctcccgtgattcggcggaggaagaggaggaggagacgccagatgcgcgcgtgatccttcggcgatttagatgcagcgccaagaagttttgttaggacaattgagaaattgaggctttgaaatctttcctcttctttctgtttgcttttctttctaatttcttcttattttcccccctttctattgttactgctattgctgttgacaattatggtgatccttgttaagctgaggcgataattgtgatgatttatgtaaattgcgagccatgattgattcttcatccaatttcttaggactgttcatgatatgatgttgatatccgcctcctctatcttagcatcccaagggatgtgggtgtctctgctgtaccttgcttacccatgtctgtccttattctcagcttgtttcttttcccttctttttcttctttgatatggtttctttttttttaattattttcttgatgtgatctctttccctccatgttggtggattgaattgctgcatgtgtgtgtggcaacaaattggtgctttgtcatcactcatcaagagttgtgatgctattggcacctgtgattgtgatgttattgtggcaaggggccatgtgatgtggctgcttgctctccatgctttccatttctactcctgcttttcttgattggatttgtatgtgatcaagatttcgaatggatgggatcaacctgagcaggatgtccgaattgaaccgtttatcagcaagctggtgacattgatgggcagaatggatgcaggaggcattgctggaaaggaagtacagtactggagatgattagggctgcgttttatgtgcaaatgaatgggacaggatcacggaagggactctggagcatgttcctcccaacttcctttttccaaaccctttctttcgttgtttattgtaccagcatgacacatgtagtggaaggcaagaaaattggacaaattttgtagtgtccaaactttttttttcatatttgtagtgtccaaactttttttttttcatatttgtagtgtccaaacttttttttttcatagttattgattataacagcctggtacatgtggaagcacaaaaactggacagttctttacactgtacaaacaaattggctggcctgaaaaggaatatccaaggatgaagttgccctgcccgggtttaccttaccgccgataaccgcgtggttaccgggcttaccgcggggtacggtaatataaatatcacggtaaccttcttaaattcaaataaatttaaaaaaaattgaatttttgataaattttgcacggttttatacgatttttcacggttaccgcgcggtaaccgtacttaccgctgggacgcggtaaccctggccccggcggtttgggaaaccctagccatgcccgcatgtgcacatgatttaatttatttttggctggagaattgattgtatttttttctattgtaaattacaaaccagtatgacggaatcgattttataacacatgcctctcgtgctgtatgagttttttcttttaaaaaaaaagaacagcaaagagaacctattcaggtattttcaaaatctactattcataactgcgggaaaagacaagcaaatatttatcttattaatagtattttcaccgtcggtaatagaaaaacggcaaaatttgctacaggacactcaaaaaatatgtaattagttgtcggacaccgcaaagacgtgaatttgctctagtacactccaaaagtgtggtaatttgctgcaggacactaggcgcattaaaatataatatccacccaattgatgagagagaaaccaaataaaatgacagttttactctcatcttcttatctcttcttcctgtctttttccgtcgctcctctcacgtgtgcaaatttcttagattaacgttcagtgagggaaattacacctaagtacagaattgatgatgctgctgatttcttggctaattaacagattatggtgttgattaactaattactccttgctagttttactaggcctccaaaaatttttagacggagtagtcgaagacgatggagaaccttctcgaattaaatttgaaaatatactgttcattcgattttttctcacaaatattcgggatgcaaaatattttacagaaatataccgtcggtctcgcacaaccgttgcgcgaaagtgacataggaaagacgtcgtggacggtatcgcgcagggaaagcatgagaccgcacgg

SEQ ID NO: 30867 - DNA, 8591 bp, Oryza sativa
acgtcattcccacatcactctcgcgcaacggttgagcgagaccgatggtatatttgtgtaaaaagttttgcatctcgaatattattgagaaaaaattaaataaacagtatattttcaaatttaattcgaaccttctccgggagaaggagcggctcgacgagtgcgggcttgacagcggcgaggagcattgcggtggcgggtaacgatggtggcgatcgtcggcgtagcacaccacacagagcgcatccatggataccacctgctgcatctcgtgcacgtcggcttcggtggcagccggccgccactggatgctacgccgaggactcctcgagaagcaacacgccttctcctcctcctccttgctgtgtgctcccgtaggcagggctcatagacccccgtgtgctggcacctcacaccctccgacaacaaaagaagactaggagaaggaagaagataagggcaaaatagtcatttcacgtggtttctctctcattagttgggcatatattatattttaatgcgcccagtgtcctgcagcaaattaccacatttttggagtgtcctagagtaaattcacgtctttacggtgtccgacagctaattacacattttttgagtgtcctagagcaaattttgcctagaaaaacgtgtctcacatgtgaaacgaaacaatcacttactccctccgttccaaaataagcgcaatcatgagtttccgtttctaactttattcgtccatcttatttaattttttttaaaaaataaaaaacataagtcaaacataaaataatattcatgttttataatctaataacaacaaaaatactaatcataaattttttttaaataagacgatcaatcaaagttggacactgaaacccatagctgcacttattttaggacggatggagtaataaaaaaaactcgtttccaatctgagcacggcaacaccacaaccgctacctgtggcctcaagccgcaggattgagatcctgcctgacgacacatcgggaccacatgtcaattataaaggcacggtgcagtgactgcagaggatcctgatcccaagctgcgacctgcgtctcccttgtcataaaaacgagacccatggcggtcagttgccttttgagctaacaaagatctttttctagtgggttccatgaatctgccttcaagtgtatataaattttatgactgtgattattcccttcatttcatattattttttttcactcaaccacctttagctattaattatttttgtttcattgattcactagttgcatacgtaatagttcgttttcttaaaaaaaaataggagatacttcctccgttttatatcataagtcattttgactttctaagataaacttattgaaagtttgaccaaatttatagaaaaatatagcaacacttatagaactaattagtttcattacatctaaggttgaacatatattttttttgtgttgtgttgaaaatattggtatatttttctataaacttggtgaaatcaataaaaaaattgacttagaaaaaaatcaaaacgacttaaaatatgaaagagaggtaatacattttgttttcttaatgtataggggtggggtttgattcatcttccgcacgctcgccaagcccaagagatgatttcagcctaacacgctaataaaaaggagttttcacatgagtccccctttactctttgtttacatttagatctgtatattaatttgtcgttttatgtaccctgacatagtttcctggacaaaggtttatacacaatagactgaaaatgtgggctaaatttctgagcatgacaaactctatatgctaaatttctgaacatgacaaactctatatgcctataatagcatgtttagacctacctgtgacttatttcttgtgtttgacttcagaattttgttcctaggacataggttatggaccttgggcaagcaagtagaagagtagctgcagcaatcttgatttcagatatacagtatatcataactggccatcattcaacataaaatattcagctcaaacaggaataggcactatctgtgctgacatagcatataaaaacattcagaacctattcatattgatgccattttaaaccataccatctttttgataaaatctaacatgtggatgcattaggtttgttaccaaacattggttatgcactaatgcttatgaaacttggcaacatcatagtaagttaccaaaatctgggcaggtcaaatgttgccaaaatttggtaatgtatatgtgggcactaaactaaacagataaacaacagcctaccatgttggtaacataccaaatttggaaatgtttattttggcatcaatctgaacaggctatcaaatttcagccattgtttgacatcaatagattcgaccttgaggcttgaggtcctagaccacacatatgctacaagaagagtgtcacagcaaagatagtgccacaagattaataatgattaaatctggagtgtcagctcttgattaattctgatagggaataaggcaatgtgtagttgtgtactatacaataaataaactaaactatagtttagagaggtcgccgaatttcaccatagcaaatcacttcattttaacattaaagcaggattcggaatttttgaaaccaccccccccccccacaacatgaaatgatttcaactaaaacttttggattttgtgaatttgatgaaaagaaatgttcaaattcaagaattcaaattatttcggaaattatggtcatatcggtgatcccgataaaaatagcgaaaacaaatatttgaatcctgaattaaagtatagggtttcctaaaaagtttaagtgaacagagacctcataacttttaattcaaaatcataaaatgacagcgggaaaaactcaataagcaactatctaacacaagttaacactgtgccagaagttaggttcctctgcccattatcaagtatccacaattctacacatttgtgaagagaatgaaggctattatcagtctgattagcagtacccacacttcacattctaatcacacagctaatcagctagctattctaatttatgatgcaaacttgcaaattatcagccaacatttcattcgattaacatatcacaagaaaattgcatgtcttaaagcagcattttcatgaattattttggagcaatgcattcaaaccgaaaagaggaacgcttgacccaaactatctgaagattaccttataagtctatacgaacgagggctatcatagcccggctatgacaaacttggcacaaaccaagtgcaagcatgcatcgaggggccaggcaactcttcgatttggccatcctccatcctgaaccggtagatgaaagacctgctggctctgtccatcttgaagaagtaaacacaattcccctcaagccccgcgaaatccgcggcgcggagcgagaatccctggtagagaccaacgaacagcattctgtctctaatgctcctcatctgaacccaccgcgatttctcccccgcaatctctagccggtgaacctccaatgcacagcaatcctccagcaattctcctgcttgttcactgttcttgctcctgaagtaccgaatcacgcacaggagatcatcgccggacgggaataggcactatctgtgctgacatagcatataaaaacattcaggacccattcagattgatgccattttaatccataccatctttttgataaaatctaacatgtggatgcattaggtttgctaccagacattggttatgcactaatgtttatgaaatttggcaacatcatagtaagttaccaaaatctggacaggccaaatgttgccaaaatttggtaatgtatatctgggcactaaactaaacacataaaaaatagcctaccatgttggtaacttaccaaaatttggaaagttttattttggcatcaataggttggaccttgaggtcctagaccacacatatgctacaagaagagtgtcacagcaaagatagtgccacaagattaataatgattaaatatggagtgtcagctcttgattaattctgatagggaatatggcaatatgtattgtacaataaataaactaaactatagtttagagatgttgccaaatttcaccatggcaaatcacttcattttaacattaaagcaggattcgaaattgtgaaccccccaacacgaaatgatttcaactaaaacttttggaattttttgtgaatttgataaaaagaaatgttcatatttgaccaaattttgttcaagaattcaaattatttcggaaattatggtcatatcggtaaaatttgaatgaaagtataggacttcttaacaagtttaagtgaacagagatctcataatttttaattcaaaatcacaaaatgacagcgggaataactcaataagcaactatctaacacaagttaacactgtgtcagaagttaggttcctctgcccatttatctaatcatagatatttgcatacatgaatttgcttcaatgtcgcaaggttggcactgatatcaagaagaattcacaggtaatgaaaataactgactatctcgaactccaagaagtatccacaattctacacatttgtgaagagaatgaaggcaattatcagtctgattagcagtacccaaactttacattccaatcacacagctaatcagctagctattctaatttatgatgcaaacttgcaaattatcagccaacatttcattcgattaacatatcacaagaaaattgcatgtcttaaagcagcattttcatgaattattttggagcaatgtattcaaaccaaaaagaggaacgcctgaccaaaactatctgaagattaccttataagtccacgaatgagggctatgacaaacttggcacaaaccaagtgcaagcatgcattgaggggccaggcaactcttcgatttgaccatcctccatgctgaaccggtagatgaaagacctgctggctctgtccatcttgaagaagtaaacacaattcccctcaagccccgcgaaatccgcggcgcggagcgagaatccctggtagagaccaacgaacagcattctgtctccaatgctcctcatctgaacccaccgcgatttctcccccgcaatctctagccggtgaacctccaatgcacggcaatcctccagcaattctcctgcttgttctgtgttcttgcgcctgaagtaccgaatcacgcacaggagatcatcgccggacgggacgaaggatgagcacttgaaggcatccctgtgcagggtcaccggcggtggtggcggcggcgcagcgtcaccgagcacggcaagcgtggcggcgtcgaagatggtgaggtggccgcggtcgttgcagacgaacaccttcccggcgtggtacatgttctcggcgacgaggtccaccaccggcaccgtcgtccacccgccgccgccgccggcggggtggtggaagaagatcctcctggtgtcgtagagcaccaccggcgagtcgggaccggggaggtagtagccctgggtgatgggggagaaggcgtcgaagggggaaggcgggagggggaggtcggcgccggtgagggggttgacgaggaggaggagggggccgtggtcggagaagaggaggtgggagtttgtgtggccgaagagggagcaggtggcggagggggcggcaacggagcggagggcggcggaggagagggagtagaaggagagggaggggccggggccggcggtggggttgatgggggcggggcgggcaaggagccatgggaggaagggaggaggggaggccgctgcggcggcggtggcggcgcgccacgcgcggcagacggcgcggaagcggaggaagtcgagtgggtcgtggaggcggccggagaagaggcggaggaggtcgccggggaggcctgaccagtccattcgcggcggcggaggctacggcggcagcgcgtcttgaatgtttcagattggggagacggcgaaatggctcctattttttgtttctttttttccattttgctacgaatctgtcgcgtgatttgttttgatgataggatgtgtttagttcacactaaaattaaaaatatgttaaaattaaaacgatgtgacgaaaaagttaaaagtttatttatgtagaaaaattttgatgtgataaaaaagttagatgtttgaagaaaaaattttggaactaaactcggctatacttgtctcatcaattaacgagccagagggaccattaaagctgagatgcttgtattttggaaaggaggaattgacagcttagcatggccattttatgctttaacccattggctgtgtttagttcagcgtaaagtttggatttcaattgaaattagagatgatgtaactgaaaagttatgtgtgtatgacaggttgatgtgatgaaaaaggactgaagtttggatccaaattttagatctaaacacagccattgttttgtttgttatacagagaaaccctcttggtataaagctaaccagttgaacaaacacatacaaatgacaaaagctgggaccataatgttgaagcaacattgttcatatatattgaaaaccaacagtaacgaaaatcctgctccgtaagattcacaaggatccagcatatacatatcgcaagccacaatattaggggaagtgtcatatttacaggtgtcaaaagatgaatacaattgaccaaaaaaaagcttatactcgaacaggataatggacagacgacttattgactggatgcagcagccactgattggaatttgatagtcagaaattacaagatgaatcaggtcctaagataagacgatcatgagttggtacaaatggctaacacaacagacaagacccacgactatcaactctttcacagaaaagtggaacaaagatatatgatcacagacgctcatctcttaatgagaaaaccaagcaggattctcagaatagcaataaccagcacaaaaactagtgagaaaccaccgttctgactccccatttgcctccttagaagatcctgttcaattccaatagaagataaatgaaactacgtgagtgttgcagttcagattcagatttcattgatgcacaaagccataatagacaaacaagatgatatttgtagataacgaaatacatctgtacttgtagaaattagtgggttgcaaataaacttgacaaaaaagttaaaaaaaaataaataaagcgcatgtaaactgcttattctatctatctaactcaaagctaaaaattgtattagtgtttttttccggtggactggtcactgctggccacagtaaaagaacagggaatgagtaaatcatgtggtgattatttattggagatgcaaatttagcgacaaagctgttactcaaacctaactagtttttttttttttggggggggggggggtaagttaatctagttcttactgccaaagttaaaaaatataatgggtcattaaatgtttgcataatcaagctaaccagttcttcttgaagcttcatgttctgttgaatggcagaactcttctcctccttcaactttgaaatcaaggccaatggctgcacatagctgtgaaagagatcagcttattgtgctttggcatcattgtcaagcaacataggaagtcggaatcctctataataagacctctcagttcctcagtttgtaacaaaagtaaaatgctaacaaagtgaatatatgctagaagatgaagcatccctcagattaagttaccatttgcatctaaatatgttgagatgaaaagccatgatttatgcaaggagaacattaatcaaaatatcattagagcaagaatattggcaagcaaaaaaaaaatgttatagtagtgtgtgaaattaggattcagtgataacatggcattgtcaaatttaacaggagaacaatgcaacatatatatcaagcaaagtccgtagttttccccagggaaaaaacaaagagcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcagacatagtagtatctctaaattatgacacctatcagaagaaaacatagatgtttcccatctgaagatgcatacctcagaggttactgtttcttattctctagatccttttgttgcctgcaaagaaaagttcacaatttgtttcagatgataaggaaatgaatctctctgaaacgagaaatttaactatttgccactttaggtttgccaattatccaaatgcccttattaggtttgtccttaattttttttgcccttttaaggtggtggcatcttaactatttgccacttttgcccatgtggcatgccaacatggcaacacagtgtaaaaatcgacgtgggacacacttgtgagccgcacagctatccccttcctctcgctctccggcctacccgtcggctgccagcgttgctcctctcggcgacggcggtgcaccggcttgcagttgcggaggagga

SEQ ID NO: 30868 - DNA, 15386 bp, Oryza sativa
agagacaggcgctcggcgaggacggcgaccaccgtcggtgcaaacaacgtgagcatgacctcgcacgtccagtctagtgcgtacatcctcgactacggtggcgctcggctccccctcctccgccgccgcgagccggcacgccgtcgccgctgccgacatggttcgcctctgggaaagagaggagcagcgctcggctccccctcctcctccgcagccgcgagccggcgcatcgcccccgccgccgctgggaaagagaggagtagcgacggaagccgatgggtatgtcggagagcgagagagggggaaagaggatagctgtgcggctaacaagtgggtcccacatcgatttttacactgtgttgccatgttggcatgccacagtggcaaatagttaagatgccaccacattataggggcaaaaaaaaattaaggacaaacctaagaaagaagggtatttggataattggtaaacgtaaaaatggcaaatagttaaattccccctgaacccccaccaaattgaagcccccaaaagtacaacgcacaaagcctccatgggaaggaaatgcaaagatagtgccaccgcacaaacacatcccgcaggtggcggcggatctagggcttggggtgctggtgctcggcgtcttcggctaggagcaaggagacgctggatgagatgaagagggtagaggcggtggccgtcggcgggggttaggctggtggcctgtggcggaggaggcagcgcggggtgtagaaggagagggaggggcgggtggtgtgctggaactggaagggatcggaggaggggaggccgcagctgcctgcatgtggcggtggctgaaacccatcggtggagaggagtggagtggagtggcggcggcgcggtcagaggctactggccaaggaagaagaagggctgatattataggatacaggtgggacccacgtgccagtggaagtaaagggcacgagcccacctgtcatcctctctgactctgcttgacttccatggcgcggtgcgaccgcgagcgacttcttcccggcttgctgccggtgatggccgagtagaatcgtagaaagtgagggaaggggacgaggatgtctgagcgcaagtactcacctagactccatgggcgtcgtcgaggaagaccgtctgctgcagtgcagggaagatgagaagatcgattcaatcacctgccaccaccggtgcggcaatattccttcttcaggagatgctgcaccaatataatggccgttggactgcctatacatttgtcgataaatttttccctaaaaatttgatagatgtaattattgtacaatcataatgtaattacgctgtaacttatatataattacactgtaacttgcatgtaactacattgtaacttatatataagtttcacataattttgaattattagatttattacaagatttgttttggtgaggaagaaaacaaatcatagcacacacatatatgaaagaatttgttcccacgacctccattttaccgaaataacatgttacggagagatttttgaaagttatatataagttacactatagttacagtgtaattacatgcaagttacagtgtaattacactacgattgtactgtaattacatctgtcaaatttttgagggaaaatttgtcgacaaatatatagcaaaatcgaatgggcgtaaactgtcacctcctcctggcaatcgatgtgcctgcatccgtgtccgtcgtgggtggttagcgccctgcaggaggacggaaaaaaaagtggtgtggcatatggactaggtcttgagaccgagaggacacacaagaatttcagcaagtctacgttatgtgattatgtcaagttgtcaaaacggtaaattcaacctggaaacaaccactaaaccacaattcatctacataaatgcataaataaaagggtaggcactgaaaaatacttgaaagaataatgtttcagacttttagcaatacatatataatcgatagatatgataaatatatatagaatatgcaaaagaaagagtaaagatggattaaaagactacctttaacatggattaacttaaaaaaaaacaagttgaattttttagatggcctttactcaaaagagctacaaccaattattacatagtagcaatcaaaaacagagtgtaaatctagagaataacaaagaatccagcctaacgtaaggagatcacaattattgaagtctatttgtaaatctccaaccataattgataaaaagttgcataaccgtagtctctaactttcgacgtgcaactttcagaaactcttcatcttcatcacacttttgtagttgtgcccgaaaccggagtcaatatgttgccctgaaaataacctgcatataggaaaatgatggtgatttttcaaaaaccatatcgttcctacttagccatattgcccaacaaatggcagaagctccaacaagtatcagtttactctttttcttatcaattcccaaaagccacccattaaaaatagaggtaagttcatccgaggtcccttaacttgttaaggaatccgactttcgtccctcaatcggaaaactagacacaacgggtccctcaactattaaaactggtgcagattagatcccttggcagttttgagagtggttttggctgacgtggcgcctacgtggctaatttgactcggtcttcatctgacgtggcattgacgtggcgcttacgtggcaattcgatcaggaaaaataataaaaccggtaggacccacatgtcagtttcacacacaaattaataaaaatggtggggcctacgtgggccccacatatcatgctcacccctcctcttcttcctcctccctccccatctctcctctcttcgtctctctcctctgctctctccaggcgacggagaggcagcggcggccggcggccggcggccggcgggagagaagggagcggcgcgcagcggcggaggcacggctccggcggttgtgggcagaagaggaatcggcggcgggaagtggctctggctgcggcggccgcggtcgctgcacatgctcgaccccttcgcggccgctgccgcgcccgccgctgccgaggctccgtccggggaggccgccatcgccgctgtcggagcggcggcggaggaggcaaccccgacgctgatcgacgcctcagcaagctcaacaaccaccttgataagatgctgaagtaagatttctcatgttatggcaaaaactgaaaattgattccacaacgcttgatgcattccttaaaaaaatgtttgaattttctgttgttgaaatcgatcatatttttaataactttttggttctggtatgttatgttccttttgaacagagacatggaggaatcatggctggggccatggaaatgccttctcttgggatacgaatgtacgatttaactgaccaacacattgaggcagctctgacaaacctgattgctggtctggaatcagaatacaaatttgaagtaaatccagtgctcatcaaggtcatccttggtggtgctatgtcagtggatgaagtgcaggactgtgtttctcaacttatatcgtgtaaaggctattttggccgaggagggtgttgtgggaaagacagacttagagccttctcttcttgctgtattgagtctgaagctctggagacagtcgaatgcttaataaaaagtacagtgaatgagctgagtgaaccagttgatagagatccaggcatttttgttctcgacgaacctgctgcggccacggccacgaccacgagtccacgacgacacttccgctcccgagatactgccacgtagcgagccctccgcctccagtccacgccggggtcgcgggcttgggcgacgagcagcaactggagcagctggcgagggtgctctcctcgctgtggtacaacgagatggcctccgcggcgccgctcctcgccaactcaacgttgctcgcggcgtggccagggtcgatcaccgtcttcgcggctcccgacgtcttcctccgctcctcttgcaccatgtgctcgcgccgccatgtcctactggagcacatcgcgactagataaatcatttgttgccacgaaaaaaatcgtggcatcaatactaaaattgtggaaatagatacatgttgccacaattgtaaaatcgttgctagccgtagtaataaacagcgtggtaataggttattgcaacgatttttattttgtggtaataaatttagatgttgccacggaatggatgtggcaaaaagtcatattgcaacacttcacatcgttgtaataaaaattattgccaccactccatatgtagcattagttttacgtaccaagttaaaagttcaaatattagtctatcatcctatctatttatctactctttttttttgattttgtgtcttggctaggattcgaacccaagacctgtccttcaggtgtgctctcctttaccaactcaactacacatcaattctgttcgaaaatgcatatagttctatttgagcctagctaactgagatttgaatcatagatttgatatctaaaagatttcaaatgaaaaagttatcacctataaaattgtagatctcgtcgagagctataatttccatataaaatttgtctcaatccgtgtccatatgaaaaaataaagttaaattatgagatggcaatttttttattgcaacaattttgttgatcatggcaacaaaaaatagtgaaaagtactgtgtactatataaattgccacaaaaataaaaattgtggcgatagaacatgtttttttgcaacagtacgatttttcgtggcaatatctcattttctattgcaacaaaagtactaaataaaacaacgattgtagatcgttgcaataaaaaataattatttgccacagaaaaattatcattgcaatactataatatattgctacgaattattttttgttgtaataatttggtggcaatagctcaattatcttgtagcgccctgggagggaggaggaagaacaggaagggtgagttctactgacatgtggggcccacgtgggtcccccatttttattatttatgtgtgagattgacatgtgggtcccacgggttttattatttttcgggatcgaattgccacgtaagcgccacgtcaatccacatcagatgaagaccgagtcaaattagccacgtaggagccacgtcagccaaaaccactctcaaaaacgccgagggatctaatctgcaccggttttgatagttgagggacccgttgtgtctggttttctgaattagggacgaaaatcggattcgttgacaagttaagggacctcagatgaacttatttcttaaaaatatgagatatgctaactggaagattaaaaacaaaagagaactgaactgctatccatatgaacttcgcaaaatgacaattcacatagagatgttgaatagactcattcttcaaacaaaaagaatacctcaagctgccattccagttacgccttgccaaattatccttagttaacacaacccctttaagcaagtaccacatgaaaattttaatcttaagtggcaacttaagcttccaaatacacttatttctctcgatatagccattattaattaaagctaggtatatagacctcaccaagaacaagccattctgatgggaattccatatgaaactatcagacgaattattcaactggatatgtactatagaggcacacaactcatgccaacaaacaagattctgataaactaaagctctcctaaaagaaacattaagcggaacagatcccataacagtggcaatagagtatgttttccttcggacaatagtgtataacgacggatatttatccttgaaagccaagttgcctagccatttatcttcccaaaatctaatttgttccccattattaacaatccaagagcccatatttaagaaagtacttttgacattcataagaccaggcaaaaaataggaatccccttgtttcctatcaacttgggttatagacttattataaagatatttcctcttcaataagtcatgccaaaccccttcctcattaattaacttaaacaatcatttacttaaaaaacatttattttgtatctccagattatgaatcccaagaccccccggtccttgggttgacaaacaacatcccacctagtgagcctgtaatttttcttatgatcatccccttgtcaaaagaaccgcgatctgtaataatcaattttacgaagaacccctttcggcacctaaaaaaagatatcataaatatggctaaacttaaaagaacagaattaatcaacaccaatctaccaccaacagataaatgcttgcctttccaactactaagctttttctcaattctctcttcaataagtttccaatctttactagtaagcttcctaaagtgcatcggaattccaagatatttaaaaggaaaggcacctaacttacaaccaaagataccagaatattgctcataacattcctttgcctgaccaaaacaaaataattcactcttgtgaaaatttatttttaggctaggtaacttttcaaagacagattaaatcaatttcagattctttgcctgttgcaagtcatgctccaaaaagatgatagtatcatatgcgtattgcaagatagacaaaccatcgtcaacaagatggggaataatcccattcaatagtcccacctctttagccatcttgatcaatagagtaagcatgtcagctactatattaaaaagaataggagataaaggatccccttgcctaaaacctttgtaagtttgaaaacaattaccaatttgatcgttaacctttataccaacatcatcgccttgaataaaagatgctatccactcacaccatctaggagaaaagcctttcattctcaaagttttttgttgtacaaaaggccatttaactttgtcataagctttctcaaaatcaatcttaaaaattacaccgcttttatctttgcgatgtaattcatgtaaagtctcatgtaaaataagcaccccttccataatatttctcccaggaatgaacgctgtttgagtaggactaattaccttttgagcgatatccattgttctatttgtagcaattttggtaaaaatcttaaagctaacattaagtaagcatataggtctatactgttgaatcttcatagccttaacacacttaggcaaaagaatgatagtaccaaagttcagcgaatataagggaaaactcccagaatgaaagtccttaaacagttctaagaggtcgaatttaatgacattccagaaaacttggtaaaactcagcaggaaatccatctggacccggagctttgttgtgttccatttggaaaatagcatccttaacctcattttcagtaaaatccttagttaaggcttcattctccaattgtgaaacttgaggaatgtcagtaacataattctcatcaaactgaaggtcagactcatcaagagggccaaaaagacctttataataagtggtaatatgtgactttaaattggcatcaccacttatgcgactttaaaaacaagttgaatgaaacgtaaaacagtaaaagcatactgctcgacaactactagactacctggtgaaatagctcttcaaatctacaaacaaaattacacacatgtgaatcaatgacaaattgtgcattaacttttgcaaattgcaatgttttcacttgtcatttgtcaaatactcaacaaatgttatctttttaagatgccaaagcctttcctttcccctttctatccatttgtgctgaatcgggccagttgctttgctgccttgcccttgctgacttgttggtgtagctgccctgctcggcttagagctgggttgctgcgtgcagcccagtggcggacacaggattttgaagatggtgtacagagttatcaaatcgttgttccataaagaaactaaagcttaatagtaggaaaagtaatgagaaagtttttcttgctagaacaaataaaaatagaaacattgcaaaatagctaaagaaaaattaaatcttggagaagagatagtatgttttcatcccaaacactccatagagatttttgcactaccatttaactttttgactgctctaccatataaattcagatatgcacattaatcaaatttcctaaaagcaaccatcaattgaatcaaacattaactacagaaagatgagttaggagcctaaaaatatatatgatacgaacacattcaacccattgagccatgaggttgcttctccagtgcagtggcttgtcgatcagctgcttgttctcggcttctctccgtgaccacgagcagcgcctgcacacggctgccattggttggttgtcccaaaccataggaaggcatgcaatatgctcggtattctggttgtaagccccatagacaaaccagagattcagggtcatgagacgagatcgaggagcttgtgttgttctgccagagccgttttctatgagttgtattgtgattttaggctaaagaatagctgttttgacccaactaatgatatatataggtaatatacctattaattcaaagattattagtcaaaaattttgggggtacagatgtacccccatgtcccatgctaggttcacccctggcgcagccgtgcatgccaggtggcaccgcgacactaggagcagacgagcaccgccatgccggcctgcagcctgcagatgctcgccgcctagcctagatgcattgcccacgtgttaacaaccaaatttggtaatatcggcatcggaaaagaagattagatcgaagtggagtcgaaggcggagatcgattcgagaacagagcaagaatcggctggagtccagatcggctacgaataggatcggctgggtctgagtcggactaggtaagccgatacagccaattccgacaatacgacttggtgtatgacatcgggttgaattgaggtacttcaagatgattgccgcacatggatagagtcctgagaaggcaattgtatctattaatttggatattttatgtaatttccatagagatatgtttgggcaaaagtctgccgcaaagacttatggtatcttagagtatgttagagataagagtcgtgtccgatatggacatagtttgtaattttcgggtataaatagaccccgaaccccgtgtaatcaattaacacacatgttcactacaatttcggcgcatcaccacccttttgctttagttttatttcgacgagttcttgctttcgggttgagctgcatcggtttcgatcttcaacaaaagataaaacttgttatgacggcttgcgttctcgggattagtgcttccatctttatgatattctaatcttgcttatgtaattcgtcgagttatcatatatcttacataatttctggcaatatcgttatctaacctacaatcggctaacatctatcggtaaagggcagtcgattaggttagatttcaacgttgatttaaattatataagatatctaccactctatgaaatttccagcggcttgattgtttagatgttgttcttcttttcatacttaatgctgcatcagttgagtttgatctattaagtcgtgcttagcatatcaatctctagcatgccttctggttgccaattagggtagtatcggagtttcagcctaccttatctgatttaactatatttgctctatatgcttcattgacatgttaaatccaccctttatgtcaagatattattgcatctaagtatactaagcttctgtttagcatattctgcttgttttaacatctaaacatagagttgtatcggagtattagccgatacatgctagatcaatctgatcggctatgccatgaacatatatagtccttttattaatatatatttcgatctaagtgatttatactgtttcggcatggcgaccgatctatcccaatcacttgatttaagtatataccgatataagaactacatattgttaatatctacaaccgatcgggtagatttagttctttattacctatttacaaccgccgatcgatttacatatgacatcggctcaaagataaatgatatgtcatcggcacttagccgaccggctatcatttataggtttaaccgtggtttctttgtctctatttcttgttgattacaggatcaaatcaactggcacgctaacacacccgaaggcgagctttggacctgcactggagttaagcagatctcccaggcctcgtgtttttcgtcaacaccacgccgacgccatcgcgtcacacgtcggctggacgccgcgcatggccgctgcccggcttgaccctggagctgaaggccggagcagggggtactcgcaggcagcctaaggtatggcgagcgccagacctcgccataccgggtcctccgccactggccgtccacaagcttgacgcgcggtgaaattgagcaaatcaatccagaactagttttttttttttttttgtttctgcattgcatagaaaagttaccagtgaactgaaactggtcttaaaaatttacatctatgctatcacaagaacctattgggagttgttccccagagataagacattgacactccatccatcttccatcacaatctccaacaccacaaggttatctcgctctttaactggatgatgaagcctatggtccaaacacttctgtgagctgaagctgagcttgcatgtcaaacagaaccggtcttttaaatgttcttgattataactcgagtttacgagtttttgcactgtctgccagctccggccccgttgtacctccgcaacctatatgggagagaaatcaagaactcacaaaattaaatctggactcttttgtagcacgaattgaactcgattcaacgattccaatttccaagccaaagaaatgtccacaagaaaaggtaagaacagaaaataatcaattatcgaaactcacagaatgaaatcaggactctttctacaacaaattgaactcgattcaacgattccaatttccaagcaaaagaaatgcctgcaagaaaaggcaataacataaaataatcaatcatcgaactcacaaaatgaaatcaggactctttgcagaagaaattgaactcgattcaacgaatccaatttcagagcaaaggaaatgcccgcaagaaaaggcaataacagaaaatgatcaatcatcgaactcacaaaacagttagaaacaacagaaacaaacaatttattcccaccttggatttcgggctacaaaagttgtatcttgacgctattggtaatcgcagcggcatttctccctcagacccgaaagtgttttcctcagcctatctcttcctagcattatctaggtgtttgcttcgtgcttgaccctttgaatcttgtccaattacaacccatcctcttatttttggcatctcgatggctcagtacaggaaaaccattaacaatgaaaatatgtcaaaaagaaggaaacatgtggagttagttcagatgcatgagacaggacatgtagatgattgaaagaaagattcttgccgcaacgcaactacctccactgtaacagcattggtgccagggtgaaggatggcggcgtgttccggacaacaggacaaacaaaccatggctgagtagcgggaacaaaacctctcatgacacgaaatcctcatgcaaaatctgttctatgaagggagaaagatccatttttgttgaagaggaggtgaagaaattaagaaagacgatcggggtggacgggaggaagaaggagaggcgaggaagaagaaaagagtctatcggcagagacgagaaaaaaactattataaaatgttaaactaactagttaaaacttataagtattattattactcagtaagttacccctttcaaattgatattctagcttcgctactgtaaagtttggatcaaagtattattactaatgtcatacttcttgatttcttctatgatttggatgtccgctgaattccgctgtatgacgtaaaagcatcactaaattctattagttgtttgtttaggtagcggtggtacaatgcgaccaaagctggcaattggtgcagaacttgtcaacataaattttaatcaattgagctgcctatatgaggaatttttcgtgcatcactgcttgagacatatgtcccactacccagtttagcaggaaattaactttaaccaaaccgcccagtttagcaggaaattaactttaaccaaagttagagaaaaatgcattgacatctattccaataaataaatactttctccgtttcatattataagactttctagcattgtccacattcatatatatgttaatgaatctagacatatatgtgtgcctagattcattaacatctatatgaatgtgggtaatgctagaaagtcttataacctaaaacggaggtagtatatatgttacaccatgatcactaattttacgctatataatataacatatgatatacttatacatagtgaaagacacaactcagttgaacaatatttatagcgcactatgatcattagatttacaacaaatgttactcacctatatatgttattagttaagaacattctagattatatttaggaaaaaatatctctcaaattctaaaaactaattaatcaacttggaagcatacataattactactaactcatgtaaaaattacaaataatataatacaaaccatgggcacacaaaccaaccgggagtttttagtggctaaagctatcagtatcatcatcaataataaagaagaatgagataacaaggagatggaagagtggaagaataccatgagaaaattgcagttttaccctacattgtgctaaagaacaaatccacgttgaaaaatatgaaaatttaataatatttgtaaatcattgatgtgtatattatacaatgtctttgtgaaagatatgacttccagcagagagtgtgagcttgtcatgtgagttgggcacatctttttgctgggagcctatctttattgagattcgaagtgcctaggttgaggtagttttgtatccactgcaataccactctatctatcatgcgcttcctattattattcatgggctagctgcttcagcttcattgagtagcttgcttctatttttgtgctcggcgcattgtcctcccctgcttttatcttaccatcattgtgtcgaatagctttctcaacatggacacatatgtcggcaatctggaaaagcctcattgctaagggtgtgttttgtgtcgccaactcttggatggtgtactgaactcggacgcctaccttgaaggctcgtatgacagatgcatcagtgatctcaaggattttgttatgacattcattgaaaatcctataaagtcttacaatgacatgccatttttctacctcatggcatgtaggtactccttgaccgcgtgccacttctaggtgcaacgacgagacaaggagcgaccctaggctgttgctgttgttgctgctactgcatgctgctcaaagttcgagcaggagtgcaccgctgcttctgttgttcctcggcgccctgaactcgctgtaaaatcaaggagttgatttagattttgtgatgaaaatattggtggtttgctaatgttattttggagattttataagacggttgattttgtgaagtgtgcagtttcggttgaccctagcggtctgactggtcgcgtgccgccagtcagaccacagatgttgcggcggtcagaccagccggctcgacggtctaaccggcaggatcatgttcgatgtcggtttcgggttgtcttgttggatttggatgtttccttcggggatttggcttctagatggtttctatgcgtatggatactattgttatactaatgtgagtcaagttgggacgaacttgggctcggaatatggtttcttggttgttgcatgtgcaggtgttgcttgaggcctcgggagagtgttgccggtgatagattggagtcaacttgggacaagttgatgtccagagatcaagagatcatgagggatattaaaggctagaggacaatgcatatggtgatgaagaaattcatatggtatacaagagggattgtgtacatatggtaagaggagtcaaatttggaagggagtccgaattcaggaagattgattaagataaggaaagagataagttggatacttgcaagagagggtttcctatgtgggttaggagttctaagttgtgttagattcgtgggctatgcacagcctacctcatgtataaatagagagggaagatgaggcctcccggtatcgattttagagatactagagttgagagaaagttagggtttcgagtttagttcgagattttggtgaggagtgttgttggtgcactttgtaaacactagttgatgcaataatgtcaaaaagtttcaatctacatcttcgagtttgtcatctaccggtgtttatgggtcccgacggtctaaccgcaggtgtgcgtgcggtctgaccggtgggatagcggcggtctgaccgcaggtctacgggcggtctgaccggcgaggcttcggtggtttgaccggcggtaggagggcggttcgaccagcggtgataggggcttcgacgtctaattcgttttgagggtaatctttaattccgaaaaagatttttgggttttcggttttccctaccattcaccctcctctggtaggtttgttaggtttgtttggtaatgtgagatcctacactcgcctggccccccctcgatttcgccaccacgctgtcaggaagccagccacgggggcatcgtcgtcggcgagccccattgccgaccgctccaccactgctgccctaccacggctagaatcaccgagcaagaagagtcgaggaagaatataagtgtaacatacgggtcccacttgttaacctctaaggctgtgtttgtttctgtgtgctgggaactcatttcccattcacggaaaacatagaggtccattagcgtgcaaggttattatgatttttttaagcaactttcatataaaaactttctgcaaaaaacgtaccgtctagcattttgaaaagcatgcacgtagaacacgaggaggtgggttgtgtgcattttggtttgtacgacaataaagactccatcctttcgcttattggcggaataagcgaaacgacatatttgcaaaaagaaaataatttgtaaattaaacttttatatacgtgttcttagcaatcgaaaagaaacgaaaagactggaaaataaactacaacgaaaaaatacctcaaaatcaactcgaaatttaagattgaaaattcaaattttgacttataaccataaggccagaagatgaggctgtaaggcatgaaaatatctagtctatc

SEQ ID NO: 30869 - DNA, 11231 bp, Oryza sativa
ggccttattttattatttcttgttaatttggagagagagaaacactggtgagagtacgattttgcccctaccctcacacggcggcggtagcctgggcgagggagtggcactttggcagcaatggcatatggatccaattaactcaaaagtaaattagagttggtagagttgcaatggcatatggatccaattaactcaaaagtaaatctatctattatattattaaaggaatagaaaaaggagccctcacgttcgctctcatggcctagaaattctcacattaatcggagaaaaaaaaagacagagtccatatagaaatacaatttagaaatagctgaaattcggaattaaaaaaaaaggaatattagaagaggagactagagtccatatagaaatacaatttacaaataactgaaattcggaattaaaaaataaggaatattagatgaggagactagagtccatatagaaatacaattaggaaatagctgaaattcggaattaaaaataaggaatattataagtagaggatagagtccatatagaaatacaattaggaaatagctgaaattcggaattaaaaataaggaatattagaagtagagtatagagtccatatagaaatacaattaggaaatagcttaaatttggaattaaaaataaggattattagaagtagagtatagagtccatatagaaataaaattagtagaaaaaggagcattcacgttcgctctcatggcctagaaattctcacattaatcggagaaaaagaaaagacagagtccatatagaaatacaatttagaaataactgaaattcggaattaaaaaataaggaatattagaagaggagactagagtctatatagaaatacaattaggaaatagctgaaattcggaattaaaaataaggaatattacaagtagaggatagggtccatataggaatacagttaggaaataactgaaattcggaattaaaaacaaggaatattagaagtagagtatggagtccatatagaaatacaattaggaaataactgaaattcagaattaaaaaaaggattattagaagtagagtatagagtccatataggaatttaaaactaactaaaatttgaaaaaatataatgaaattaaaagtagagtttagagcccgtataaaaatacaatatatttataaataactaaaattcgaaattaagaaaaacatgggaagaagaatttaaagtcaatataagaatgcaatttagaagtaactgaaattcgaaattaaaaattaaagaatattgaaatatgagtttagagtccacgtagaaatacaattagaaataataaaaattcagaaataaaaataaataatgttggaagaagagtatagagtctatatagaaatacaatttacagaaaattcgaaattaaaaaaaagaaatattgaaagacgagtctagagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataaaaatcatatatgctattatatgagagaaaatataatgatactagccgcgcaatctgcgcgggccaccatgctagttagaaagtaaagatatattcactttcgtgggatcacgctactaactaaaataatctaaccaaccagagtattaattcccagtgacaaaaattgtgatgtcaacaggtattccatgaattgtccgttgtcaaattccaattacgacataccaacttaccaagggcatgcgcacatagaattgtgctaaacccaccgctgtccgctctcggcttttctcatcttaccgtaggccaattctcttccttatatataatttttacgcgatttgacatcagaggatggagcaatttggcatcaggcttccacggcgaggccaatctgcatcacctgcccgctcgatccctgaaaatcttcttccgtttctctctggagattgctgacagcgaggctgcggaagcaggcgaggggttcagggctggtgactggtgagatcgatctctcatctctccgtcttgctatctttctccctatctctaagtcgatcattcctgtaaattgtattgctggtaggcttttcttgttacctttgctgttaaagccatttaggatttttctattgcctgtgacctgtttgtggaaatgcctcaaaaagatatcacagctcacaggggcaggattctaggttcccaggtgaaaagcaacatggaagagggaggaggatgaatctgagtttttttagagtatttctttttttgtatttgtaattggagaatttagattatttaccacctaattctcttgtaattgaggcattcattttctaaatcatatttcttttggctaactgcactatgagcacctgcaaacaccaaaaggtatactattagagcatgattttcatacatatataacagaagtttcagtaaagctctactgtaatcagattctgctttattgaattgcaatttctggtttagtgatacaggattttaggtgactatgcaataaggaaattcgtgcccttgtgtgcgtttgggggctgatgtttacaaaataataatcactatgttgaggatgttaaatggaacttgtttgctctttatatttagcattgtcttgcactatgtctcttaagggttatattatacgagttacatcatccagaattggactagaagtagaacttcatatttggaagtggaattaccagtctaattcggatcataatataacagtcatcatcccctaacaaattttgaccactagcagctacatggcacaggtaacaggtaatttagttcatagtatatatttgccataaggcatgcagatagggactaagcccagatcaattggtgagaggtgtggatgtacaccaccatcaccaaagttcagaaacctcttggactcaacttgggtctctatttcttctctattaatttgataccaagttcctttttagtatttgtttttgtgtcaatcaattaatcttcacaaatataacgcaagtgttcttgaatcttatataatatctttttctatgaaatcacccatttctaacaaaagttcactatttagccttaaaagtcatgtgctgattcattttccttccttatcgagtggcctatattgtatggcatccacaggtctgtcacatattttactttttttcagaaggctcagttcttacaactatggccgaagtacttctgtcaagttttgccgtgtcaattattggaaaaataattttgtttgttagtgaacacggtttgatggggattaaatcagacaggagtgtgcatcaagaactggggaagctacagaattcgttgcaagctattagtggagttcttctagacgcagagaggaagcagagtacttctagtgcactcaaggaatggctgcgaaaactgaaagatgtcatgtatgacatagatgacattttggacgatgcgtcaactgaaactttgaagcgcagagttagcaaagatgtggttactcaaaccaattgtgtacatatttctcgattgaaattgagaagaaaattgctcaaaaggaagaagaaatggagcagcagaataagagaagttcatgaaaagcttaacgaaatagccgctagtaaaaaggactttggactgaccgattggacagtgggtggtcagtgttctgaagaaccagaaagagaatcatattcttttgtgtatcaacctgatataattggaagggatgatgctagagatgagattgttagtaagatactaagagcagcagaacatcatgatatttttgtgcttcctctgcttgggcttggaggcattgggaaaactgaactagcaaatatggtgtatcatgatcaacaaatcagggagaggttcagcaagatgatgtgggcctgtgtctctaataaatttaatctgaaaaatatactacaagatataatcgagtctgccagtggtgagagttgcaagcatctaaacttggaacatttacaaaataagctcaggggaattctgcagaatggaaattatttcctggtattggatgatctgtggactcgtgatgtaaatgaatggagagagctgaggaatttgttgtcaagtggtgcaaggggtagtgtgataattgttactacacgcgaaaatgttgttgcatctatggttggtacctcagacccgtacaaggtgggtgcactcccttttcatgagtgcatgcaaatttttaccagagttgcattcagacaaggtgaggaaaataaatatccgtggttgttgaaaattggagagtccattgtgaagaagtgtgctggagtaccactggcaataaaatcattgggttctctactatttaccatgcgtgatgaaactcaatggctacgtgttaaagaagaccacttgtgcaaaattgtacaaggtgacagagatataatgccagtgctaaagttaagttacaatgctcttccagctgcccttaaaccatgtctttcctatttatccatatttcctaaggacttcgaatattacagaagatgcataatcatgttttggatggcacatgggctactgaactcgaacaaattgagtgaagaaatagatgttggtaatcagtacattattgaattgataggaagttccctttttcaagactctctaattacttttgatggaagcatgccacattgcaagttacatgacattgtacatgatcttggtagatatgttttggacacagacctagctgttgtgaactgtgaagggcaacaagtctcagaaacagtcaggcatctagtatgggaccttaaggatttcacacacgagcaagaatttcccaggcatttaatcaaagcaagaaaagctcgaacttttattagttcgtgtaatcatggttctttaagcaaaaaatttctggaagtgctgctgtccaagttattgcttctacgtgtattgattatatccggagttagaattgacgaactcccagattcaattggaaatttgaagcacttgaggtatcttgacctcacctggaacaaaaccataaaataccttcccaattccctatgcaagctcataaaccttcagacacttgatctttatcgaagtgaccaactaatcgagttgccgagagatgtaaacaagttaatcagcctcaggtacctgagtttgacatcgaagcaaaagcagttgccagaagcaggacttcgtggctgggcttcactaacatccctgcagcttcactcatgtagtgaactaacatcactgtcagaagggattggctcgttgactgccctacagatgctgtggatcagtgattgcccaaagcttccttctctcccagccagcatgacacacctctccagtctgcgagagctgttcatcgacaattgcccggagctggatttgatgcatccagaggaggccatggatgggctatggagtcttcgatcattgcagatcattggacttccaaagctagagcgtcttcctgacactctttgttctgcctcgggttctcttcggtatttattgattgagcaatgccccaatctaagggagcttccaagcttcatgcaagatctcactaaccatcagaggcaggggggtattcattaaggatttcccgagcataattatataaagggatgacaattagttgattactatctccccataaaatcttcatggaggtatagagcttatgctaaaagaaaagccccacaggaagtgaaataggtaagttgcattgttctctcagaaatttaaatctttataatttaatacgaattgcagtgtttgctagattttaggtttgggtgttaagcttccacacttgtatgattactttgtctaatataattcagttcagtttgggagatggatttttcatttttattttttttgcattataggtatgtatggaagtatagcaaccagtgaagctaagaaatcccttttaggcaccaattcaatggatttccttttgttgcagagaggaccaaagtacacactagctgggatgaaaaacaataactgagactgctcataatttgttaaccgaataggccacaagtttgaattacgatgctcattagggtgattgtaaggttgctctttttgaaatgtatagtgatgctctgaataccatgtccctgtttctaaattgtaatgatgcatttcaaatgtgccatgtctaattcagtttatgtttttcacatgtttaattatttcagaccttaattgaacttatatggtcgttcgaagtcctgtttgtatagaaatttcagtttaattcccgagcttgaaattttattatactcatatattgccagctgattaaatattccatatccgtacaagttttttagtttctcatttttatatgttttattaattcaaacactgctacagaaacaacaatgtgtaccggttgggaaaaccccatggatgctaaatttcccaaatgacacataacataacagggggcacctttgaggtagtcaaaggtgccagtttaggaaccggtagctttgaggttccagaaataaaaaaaaaaggcggcttgatcagctcgaaggataggggaaaggaaggatgtaggagatcccaatccaatgcacgtcagatcgcctcgtggatcccggtggtgatcggcggcgggtgttggtggaggagaatgggagggtggggaaggcaaggaagagtcagagatagagagagagagagaggagaggataaggccgagtacaagtactcatgggttcggcaaaaagtatctccctcccacccaccggttcggctcggctcggttttacgggcgtcggtttattaaaaaaccatcacctataatatattatagatgttgatttttttaatgaaatggtacctatgataaattaaaggttcctttttttagaaaaaatcagcacatacagtactggtttttctctagaactgttacttataattgctcaaatgtgttggttatttaatgtttcagcccttggagacagggaaaggtttatatatgccagttttagtacatccgtcacctatagtgtcgtcctctttgtgtatttgtgtggtagtgagaccttaattttgcaccttccatacgatgttctacatgatgctcacacatttggcagctgacaaaattgaattcatagccaaatttttgtatgtcttacatcataatgttattgaatttaccgtggaatttcatatgcgtagtaattttattatagattagtttatgttttctgtaggtgactgtaacctttgttcttttgtagtttctgtacgtagtagtagtttgtgctagcagaatgtttatgtccaatgttcagatttctgatattacctgcataggttagtatttcaggaagaggctaaaagtttgtgctaagtcttatattttcttctttatttgaatgatacttgcaaaatgcctagttggtcgaggcattgttttccctgttttattgccgaagaatggtggtcacaaaatagcgaaggtaaaattagacaaccatacaaagttttatggaaaatattaccagggctttgcccagtagctatatattaaaataaaagaacgcgtgtacagagaacataaaacaaaggccccagaacaaaaaaaccaaaaaaaaaagctaagaatgagaatgctaagagaatcctttattctgcaaacatgcagaagaatttcattttttaaagcaacaaaccacctattaagatctggctgaacattgttaaaaaacatggctatttcgctgcttccaaatgcgccaacaagcaaaacatataaagtccaagaaacctttcctccttagccaaaacctgcatttggcaaattttcaaattagtattccacctgattcccagacgctcccaacacatcttactgaaaggacaaatgaagaataagtgaagcaaggtttctcttggtcctccacaaacaccacaacacaaaacaacatcttcaggggcacaatgcctcctgtccaacacatctctagtgttgagtctatcccacagaagtaactacacgaaaaccttattctttttgatgcactttgatttacagatccaaatgaaaagccttggaatcgaaattcccaaaaagttagatggataaaacttctgagtagagtacacttgagaattccaaatgaaagaccaagaatctcctctttgagttttgaaagataaactactcattgcaactgaaggaactgcccataagcctgcgcttctagaggaagattgaaacaatcttctagatggaagccagaaaaatttcttacagattcccatctcactgtggtttgggaaaagagagcttagaacttaagttttctgtcttccccattccagatatcatcccaaaacaatattgtagtaccagactggattgagcatttagagatagctctgtatatattaaccaattgaataatatccctccaccaaaaagatcctttattaaagatcatgtgaggcacttttgttctgctgtaagaagtccatataagtctaacccaaggaaagtcttgcacagtgtaaaatttatgcagatgctttaaagaagcattagcagttaatctcctttacactctatccaccattggtgccatgtcaaccgctcttagtttgtagtatacccattggcaaacctaagtaagtaaaaggcatggtgcccacctttacatcccagcaacagagcaaattttctaatttatccttaggaacattcaaggggtaaatactggccttatgataatggatttccaaaccagtgtcttgagtgaaagtgtgtaaaagatccttaaggaaaaaaaaaatctctctaggatgcgtttatgaaaatgagggtatcatcagcatattgaaccactggaaagtccccctcatcttgcacatttataggtttagataacagtccgattctcatagctttatttaagactgttttaagtaattcaataccaagcacaaaaagcaaaggagaaaggggatcaccttgcctaacccctctcttgcacttgaaaattttcccagggactccatttgacaaaacagatgaacttgcagaactaaaaaccatcttcacccagtttatccattttgcagggaaacccatatgcttcattatttccaaaattgtagagtgttcaattgtatcaaaagcattttcaaagtccaatttgagaatcagaatctcccacatagactggtaacactgatggataaactcaaaagaccaaaacataggagaaaaagacaaaaccaataatagtgttattcgtatggttgtttatttacatatagcatgtgtgattttttttaattttttgcgaacatttataaaatatcttgttcaagttttcatgtaagatatagtttccactatactttcctagtaaccaatgtgatgcggacaagggttcctgatcttctgaaaggttttgataaacagtcgattttatggagtcacagcacaaattgatctggcttctgaacgaacatgctcttgagccccgcaaccgcagcaccacgtctactctggttatcaaccgtacgtgtcgaaacccggttgacctcaccgagaaggctaatccctatttgtgaatcgaagaacacaaacaagaacaagaaagaatacattcaaaatgtatatgaatgattaagctcacaagttggggtcttacaaactgaaggatcagcgaaactattcttgacagattaatctaagcaaaacccaaaccctaaaggtggcagcagctactaatatatagagtttagggtcatgcaaataccccttgacgcaaccctaatgggctccaacacgatacatagcccaaagaccaaaatacggcgacgcaacaccgaaacagattctagatgtcaacttgtttggtcgattcccaatgactcggaaagaatttggatatgggaccaaaccattggaaatgttatcttcttagctttccatccatataaagaaagccccaatccgagcacgtatgcgacctaggcacccattttagtgcagactggtcctagactacgaaacgtacttgaagttgacttggtttgggcctccatattgacttggacctccttgctgatcctccacacctctaagtccctctctaagtgtctccttgtctctccattattcctaatcataatataatcattaggtagcaatctgttctcaaaatcatataaagataaacataggaacgagctcacatctaaattcaattgttgcgtgcgagctcttgtgattggttcttgaatgaccgatggatgattgttgtgtatatccaaaggagtgatgtcctcatcacaatgtgctcttctggcgctctcccaagatagggaggttggggagctctctggaaacaataagaaaggcgacaaacagaaaaatccccttctctcgatccctcttactcggttccggcagctcactgccagtgatggctgaaagaggggtcaagccccttcctactagtagtagtttagccagtatagtgttgggttccacccattcttgggctttttcccgtatcttcgtgcaatgtcctgttttgactgaggtcgccggagtcgttcctatggaatctggacttgctaataatggatctgatggtggcaagttccggaggcggtcgattaatctgctccgatctctagccatggcagattgacaaggtcagtagttgccaatgctaccttctggtgattactacgctggtgattccactgttcatcctcttcacatgtggggagatggcggtcatcaggagtggcagatctggccaggcagaagcttagtagtagctgatctgcttgcccaatggctgacaccatcgaccggtggtgagcacaatggtagtggctggtgacttcgttcgggtggatttgtccatgcatgccttctcatccaatacagaagtgccgatctcattagacgcacatgcaggtaggctccttctcccccagaatgatgcagtcaatatcagctaggcaaaatcacatccttcctagtgctagaatgatcaagggttcctgcttttcgg

SEQ ID NO: 30870 - DNA, 19901 bp, Oryza sativa
  unsure (1)..(19901): unsure at all n locations
tccgaaaagcaacaacccttgatcatatcgtaactctatcagaaaagtctgagcagctaaagaacaaaacgcctgaacatataacggaatataagaagagcttgtacaagaccaagtttcttactgtgacacaatatattggatacgcattcctaagatttcaaaaaaaaaaaaagagtcataatgaccgcatacaactttaagtaagtctgataaatttcaatgtatatatctgtatttttttggtttgtgactaattgaaccgtcatagcgatcattacatatgtttattgctctacctgaagtacggaccgataccgtcttggacccccttgattataatcacatgtcgtgcagccaattcctaaaaatctgtcggcacccagggattgaattcccgaatacctggagcgtacactgtactagtcccatgatcagtgcgtagtacacgcatccacaatatatattgttaccacatccataccatgtacatggcacacaagtaaaaaaaatgtagctcttataacttagcagtgtaagagtcatgcaaagtggttaggccaactgaccactgaaatgagtttaaaacgcagcggaaaagatacataaattgttcagtatacccatctaccaaatgacacaggcaaccgactaataatcaccctagaaagaactatccaaggaaacgtcggttagcagcgcaaacacccgattcctgtaaacaagactaaaaacaacaatgagcggtgggtcaatacacgaggtactggcaagtcctacccaaaccttgggaaacctaggactattgcaagctgagatcaaaatgagcggtgggtcaatacacgggggaatttactatttgctactctctcaaaatgccagtgctcaaatgccactctcccaaattttcattcccaaatgccacccaggcccacatgtcagcctcactcggtcatggggtcccgcatcacttttgtttgaatggagagtgaggctgacatgtgggtccggatggcatttgggaatgaaaatttgggagagtggcatttgagcactggcattttgagaaagtggcaaatagtaaattctccccaaagatggctatatttgtagctcattttcagtgtaaaacaatttttgtttcgcaatataaatataacatattgaaacggaatttttaaatcaaagagtaaagcataataatagtaatataagtatcatcatatcatccttgtgccccctccatggtagcaagtaatcattatattatcagcccacaccaggcaaaatcatcaccattattcaccatacccatatcgcaattcatttaacaaatcaccaacactatacttgtatcatttcaccaagtcgctcatgaccgtgagcaccggctaatcgattagttttaaactctgcagagtttgtacaactttacccacatgatgtgatagaagccaaaaggctacactctagttgtttcggtacccgtcggtaacccacactctacacattgagcacggtctagaggtcacaacgaagccgttacattgcgtaaagtctagccttgcatgagcatggagagtgtttctccacattggccatgaaccaatgccgctaggaaaggtgggccccatcctaatactaatgttgtaacacatctattccctcaacaaggcactatccattatattggatatgcttagatgcccatgccatatggagaacacgatcgttcccatagagggtcacatgggtagctcctatgagctatcgctcagactagtccctactacaacggccttccaatgcaatgctaaacagtaaacaacttagtaagccaaggttgccccataaccgacagatgtggttgcacggtaagcttagttggtgacacatagttcggtccttaattgactcgggcgaacactccccctatcagcgtagaactatcaccatatgcacaccacttgccgcccaagtttgaaatcatcattttcagtttccaattttcacataataacagaggcaaccgctctgtacaacattttaaaataacccatttgaaagagttaatatcatgtcatttataaccatagcaaattttctaagcatggctaagcaatagctatagtagtagctcgaatatacccatattggtgcttggataggaccacaacccatcctaggtccatcaacaatagggtgatcaataatcaaggtggataatgcaacaattaggagttgttctaccaaagtcccacatttttgcaaacaccgcatgcaattttaaacataataaagcatttgcgaaaatatatgattcaacatgatcgaaggaggaattgatctaatagtacttgcttgctcaagagttactcgaatatttcttgatcctgcacactcccatcaacggcaacaatcgatctgtcctctatttaaatttaaacctatattcaaatgaaaatccaataaaactccaagataaaatatcatgcacggtgcatgaacatgttcagtgtatagatgatggtttaatataaatttaggagaaagattcgcctaaatccgatgttgaatgtgcaagttatcacgtttctaagatattaaaatacggtacgtactattcgaatttaaattagtgaatttttttacaacagtgattctaagtttgagtgtgcagtattaaaaagagagttggaaactaacaaaatctggttcacctcaatcggagctaaaatgaattttctatgattttccaaattttcagcattttatagtgcataaataattaacagaaaatcttttctcagatttaataatttgtttataaaagaaactaaagggcactgcttgaagtacgttttcctatagggaagagaagacgcatttctgttctgtatatctctactctacttttatttaaaaaattcgtagtggtgatggtgaagcacatattttcccgacatgcgatccaacataatgtacatcgacacgcttcagagcggcacactactcctccgcatccctctgcaccacccacgcgcgattcctacggattgctcgcaatccgcaatcagcgggaaaaaaaaacacgctagcgccgccccacatcgccgcgccgttcccccttcgccacggttcatcctcctcgtcgcgagtcccctcggcctccgcaatacgccggggaaccacacctccttcccgtcccgcacctcctcctagatcgccgcaccgataccgcgtcctccaccgtcgctgaatcccttttgccgcgcgcccatcattggatcgagcgttgtcgtcatatccacctccaccgttgtggagtcccccgccccacatccccgtccccggcgtttctccaccccgcatcacctgccgtcgacgctcatcgtttaatctgctcctttccgccaccgccagcgcccggatccacgcctgcccagatcacgctgccgacgccactccccgatctcaactgaccaatgtcgtgcccttacccccagcgccacatcccaccctctcctccccttttggccttcgaggcttcgcttcggtcccacaccgacacgaggtaccgcggctgcagcgccactgctgttttctcagctatgatttgggatcctgtgtgcaaggagtggctgattactccatcctcaatttgttgatttagactttggaggcttggtctgctttgctttgttatttaatttgctgttccttatttttttaaatagatccattcctgttcagaggaggcatacggggcagaatattgttcattcatagagaggcataatgcacagttaatttcaatcactttccattttcactgtaagttttaagttgttccagaaaggccatgatgatattactattagaatgttagattaaaaatgcatgcccagtagatgtttttattaaatgcctctgaaacaatctggatgtgatttcagcatacgtttgtgcaaacagaccctttaatttgattgtctaacagtatcaaatgatgatttttcaagaaaatccactgaggaattttcataatttatttgcaatccacagatgaaattgtactcttcaatctttataacaactaactataatcttttgcccaggggtatttcaatccttacactaatctatttactgtcaattagagaatgtaccaaaagaatttttgtttttgttatcaaatgttgcacatttgatgataatctatatttcttaatactgtctgcaccttttgtttgcaagctccaaattctataaaaaaaaaaccttgactgcaagcttgtttacaattgtttggccagcacagtaggagcagggtctgatcgggtgctccctgtgcataactgctattggttcactgctgttccaaagtgagcaatagtaatttggaatgaaaatataccaatataagaggtttccagcctcgatattcagatgttcataatatatctgaccaaagtagagacaagtttcaggttcatatatctgatcaaagtagtgcccttgccaaattcagttccagagcaacatgcaactcccactaggtgacccaaaaatttcattgtggttccactacaaccaagttaaacacgtcaaagtgaatttcttcttcatgttcggacagaagtgcatagctagatcaagataagctagagagcaacccaatagttagatgacttgaacatagccttataaatagcatgcaagcctataggtatatataatttgattggttttcctgaaaatactaaccaaaatactttttttttgtttttatcaatttggttaattattttacatgataatatttccacgttcggtcatcaacttatggttgttgcacccctgacagaatggctgggcagacaccggtggctcttgggtgaaatgagagcaagtcaaccgatcattttcatgaagagatgaattagacggaacaacagagcctcatgggtatgcaacaaataactagttttttttcctaaacaatacatgatttttcattatgacttaaaacctactctagatgggtcaacaatgggattgcatatttctttacttggtctcagaatgaactgaaatgtttctcttttttcatttaactatattagaaagcacatattgtttgacaatggtattagttgcatattgtattttcaaaatttgaagaactaaagaggttgacatactaaaatgctttgcatgaacattactatgacttttacaccttaagctcaaagttgtcttatttgtccagggactcaaacttttgagatatgtatattggcatgaagagaaaaggatacaaatatatgaagcctctgacttgttgggttgttgtatgtgttagttcctggcaatgcagagctagcactgtaaggaaatgactgtgttgaggcaagtgtcaagcactaacttcttccacaacaaccctgtcttccatggtaaccattccgttactccctccttcccaaattgatcatcacactatgaaattcaagatttctcaaattgatcatcatataaccgcatggacacggatttcatcagaataccattaatacaacatggaagaatgtgtgcatgctaaggtgtaattggcatggtgttaatcgatgcatgtattgtgggagaatgtgtgcatggtatcttgattgatgtgatttaaattatcattggtcttggtgcataaacatatatgatgatcaatttgggaaggagggagtatttcttttgctatgtaatgagaaccattgtgtagaattttgtaaacaactttaaccattgcttctctgcatgcaaatgcagatccattcctttccaaaaggattagttaccatttcttttaatttttacacatatgattagcaattgtctataagcattaggaatgagaatcagatgaaactatagacaaactttccaaagtagtatcaatatgtggccaataatgtgctgttccattcattaattttgttatatgtggtactagcatgtgaatactataaagatgtgaaaattataaatatgtgacgtaattattattagttctatattaagattttttgttacagccgatttacactcaatgattatttaacatcatttcacacggttgtattcattttaaaactgtggggtccatctctcagtgaggggcactcctctaaactttcagccaagcactaaagttttcataaattacatataagtcctaggcctaactgtcagtgtctggcgctttgcagaaagaaccccttttaccctaataacaggactaggtccttcttcttcaacctacaggcagctcgataggcagagaggcacaacggctcgggaatggctcgccggcgatgagcggtggaggggatggctcggcctaaggccggggaaggctggagtcggcgagcgccatggccggtggtgccagcggttctagatgacgggcgggcggtgtgccacggtctatggagattcgattaagggataggggatggcctaaggaaggactactaggagacttaccctgtgcagtgctcggttagagttgaggcggtctgaggcggcgtgacgacgagctcccatggcggcagaggtcggtgacggtggtgacatgacggcgctctagagagggggccctataattagttgatgaaatgggttgaagggtctcctagggtcattctggcgcaaggagatggaagggaaatcaccgtggtggagatttgattggcgtgggttggggggcggtgctctgttcggcgcagaccgtggtggtggtgcggccgttcccggctacccagaggggtttgagcttcggctatgcatggtggagaacgagtgtggtgtggggagttagctggcgcgcttgctcaatttataggcgagggaggagccagaggcggatgcggaggctgttgtgacgcgttcggcgccatccatcctaaaataacaaaccaaactctctcaaacaggatccacctcgtgagttcttaaatgcatgagttcttacaaataaataaatataataaaacctcacccctgcggccctacccggctaccctgcgagtgcgagtgcaaggcgagtccgagacggagtccgtctccagcttggtgctggagtcctattcggaattgtaactcgtgtactgttgtacccgttgcaacgcacgggtattttttctagtaaccttaaatattcctgcatgtgttgtagccgccaccgtctgctagcttctggactgtcccatccgccatgttcaccgcgaagaccgccattggcctccccaacggtgtacaccaccgtaccgctcttctcaccgaaccaccggagctcgatcggggtcgtcctcgccggcctgaggtctggtactcggacgtacacagtgcacgtacgtcgtgtctgtactctccatgcatcagtgtcgtctaattgtgtcttcaacgagcagaatacaagctgggacactcggcgagaagtccccacgttgatgtagcgcaactccgtcctgtccgccaacacccccaagtatgcggagaaccggccagtatcccccataccaatgttcaaaatagccggctatagccaccgctatagcgggctatagcgtttgggcagggttggagctaggatagttagccttttgcgctaaacgattttttccgctcatagcggcaattaaccggctaaatccgctaaactgcagatcatttagcgccactcactttgtagtttagctcctgggccaaaatcagagcaggccttgggccttcgccagtggcccaaaggggaggtagaagatcaagccagcaatctgtgttgtctagactgtaatgaaggcatgaaagaacacttaatttgtttcagtccgtgattttttcttgattccatgttcatatgcataattgttgactgatttctgtctggcaattacaaaaccgctaaatagggttagctgggctatagcccgctatagcctttcttagcctccctagatactagccgctaaaagccttagccggctattttgaacattgccccatacgtgtaaggcaccgaacacacgtccatggctgagtccgatagcgcgcgccgacgaacgcctcccagtggaagggccagtaggccacgccgccgccaaggcatggcctagccgggcgcagtatggtttccttcgttccgggccccagctactgtcgtcagacgagtagcaccgcatagccgtgaagccggggcggttgtagatgatgagcaggcggaagaaggagcgcgatggcggcgtgtcgaggtcgtcaccggtgagtattgcgcacacgcgtagtactgtagtagcctggacagtcgccgccggtcatggggttggagacgacgagcgtgaggccgttgctggcgcgggcgcgcgtcgcgccggagctccaatgacgcggccgttgcggccttgcgggacgccactggctgggcgtagtcgagcagcaaggcctcgccgtccgggagctagaacgggcctaggaaccgcgaggcggatgccgccggaaagaagcgcggctgccgcgagctcgaagccgcgagccacttccgcccccacgcgcagcggccgacgtcgttctcctggtggaagcagccaagggcgaggcttgggaggaaccgagtggggaaccgagctggccgcggcagtgcgcgggagattgtagcggcgtacgtgcgtggccacgaacctgccccagctagcggggacacgtcgacgcgaagcgcgcgacgtcggtggcgtcggagaacacgcggtctggcagagtggtcagaagcgcgccgtcgtttcggcctctctggtggcaacgccggcgcgacagccacccgccggtgtacggcgtggcgtcgcgacgtgcgcgggctcgtcgcagcggcggcatgactagctagagcctggagggtttccccaattgtagttgtgcctgctaaaaggatgcgcttcgatcgttaatggatgacgtacgtgcatgttagggtatatatataggccggcatgtcgagtccgaaattgtgacaatttgtgagtgtgtatccataccagcacaacacgtcgactatcacgggtcacggcaccgaatgagcccgacgcagcgaatccggtcttcagctgcgacgctgcggaggattcttttctcttttcattattatcggtcgacgatctcagccgttggatgttgatcaaacgacttccacatcgtcttcttcctctcgcctcttttttctctctctctattttcgttctcctgctagggcaagctcccccatctctcgcctgacaagtggcaactcctgtcctcgattggcaggacatcgctcaatccatgcaccagcaccaccacaccggctatcttacacagcaccgcgccgagcggcgtccccatcaccgtcttatgcccacacctcctccccatcggccgatgtcaactctcctttaagcccatcggatcaaatcctcgccggcagcacccttcccctaaccccaacaatcaaaaacttagtgtcagcaacccggcctgcttaggaagcgcgtgttgtttgttccatattgtatttgcactcgtattcaaatccagtcgcacagaggcgcgtcaagcgtgcgcacgcgcgataggagggaaagcaactaaggaagcggagtccttggcagtcgcatcgtgcagatgatgctgctacggacgaaaatcaaagggtgacggaagtaaaaatactaatcttttaattcttactatcaaaatgcccgtgcttcgcacggtgtattaaaactaaaaatatttgttcttaaccgaagttattttcgcactgcttctgtacttttgctcgctagaaaaagtatcaaatgatagagagaaatatagtagctcataataaattattattctgaagaaagggagataaaaaaagacaaagccggtttgatttccacctttacacgacgcgagtcaacatggactctgaagatataggtagatctatggggtggctcagtagcacgatcgactagcaaatcagcaagcacccttagaccaattgacggccgaacgatgaccgtagcatggtaggtagcagccgcgtctggctgcaacggacgaagactttggtgaatgaggcttgaagtttgatgttataagaactcgaccgggatcataaccatatcagtgtgtactacggccacgagccacacatacggagctgatcagcacaacaataattaatttacggtgctcggacatgaccacaaagctggagatgaggtgtgtgcaatgccgtgatgatgcgtttggagaggtgactccaagatggtggtcggcgtggtgtgtgtgcgcgctgagagtgtaaggagatcattgagttgatcaacgaaatgggaacatggttgtgtgaggcatgtgccgtggctgaattaaagtggtgcacaatattactgccagaagccgatgcccatgggtatgacgcgccaacctaacaagtgctctggttcctacaacaagacgttgatcatgggcaatatatattgataaaatagcatgccacgagttgctacttgatctaatctcctatacaagttttagttaatttgatttgtacggtcgatttagttaatttggatgtagaaggattcaatttggactttggtggaggggaggggctgctgatgggctttggcctagagcttggacgtgagacatattataaacttttgtagagattgattgatctactgggcttggccaaatgaaggaagagggaggctatgtggactttggaaattatttttcgagctgagcggtagaatggtgggtcccacggagatggggttagagcagtgggtcccctggtaggtcccagtcccaccgtttttctctctttccttttcctcttcttatcttctctctcacactttcccttccttctctcgcttttttcttctctctcggctgcttgcaggcaggagagcgccggcagcgatccaaatggcgtaggcaggagggcgccggagggcagggcaccggggtgcgccagggtagagggagggagctccggcacggttggggatgcgacgagagcggctgtgctcggcgggcgcggcaacgataggaccgcggtggctttgggccggcggcgcagcttggttcggcttcggcgatggcgtggtgcgagctcgacgcacgcgtggcgtccaggagccagaaggaggatgggggcggcgtcgggcggctcggcggcgctcgggaaggaagggcgtgacgttggcgggcagatagaagacctccttccccacgccacttcttcgatctagaagtggttagcatcgatctgcaactggtgggcttggtgggcttgcttgctgcacatgattcgtggatgcaccgctattccaattttatttgtgcgattgaattccaattgggattttttcgggggttgattgaattccgattgggatgggatttgggggtgttgtgacggacaaattttattgggtggattggagttcctcatggatccctatgctgattttattagggtggattagaatttgattcctggtttctcccatgaatccgtctactgattttgtttgggtgaattagagtccgattcttcgaaatttctgaatcggacaccggcattgcaggcgcggtgatgaacgacgcggtgatgaatgacggacgaagaagtgacggacgaaaaatcacgtgggtgaaaaagatgtgacgaaaaatcacgcgggtgaaaagatgcgacgaccggaaaaatatattactagcaaaaagtgtccgtgggttgcaacggaaagtgtacagactagaaaattaagaaaaatttaagaaaaatttacattatgtaattaattaaaatacaaatttgctaaaatatttggtatttttaagtaggtaagtgtataattaaatcaatttacaagtaaagccagtgtgagaaataaaatgacattgttaaatttaattttactaaattctccacgattagttacgctctttgaaattttattggaattatcaaagcttaattgctaatgtttaataatacaaacatcatttaacaattatttaattggaaaaagaattaaaatccttcattctaggtttgggccgaatatagaaaagtttatattttctcccttttgtctattcaatgtgcctggcctgtttcctttttccgttgaagtccattttgtgtcctccattcggtggcccaatatgccggcggcatgacccgggagcagctggagccgtccgatcgaatggacggtctagattaatcctaacctaaataaatacacctaaaccctaaccctaaccctaggattcatttttcccctttcccccgcccccaatctcctcgagcggaggcggcggcggcgcccaccaccctccttcccccgagcgactgcggcgacacggagcaacgaccggcgagcggcgcccccctccccctcccccgagcggcgataggcggctatataccaaagccgcaactctagagttcatccgtaagcgcacagatataccattgtagcatttcacccgagagtattccaaggatatcgtatttattttatcccgtgggaagatcatgtagagagaacttgactaataatttatatattacttgtgataatcacattctaagcaggggttaagataatccaagggtagaatgacacacaagcatcaactactcattatcataatatattatctaagctaagtggatggaaaagagaaatataatctattcctatacttctaatatacatagtatacatacattctagttaaccgatatactagctaagaccctctatccgatgccctcctggtacttcgggaagtcacccctgactgccgagttccttacgacagcccgtcatgaccatacaaacgggactaaatacgaagaaataccctccccagggaattaacttaggattatataccggcacggaggaatacccgtactgagctgtcaccatcagcggcccacctctcatccgcaatatataaccccaaataataatatcccgtaagctagacaccacgtctaaactaccagatactactctaatatcatcgtcatgacatagagtaattgcatatgcaaacattatacccgcaccaatgcatctcccagataagctagctgtatattcagtataacaagaacataatgtaaagtaggtacttatatacttggaaagtatttcaataccataaatgtatttagaagagtattctaataaaagtacaaagcttacaaaagagaagagaaaagctactagagccatacccgaactattccgaaggctgtaggatcgaatcacaagaactaagccaaccagatgggggttgaatggttggtatacccaaaaaccgaaaacttttagcggaaataaaagttaccctcgaaatcgatggatcgcggtctgaccgaagtagttgcgccggtctgaccgcctgatgaacgtcagtctgaccgatgtagatcgatcggtcgaaccgccgagaaatcctgccgccgattcctgtcgccgccggtctgaccgccgtgtgcccgccagtcggaccaccgagatgcctccggtctgaccgccggtgcgccgccggttagaccgccgaaacccggtgaaacacaaatcgaagaactcttaaagtggatgacgactttattgattctctctgtgtttacaaagtgcaccaacaacactccttacaaaaatttcgactaaactcgaaaccctaactcaaaacttaactatattgctctcaaaagcgatgccgggaatcctcacgctccctctctatttatacgtgaggtaggtagcctaaagccacgaaccaaactcatactaggagtcctaaacaccttaggaaaccctctagtacaagaaagaaactttacataaccaaacgtaccaaatttggactccttccaaattcgactccgcatcccacacgcacacaataactctatcgtatgccatatggaaactccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccaagaccaagctatctccaacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttcgtgaataaattccaaatatcaaaaccaataatctccaatgcccaattgttcatcatagaataataatcaaaaacacctttgattttacaaaggcttccggactcctgattcctactctattcctattccaccagctagatactagtaaactgaacttgagagaaatgagagagatattgcttgaggtgtgtgagtgaagtgagaaggcgaagtctttttataggcaggtatgacggttgtaaccgctgcaaaatgtctgaagtgccccgcaaccgtcatcaagagaagatctggagcgtcactgccaaccccacatccaaggccagcccaacctagcccaaaatcggcaggtggcctcctccgttgcttcacttcgtagacttgtgaattttggcccaattcatcgtgtcaattctgagttctttgcccattcatgcataagtttaattctcgacaccgtccgattgatttatcgtctatgttgatgtcgattctcctccactttagtgtcattctctgcaaaaggttggtatacataatactagtgtaatattattattctaacatatttatgcattgcaagtatcactagttctcctctattttggtaatattgacggtcaaaactgattgataacaaccatcagcaacatatttcaccaatactagtggatacgattagtaataatccctaccactaagttggataccatattttattccattatatgcaagcattgacggtcagatatcatgatttaagaaccgtcaacacccgcgtcaaacacttggcgagcgtgcagacggactttgtcttcatcgagaagaagacgcattacatttgggccctcctataagactcacaacttacatgtcatcccttttaacataaagactccacctagtagagagttatactcttttttattagcattagtgtaatttcttgccttgccctatccctctcgcccaggcgcccaccctttgacctcctataagactcacatcttatatgtcatcccttttaacagaaagaccccaaatttcatgccttgccctatccctcccgcccaggcgcccacccctctctttctattgctctcgtgttgctctttgtcctctccaatcatggatgatctcaaccattactagactatttcttagcagaggattttgccatgccttgcataccgcaagctttttttaggtttgtgtatattgctgcccaaaccacgccgttgcccatcaccctgacacaaatacggttttggtcgaaggattgatcaaactatcctctattttttcctctctatgcgccatcttttggattaacattgctccatgcgctatctttattggatttatattttatttatttatttatttttgcttgttcacatctagtcatgatggagagttttcccgcccttacgcaccaacgggatgagtatgactgtaaccacgttcagagtaccaaaaatgatgcaagatgttccggagggatatgccgaatagatcattgtccgtgtttgagccttatttgatggacttagatggttcttgtgtgcgatttattgattgaactctgagtcctcatttttagatggacttagacgattttttttgttatgattcttgtgtggaatttcctcatacgaggaaaacttgtgtcgttgcagcactgggttttgtatagtgcgttaccaagatttactgtctcacatggttttatttgtatttggtttggatcagtggcaggtttggattagtggcatagggaggggagaagggagaggcctggtctcccataacaaaataaaattgtaattatcaaatatatctacttaatcatcacatgattaaattagcagtaagtgttttaatcccctatagtgacagaaaatccaacacccctctagtgacaggaaatccttctaatattggaagataattggctgtgttttaatccctctagtgatatagtgtatatggatgagcatggaacactggaataatcacgttttatggtcgaatcatgagtttgattactaatgcgataactgcgttaatatacctacttcctcgcaaagtttggatcaaagtgcctaattccctacttaatttcttccatgatttggttgatgtctgctgaattccgttgtgtgacatgagagcgtgactaaattatgtttgctgtttttttaggtatcggcagtacaacacggtcgaaggtggcaattgtcaacgtaaattttaatcaacttttgtgtggagtttttcgagccagcactccttgaaatatatgtcccaccacccagttgaataggaaattaacttttagagataactaattttaaactatataatataacataatatatacttatacatagtgaaagtcataaatcagttgaacaatatttatagcgcactatgatcatcagatttacaacaaatgttacttaccaattatatatatattagttaagagcattctagatgatatttaagaaaaaatatctctcaaattctaaaatctaattaatcaacttggaagcatacagtgtaattaatatgtcacggtaattactactaactcctgtaaaaattacaaataatataatacaaagcatgggcacacaaaccaactggcagtgtttattggctaaagctatcagtatcatcatcaataataaagaaaaatgagataacaaggagatggaagagtggaagaataccatgagaaaatttcatttttatcctacattgtgctaaggaacaaattcgcgttaaaaaatatgaaaatttaataatattagtaaatcattgatgagtatattatacaatgtctttctgaaatatatgacatccagccagggagtgtgagcttgtcatgtgagttgggcacctctttttgctgggagcctctctttattgcgattcaaagtgcttaggttgaggtagttctctatctactgcccctgtaacatactatatttttcagggtaatttttttacgaaaatctttaaagtcgttgttctttgttctttcgaattgaagcctcccaatccttacattccttttgtttccttttaattttccaactccctcgtaacttcgtttagttttccctccaaaccaaatccaagatatcacaaaaaaaaattcccaaaaccatccgaagagctcgtgtttatttttaagttctcgtgtttatttttaagttagcccgaagtcatcatgcaaatattctaagatccccaatcccaaagattcctattcggaaatattttacaagaattcgattaaaaaatctcttcaaaaatttaaatagatcactatgattctcctcaggccgaattctttgcaatctagcccatattcccaatttactttccattgctcctctgtattgggctgttctaacccatctcccgcacaaccacccagctagcagcccattgccgttgctggccgagcctccaactgacacgctgctcgtttcgctcgctccagccaccgctcgcgttacgcgcgtttcgcctcgcacctccctgcgccttgcttgcgcccgctgcccgcatgcgcttggcccgcgctagccgcgtgccgcctcgcacctgcctgctctgctccgcgtgccgccacgcgcacgacacacgcgcttgaagtcgctcgaaggaactcgatcagatggtgccgacgttgtcgcacaaatcttaaaaccgagcaagcaccactgctaccgtcaatctcccgctgcccaactatntaagcaggcaaggtagctgtgctcatccttttccaaatcactttctgtcttcaatttcttcaagccacgctgccgtggtcatccgcggatccgccgccgcaggccaccgatcgtcgtctgctcgcaccaccagcctctttgttgcttcctgcttctgcaaaattgaccatgcatccatccaattataggccatgtgaattaaatcagtgggatcatttggaagttttttctcaaagcaagctttatttctacatttccatttagaccatatcacaacagcaatcccaaccacaatgagattttttatgaatttgtcagcattcttaatctaggaaccaaacagttcatgcctgttcaaaacaggtttcaaatttagagcacaagaaataatcttccaaatcaatctagccgtgggacaagcaaagaaaaagtgttgaattgtttcttccttatcacaaaactgacatttattatcacctttcctccagcccctcttgaaaagattgtcattttgtcaagattttattattggtaaagagccaaagaaacactttgattttcaaaggtacttttgaacttccagatttttttatgagggtaattcacttgcttaattttaagtgcattacagaaagatttcacagtgaatttcccatctttggacaaggtccatcagagtttgtctcaacaattttctttaaaattcaactcttcccagttgtgtataatttttctccaatatctcagtttggctccagacagatcccttttgagttttatagagccaacaccttttttgttcaagtcagcaatggtgatctttttttttttttgtcaagggtatgttatgaatctcagggaattgcaaggccaaaggtctaccacctatccagctatcttcccaaaaaaaaaagaagaatattttctctatttcccacttttttattcacagactgaagaaaacatctttcacctctataatccattgccaaaaatgtgaattaccaggtttgagtttcagaccagatagtggtttgtttttgtaatatttctcaataatgatctcttgccaccaaccctcttcattctctaatttccagatccactttcccagcaaagctttgttcattgcttacaaatcaatcaccccaagacctccttagtctctgggtgaacaaactaggggccaattaactagatggtactttctaataccttgatcttcttgccatagaaatctttttctgaagtaatccattctatctttcaccccttttggcagttcataaaaagagagcatgtacataggaacactacttaaacttgaattaagcagcaccagccttcctccaatagattgcagcttacctggccagcaacccaatttatgctccattttgttctcagccaccttccagtccttgtttagtattcttttttggtcaatgggaatatccaaatatttcagaggtaaatcaaccacattgcaggtgaaaatattgctatatacatgttgtttttccttagcttcccaaagcaaaaaaaaaaaaaaacctcactttatcttaagtccagcaagttgctcaaacagacacaagatgtacttcaaattttttgcatgctccag

SEQ ID NO: 30871 - DNA, 652 bp, Oryza sativa
cctttgctttcagaatcggatagataaagacccagtccccttatcgtatgtttcttcgaataaaactttaaacaagatcccactctgcatttttttgatgtactgaattcaatacttcatgtaatatcaccattccttccatgatgaaacgatttttcagaaaagttgtttgttgtttagagataatgtatgccatgattgtgttgagtctattcatgaggactttagttattatcttaaagcttacattcagcagacatatgggacgaaatttttgtatttgagaggcatcttttgttttgggaatcaatgtaatcactccaaagttcaatctatcaatatttattaaacccttgataaaatcatttatcaagtcaatcatgtcatgtttgaccaagtcccaaaaatgcatgtaaaattctcctgttattccatcgggacctggggctttgttcttttttagttcaaaaatcattgttttgagttcctctaaagtgataggaatggttaacatcttcatatcttcctttgccaccttagatacatttgccatatcaattgaaaacatgttttcctttgaatgtccaaagagatctttgtaaaaatttctaatatgaagcaacaaacttatcttatccttcaatcacctctc

SEQ ID NO: 30872 - DNA, 381 bp, Oryza sativa
ccgacgatcgccaccatcgttacccgccgccgcaatgctcctcgccgctgtcaagcccgcactcgtcgagccgctccttctcccggaaaaggttcgaattaaatttgaaaatatactgtttatttacattttttctcaataatattcgagatgcaaaactttttacacaaatataccatcggtctcgctcaaccgttgcgcgagagtgatgtgggaatgacgtcccgagcggtctcgcggaatggaagagagagaccgaacggtctcgcaaaatcaaacagcgacacagtcggacggctcgatttgattagtgattaattacttaattaacaattaactaataataattagtggattaattatcctaattaatgattaatt

SEQ ID NO: 30873 - DNA, 265 bp, Oryza sativa
gcggaccggtcaaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagtggttttggagatgattggatttcatagatgaatctgcaggattttatcattttgtgcg
